United States Patent 7,868,149 (PLANT GENOME SEQUENCE AND USES THEREOF) - sequence listing, part 74

SEQ ID NO: 40267 - DNA, 19844 bp, Oryza sativa
ccgacggcgagccggtcgaggtgacagaggcggcggcgaggatctccaaggtcatcggggacaagatcgacgccggccgcggcggcgaggccatcccgctcccacacgtcgacaaaaagaccctcaagaaggtgatcgagtactgcgacgagcacgccaacgagaactccgacaccgacgagcagaaagaggaactcaagaactgggacaaggccttcatcgacgagctggacgaggacgacggctccttcctcttcttggtcctcctggcctccagctacctcaaaatcgatgggctcctcgacctcacctaccagagggtcgccgacaatagcaaggccaagaccaccgaggagatccgcaagaccttcagtaccatcgagatcgaactcagcgacaaggaggaggaggagcagcagcaggaggaggagatccgcccggagaacgtctgaatcttgaagtatagtactcacttcgatctcttaacccgcagtgtttctcgtcgtgtgatggcgccatggcggctgtctcgtagttgtgtgtgttgtggctctggtagatttagatcgaattggggagttcgtgcatcctgtccaagaagaacagagtcgatcggttgtgtcgttgaatgagttgaactgctggatcgcttgcatgaagtgaatattttgaccccaaattgtttgctacgtgcctctatccgattggttttcatgcagtttggattctggtgtgagttgaatttgaatatagaagggagaactttctctgaaattctgaatgctgcgtttcgtttctgatgcatggactgatccgtcagtactgatgccttagtctgttgtttggttaactaaaccaactacctgcatgtctgaattcttctgcatccgaagcattttcgtttcagatatgcatgtggactgatacccagtatattgcattcttcagcatctgaagaatttcatttcagagatgtatggacttactgatttggtagatgaagaagaagacggccacggcgatgatgatcgtgacgccccggccgaccgtgacgactgtgcccgtggcaggagaagaggtcgccgggggcacaacaacgaccaccccagggctaatcaaaactggcgatgcagggattgagacgacgacgattggaatgaacggggacgagactttgggcgtggccgcggcgaacaacgtgcgattgatcaagactaccgccgtgaacgcacacgctccccgcgccagcgcgacaggggagggcacagtcaccatggcggccggcgtcatcacgctggtgccaccgacgtggacaacgtcaccgatcctgtctaccccgagccacacctggcagagatctctctgccttcccgccagcaggagcttcacaccgaggtttgcatatttcgattgctgcatgctttgcacacttccccgttcaagatgcaggaaatcccggcgtgatcagctgcttcgcctcgcgcttgtcgctgataaggccatggctgcgccacctccgacggcgatggaggacctggccatccggtcttccactgggactgaagcctggttcagcggcacggcatggaagccagtgcctgttgcgcgtgtctttggccgtatcagggaggccttgccggccacgccagcggtcgaaacgccgacaacctaccagcaaattgaggaggcgctgatgcgccttgagctcgctgccgctgcagctcgcaccccaggcgatgacactctcctaccacagcccatgtcaccggcacctctcgcagcgtccccgcctcgccgcttggaagatctggccagcgacgctgtggccgacaagattctgccggctccgctccccggggcgctgcttccccaagagatgacccatatgccagccaccccgcccctgtggcgctggagcggggctcgctgccggaacgcgcatcctcgccatgcgccatcgcgggactgttcacttggcctccgccggctatcattgcgtcgccgctgcgctcgacgcttccatgtctgcggccggtcgtcctcacaaggaaggtgaagctccggccgaggcagcatagccaggcaatccggcggagtgagcacctcgccaagcaacctgcaagaccgatgatggagaggtgccagcgcatcctattcaggaggttgggcatcctccatgacgaagaagatgcctccgtggagcgcgttctcagccagtacatggccatgtttgatgggcccctgccgccgcacgccatcgccgccttgacggcgatcttcggcctcgacgacgatgatgagtgcgccatggatgcctctctgctcccccttgtgggcgaagggatcactgatgtggccgatgaagtggaagaaacgctcgcttgagcagcgcctgcgcccgcggattcggagctgtcgtcgctccatgtatcatcggattcggagctgtcatcgctccatgtatcgtcgccgtcttttcttttgcagctggcgtgccgccggtggcctgcgtgccgcctccctagcatttctatggaacctcagctcttggagcacatgtcggtcagaacttcgtttggcttcaccctgcctgctgtcttttttcctgcttgcgccgcgcctcgtccgccgccggcgtctgtgtgtatgtgcgccgctgtgacgaaggcagaaatgatgacgacgacgctagcggctccccagccacgggccatacctctcgctgggccttgcttgggccttcgcgctctcgctcgggcctcaacgcgccttctaaggccgtcctccatcttgggcctcgttgggttgcgcgtgcaacgacattcgaggccgacgccattatggccacatgggatcttctcggctcaagtccccttcccctccctcgcgccaagcaggccgtgctccaaccccggctgggcctactcccccaatcaagagtccacctttgatttgcagatgtcgcacagtctagatttcattagttggaatgtgagggggctcaattcgccagcacactgcaacacggtccacgagatgatgttggatacgaagtgcaacctagcatgcctccaagagacgaaacttcagaacatctacgacggcctcgcccgcttcctgggtggctacaaattggatagctttgccttcaaaccggccacgggcacgagagggggaattctcatcctttggaacagtgctgtcctcgtcctacaagatattcgaatcggccgcttttcgatctcagcacaagtgacggtcccactcacaggggctaccttccttatgaccggggtgtacgggcccacgagacaccggcttaaggatggcttccttaggcacataaggcggctaaagcccaatgctggcgaagggtggctcctattcggggatttcaacatgatctaccgagcaagggacaaaaacaatggcaaccttaatctagctcgcatgaggcgctttcgagcgacaatcgatcgatgtgaactccgcgagatccccttgcaaaacaggagattcacctggagtaatgagcgtcaaaggcccactctagtgaagcttgatcgttgtttctgcaatgagaactgggatctcgccttccatcaccatgtcctgcatgccctcccaacagggccgtcagaccactgccctctcgttctttcaaatcccgctgccccgcgcaagccgcgcccctttagatttgagaacttttggacacgcattccgggtttcaaggacatggtcaaggctagttggacccaaccatccccgcacacagagccgatgcaccgcctaaattacaagctacagcgcacagcttcttgcattaaaacctgggctaaaagtctattcacggaggtgaaaattcagtttcacatggcactcgatgtcattcagcggcttgatgtggcccaggaacacagagatctctctggcccggaattgcggctgagagctgccctaaagcgcaaaactctgactctcgccacgatagagagggcaaggaaaagacatgcttccaggttgactcatatccgtgaaggggaggcaaacataaagttttttcacctcagggtgaatgcgcgtaggaggaagaatagcattcaaagacccagcaaagaaaatggctgggcagtcactcacgatgagaaagaaatgaccattcttgaccacttcgcccatttaatgggtcggccggggccgaggccgaatgagctcaactgggaagctctagacatccagcctttcgacctctctaccttggaagagcctttcttggagcaggagatccaccaggctatcaaagagatgccagttgacaaagcgccagggccgaatggttacactggtatcttctttaaaatttgttgggatatcgtcaaggaggatgtttcccttgtcttcaattccatcttcaacctccgctacgccagcttgggcctccttaactcagcgaatattgtgttgatcccgaagaaggaaggggcggagagtgtttcggactacaggccgattaatctaatccatagcatagccaaaatcttctccaagctgctggcgttgtggctgaggccccacatgcactccttggtctccatcaaccaaagcgccttcatcaagggaagaagcattcatgacaacttcctctttgtgaggaacatggccagaagatttcaccgtacgaatcggccgatgctcctcttcaagctcgacatcacgaaagcatttgattctattcgttgggactacttgatggcccttttgcaacgcctaggcttccctgtaaaatggagagactggctaggtgatggctaggtgacctcctatacacatctacctcgcaagttcttctcaacggcatcctggtcaaagaatcacgcatgggagaggacttcggcagggagacccgctgtctccgctcctttttgtcctagcaatcgaccctctccaacgtctccttacaaaggcaacagacctgggttcgctctctaagcttcgaggcagaatgcctcgcctaagaacatctatgtatgcagatgacgctgccattttcgtcaatcccacaagaggggatgtccaagcgctcacggaaatcctgcaacgtttcggtacggccactggactcgttaccaacttccaaaaatctcaagtcgcggccatcaaatgcaataacattgatttggacgacgtcctagagggagtcccagcagtgagagcatgcttctcgatcaaacctgggactccccctgatcctcgggcggatgcgaaaggcggacatgcagcacatctctgataagatcacagggcgtataataggatggagaggcaaaaacatgggacttgccgggaggtccacacttttaaaatcagtgcttacggcgcagccaatctacttactgaccgctctgaaaacttcaaaggaagccttggagtgcctagacaagcagcggcgacgttttctctaggctggcacgggggacatcacgggtggaaaatgcaaagtcaattggacaaagacgtgtctgccaattaggcaaggaggcctcgaggtcctgaacctagaaagattcatgagagccctgcgtctacgctggctgtggcatgaatggaaggacccaaacaagccatgggttggtctcgagatcccctgcgacgaagtagacaagagcttgtttgccgcatccactaagataaccattggtgatgggaatatagcgcgattctgggacactgcgtggattgatgggagaagaccaaaggacctcatgcccctagtatatgcaatttctaagaagaggaaaaagaacctgcgccaaggaaaggagaatgatgcctgggtaggtgatttggcactggagacaaacccagtaattacagtggcccttgtggagcagctggttgccctatggactgcagtctgcaacgtgcagttagaagaagaagagtcagaccaaatcgcctggaagttcactcctcatgggcactactcggcttcatcggcctacaaagcgcagtgtgttggcgcgcctgacacaacttttgactccttgatctggaaggtctgggcgcccggaaaatgcaaactccacgcttggcttatcatacaaaatagggtttggacctctgaccggcttgcgactaggggttgacaaaataatggcaagtgccctctctgcagaagagaatatgaaacggctttgcacctcgtcgccgagtgcaggtatacgagacggatttggaacctcgttgcgacatgggtagggttccaccagctagaaccccgacgctggggggtggcgcaatcggtcaaagattggtgggaaatgctggcctctgtgtctggcgtccccaagaagggactccgcactctgattctactcatcgtatgggaagtctggaaggagcgaaataggaggatatttgatcataaggaagccacaacctcgtatctcctttcaaagataaaagaagaggctggcatgtgggccttggcaggtgccaagcgtcttggagagatcatctcgcagtttgtatagtgtacagctttccttgtttttttgctttttctttacccctaggggttgtatttttctcctgctatattcaatgaataagcacattcttgtgctggttcctttaaaaaaaaaactgatttggtgggacaagtttaacccaattcttccctgcatgtgttcttctttcttccgcatcatgtagccatttagctaattggcgcagtagttgtgtttgctcactcaactagtagtggtctaatgcatcatgtttgtgaatgctaagtgtttttaccggttcatttggaatgcatgactttatatggttttgtatatatgaattaattacttcatttaccataaaaatcctgtaagatttcttcatttcagaaggtggctaactacaaaaaattctttgagggaactatcaacaaattaattaacctcagttgccaattgaatataatagtgtttcctttaaagaaattgattaagctcagttgagtttcttcgcacaaactctgaacaccttcttaaaagttagcaatttattttacaaaaggaaaaagtacgaattacccccccgaactatcgtggtcgaccgaattaccccccgaaccacaaaactggacattcttcaccccccaactatgcaaaccggacgaattacccccctggacccaatccacggttgttttagtctacgtggcgtacgcgtggcagtccagtcagcattctatttattaaaaaatgtgggacccacctgtcatacactcatactctctcttctctttctcactcttcctctctctcttctctttcactctctctctctcacagaggaggggcggctgggcgccggtgtccggtgggatggagggtgggcgggaggcagcagccgcgaaggagctggccggcggtggaggtgggggcgccgtcggagcggcgaggcgaagggggcctcgagccgtctcccatctggtcgtcctcctctgccaccagcgccgaccacgccggctcctcccctggcccgatggggatctcgacgtgcgtgaatcgcgtggccggaggggcggctagcgggcgtcggatcacatcctgctgctgcttcttctatgtgtcggaaaggagcatgacgatggcgacggggttgcggtcacggtggtcctcgagcaccttggtggccttgcgcagcgcgtcgcagacgcagacggcctaccctggccctgggcggcggcgcagtcgacgaggcggtcgacgatctggcaggcgggcggagcgctggccctggcgcgtcatccaacgcagcggcaggaggcgccggaaaaggcgacaatggcgaggcggtcggattgcatcctgctctgagctctgtccgagatggaggggggaagcagcgccgagctccgtccgcccgcacgcgcgcgagctacgtccgcctgcacgccgccgagagggaggggggaagccgcgcgcgagctacgtccgcctgcacgccgccgagagggagggggggaagccgcgccaagcggccgcctctctcttcgtcagttagcgggcagtggcgtgcaggccggcggccggcacgcatggcgtgggtgcgcggggaagggaggtgggcggagccacgcgtgcccgcggaggcggcgatgacgcgcgtgcccggcagaggcggcggagccgcccgtggccaccataccccacggagttcacgccttgcatgcttctgctcaaggaccgtgtacgagcgcgagcaggaccatgcatgctgctgggtgctgatgaagtgatgccttcatgcatacgaaagctgcctattcctcgaagctctcggagcgaggtagccctttgccggccgcggaggcagccatgagctcgggacgaccaccattttttgtgcatcgtccgccagaggcggccgtggaggcgtccatccgccgcacggggacgaccggccatggtgctgctagtgcgcccgtctcgccactgcgggagggactgcgatgcagtcgtgaggctgcggcggcgcagtcgcggaggcaacacgagggttggtcacttggtcgtggcggcatcacgcgaagttgttgggaatagtcccacattgctaatctagggggagttaaaccaacttaaaagtggggggagcccctcacctcttgagctagcttttggggtgtagcaaggctttctcccggttgggccaacgtctcccggtttggggccaacaagtggtatcagagccaaacccacaatctctagtgtttgtgcacactcagggtagtgtaagcccaaagcccagtggaccgcgggtgtgaggcccgtatgtgcctgtgtgtggggccggtcagggctaaggggcaccaatgtgtgacgaggaagattgttgggaatatagcttttggggtgtagtaaggctttctcctggttgggccaacgtctcccagttttgggccaacaggagtgtgtagtaaggctttctcctggttgggccaacgtctcccagttttgggccaacaggagttggggccgcacgcggccagcaccatagcggagccgcgtgcgcgcccaccgccggcccgcccctacgccgccgcccatcgcccttccccgctccgtgccatgcgtgccgctgcccgttgaatgacgaagatagaggaagagagaaagaggggatgatatgtgggatcctaccattaaaaaaataaaatgctgactgaactgtcacgcgtacagggtgaaaaatgtccggttttgtggttcaggggggtaattcgatcgaccgtgatagttcagaggagtaattcgtattttttcctttacaaaaaggaatactctagttggtactatctccttttctagagatcaaagatgagtgatgtggcatcagtcgcctaatgatgaagagcagtactcatatcttgcagtttgcaggtcaagtaaaaggaaaaacatggcgtgacatgatcacaattcacaaactctttcggcttgcacactctttatcttggtgcatatggctgcagaggaacaatagaattttcagtggcagctacgaagttagcagatgtagtgcacatgatcacaaacctgtgcaaggcctgagaggaagctttagctacaatgtactagttttcatggcttctctgcgtttcgttgttgttttttctgctttctcgtatcaatgaaatggcagagctcctgcccctacactcgatgaaaaaaaaatatggtgtcacagaatatttgctaaaatatccatattactcctagtaatcaggcatgttccttggttgctccggtgacttcttagaaggaaattaagatggtgaaaattctcctaactatgaaccacttgttaattgttactagcatcagttactgtaatccatcattatgccggagtccgagttgatttaataaatcttaagcggtgatacgatccccaacgatcaaatcaaagagacaaatatatacagtaggagtcttcagagaaaaattcaaaatatgtaaacgtgaggaaatttttaccaaccgacaaaagaggagaaaaatgggagcaatgtactgtatgacaacatggtcctcataaatgggccgaatctattacaattgccacagcctctggcccaacgtggcccgcaaaacgcagccgctctcgtccagctggcgtgccaggtaaggcttgcattgcagtagaaaaaaaaaacgtaacggacacgaaagcgagcacgcctcctgacccgaacccgctcgccggcggctatatataccggcgactccgacctctcagtctctcaccgatcaatccatctcgtgtgccacaccatccacggcaagaagagttagggctcagcaagagaaagcgatcgagcgatggcggaggagaaggggaaggcggtgatgccgatggaggtggatcaggtggaggacgagagagaggccgagacggtggtggaggcggtgcagaaggcggtgtacgatgctttggagaaggtggagatgatggaggaggagggagaggccgcggtggcggaggcggcggataagttgctagaggaggcggtggagaaggcggtgacggaggcgttggaggaggcggggtgggacgcggcggagaaggcgttgtccgatgatttggagaaggtctcgctggaggcggagagcgctaggatgatcaccctcgagagctccgacggcgaggtggtcaaggtgaaggaggcgtcggcgaggctgtccaagaccatcgggaacatcatcgatgacggccgcggcgacgaggccatcccgctcccggacgtcagctacaagaccctcaagaaggtggtcgagtactgcgacaagcacgccgacgagaagtccgacaccgacgagcagaaagaggagctcaagaactgggacaaggccttcatcgacgagctggccgaggacgacgactccctcgtcaaggtcatcatggcctccaactacctcaaaatcgatggactccacaacctcgcctcccagtgcaagaccacccgcgagcagatcggcaaggcctgaaacatcgagatcgagctcggcgacaaggaggaggaggaggaggagacccgcccggagaacgtctgagtcttgaagtaatactcactaatctcttaacccgtagtgtcctcgtcgtgtaatggtggttctctcgtagttgtgtgttgtgcctctggtagattcagatcggatcggggagttcgtgcatcttgtccaagaagaacagagtcggctgtgtcgttgagtactttgtactgctggatcgcttgcatgaagtgaatattttgccccgaaattgtttgctgtgtctgcttggctttcatgcagttagtcttcttgttaaatatttgctctatttctagctatctactcgttcgcatctggttcgatgttgggattccaatccaggagattcggttgcagatttgcaacatttctcagtggtcagtgctcgatcgatcaggggatgtgtttcctgctcttgagtttgtattgggtgcaagtttggtgttgcattttgcttggattgtggttcggattaatttgagaaggggaaaaaacatcgttgcatttttatctggaattctgaatgctgctttcgcttcagagatacagactgatctgttcgaaatgatccatgcgtgtctgaattttcttctgcatctgaagcgtttcgtttcagatatgcatatggactccctagtatgttctgtgttgcattcttgtgcatctgaagcatttgtttcagaaatttggattgatcctccctaagtatgttatgggtttccggatctgaagcatttttcgtttcattgatgcatggacagatctagcagaagaatgttcttggtcgtttggttaagttaacccacttcatttccctgcatgtggtctgctttctcaagcattattaggatggtgtcctactgtgttgtttggttcataaaatttctgtacgtgttctgaattcctgagctctgctccagattagttagcaacaatccaatgcctgaacttttgccttttgttttgagacattatgagagctacagctacagcacctttgcttccttcttgtgtgtgttccatgtaaatttgctgtacaattgtaaatctgcttgagttggcgttgtctctgaacttgtgaacaggggattgcacagtttcagtcgacatgtacatttcttaaaatctggaacttaattttagagagaaaactgaagataactaattaccgtgtgattcaatgtaatccgagtttaatgctgtgtcagcagaactccaggtcactaggccttatttgggtgcctggaaggattcccagggccagatatctgtttgaatttcattaaaggtagaggacatgttcaattttgctttgattctagtgcaaaatgtactaagtggaaaaaatgcatcgtcgcagttttgtctgaatgctgcatttcgtttcagatatactcagtacgtgcgctttcaccaggagagtatggaggatgatgcagggatggattggaatcaatttcctcttgcctacagagaacgaaccagccctggcagattggtggatgaaggcgaggatggcttttcggacgggctacaggagcatcttcgacagtgttttcgcgctaacatgttggctgctgtggaaagaacgcaatgcgcgtgtctttgaacagaaatttcgaagcatagaacagcttgtgcaagatatcaaggaagaggccattgtctggaagatggcaggagtgttcaaaaaaaaaaactagaatattagggaaggacctaatatcaaataattaggaggggtgaggctttgaacccaggttgtctagcccaccaccttgtggagctagccagaagacccctgggcatttctcaatggcaggagtgttcacaacgtgcaatagcgagatcacgtaatatgcattgtaatttgtagaagttttctagcttacgggtcagggattttgccccaatctgttttcgacagcttactgtcgttgtaagctctttaattgtaatgtacccttcctttcttaatgaaattggtcgaccgaacctttcggccgacctggcaaaaaaaagatatactcagtacgttgtccgttgtttggttaattaacccaactccatgcgtatgcctgaattttcttctgcatctgaagcattttgtttcagatagcacttctgtatctgaagaatttcgtttctgagatgagattcatggacttatctcacagtatgttctgagttgtttggtcaggttaacccaatccctgcatgtgctgtgcttctagttgaggcaggattccacgtagttgttttgctcaacttgtgcatcatgtttgcaagttgcaatgctaattgtgtttatgggctcctttggaatgctgaatgcatgaattttataaataatcacttcagttcagctcagttgccaattgaaatcagttgccaatcaaagacgagtgatgtaataagttcagtgctaagttgccgaatgaaataatagtactgcagttttttgtggaaccaagcagcatgtgttatactctaccttgcaatttgtaggttaagtaacaggaaaatggcgttacataatatttggtaaaatactcttgttaattagagccgaactagaaaaacccgtgtatgaacaagctgaaattaggcacattccttggttgctgtgatttcagtgttagttttacccatccacctactctaaaaagaaaattaagacggaaaaatttctatggagtcctaataacggaccacttgtcagtagttcataaatatgccggagacttccacttaaataataattggcgatacacgatcgtcaacgatcattgaaaagaaaaatatatatatactccaatatacagcaggagtttttcagtacgagaaaaaaaaaactccacaaaacatataaacgtgaggagacttgacaaccgtacaaaaaactttgtacagtggtcagtggtgtggccctcataaatgggccgattccattacaaattctcagcccatatacaacaaatcccccttgttccagtcggcccagcagccagcccaatctagcagcccaacacggcctggacaaaacagtagtccgtccagctggcgagccagctaggcttggagaagaggcttgaagcgaaagcgagcacgcctccaccgccggcgaggctatatatatcggcgaccccttctgcctccgacctcgcaccgatcaatccggctcgcgccaccgcatcgcattcgcatccacggcgagcgcttaggtagtcactagtcagtgcaaggagagctagggctcgatctttgtgagcgagtgatggcggaggagaaggggaaggggaaggaggagggagagggctccgcgatggcgtcgaaggcggcggggattctggtggtgccgggtgcggtgggggtggggaatgcgttgttggaggcgttcgcgaaggtggcggtggagaagaaggacgaggtcgcgacggtgtcggagctggtgcggaagctggtgtcggagggggtggcggaggaggtggcggtgaccgaggcgttggagcatccggtgtttgattcgccggagaaggtggtgcccgaggtggcggaggaggaggagagcggcggcaggatgatcaccctcaagagcttggacggcaagacggtcaaggtgaaggaggcgtcggcgaggctgtccgagaccatcgggaacctcatcgacgacggccgccgccgcggcgacgagaccatcccgcgcctgttcgtcagctacaaggccctcatgaaggtgatcgagtactgcgacgagcacgccaacaacaaggccgacaccgacgagcggaaagaggaactcaagaactgggacaaggccttcatcgacaagctggacgaggacaacatcctcttcgtcgaagtcctcgcggcctccaactacctcaaaatcactggactctccaaactcaccgaccaaaggttcgtcgacccgtttaacaccagcaacaagacccccgacgccgaggagacccgcgtcaacctcatcccggcgaacacctcagccacagcctcgacctcaaggccatcaacatcgacctcaagcccatcaacatcgacctcagcctcacactctgcgactaggagggggagggggaggaggagacactgagacactaccggagaacgtctgagtcttgaagtaacactcactttctctcttaacccgtcgtgtaatggtggttctctcgtcgttgcgtgttgtgtctctgctagattcagatcgaatcggggagttcgtgcatcctgtccaagaagaacagagtcggctgtgtcgttgagtactttgtactgctggatcgcttgcatgaagtgaatatttcgccccaaattgtttgctgtgtcttgttggctttcatgcagtcagtcttcttgttaaatgcttgctctgtttctaactctgtctactcgtgatgcttgggattccaaaccaagcgaattggtttcagatttgcagcatttctcagtactcggggatgttttcctgctcacaatttttattgggtgcaagtttgtgttgcgttttacttggattcaggtgcgaattgagttcaggagggtgaaaacatcgttgtgattttcatctgaatgctgcatttcgtttcagagatgcatgtactggtctgttcgaactgtaaaattttgccccaaattgtttgctgtctctgctcggttttcatggtgctagactactcggtctacttgttggcatgtggttcaattcgtttgtgggattccaatccaagggtttggatgcagattagcaaacatttctccgtgctcaaactgaccggggatgttttcctgttcatgaatttgtgtggcttgcgttttgcctgaattctggtgtgaactggacagataagggaaagtatctgctgcaaatttcgtttcatagatgtatttattgattagtaccgatgactaacggatcatcagttgtttagttcagttcttaacagtaactgatccttctttgttgcaaactgatccaactccctgcatgttttctaacttatcagataaagtttcagagatgttgcaaactggtctttctgtttgtctgtctgtatctgaattcttctggatatttcagagatgtttcagagatgtatctgaattcttctggatatgaaacaattcgtttcagatatggatgtggattcttctgcatgtcacaatgtgttgcatttttctgcatctatagcattccgtttcagagatgaatgggcttatctgaagaatcatgcttgtaacttgcagggctaattgtgttcacgggcttgaatacatgacttttatatatagctttcgtgtgaactaattacttcagttaccataaatatcctgcaagatttctttatttcagaaggggactaactactcagaactcttttaggggattatcaacaaataaattaagttcagttgtcaattgaaaacaacaaaattcctagaaagaaaattcacacactctgtacgcctaatttgaaagttcacatgttttacaaaaataatactggctggtacaatactccctttcgagagatcatagacgagtgatatggggaaaaaaagtaagatgccgaatcaaatgaaccaaacaacatgagtgatatacctttcaattagcaggccaagtaacagggaaatggcgtgacatttttcttcttttgattgttgtgccgtttggctgaacctgtactggtatgatcatttctagtaaaagaaatgggggcctttgcccttgctaaaaaaaaaacaatatgctggagactactttatcctcgatttaagcattgaatcgccatcgttgaagagaaaaagaatatattaatacagtatccactacgagttttcagtatgagaagaaaacaacatatacttcgtataaatctaaggatatctaacaaaccgtacaaatctagcccacgaccttctcctctgggccgtacccagcccaacctactggcccagcaaggcctgcaaatcacagtactctcctactcttggagaagaggaaatgcaacggccgccgcgaaggcgaaggcgaacacgtctccgtctccgggctgcgcctttaaccagaacacgtgagccggcggctatatatcggcgaccccatctgcttccggcgatcgctaaggtaatcagtttccgagagcgagcgagagagagagagagagagagagttagggtttcgcaagtgatggcgacggggaacggagaggccgcggtggtggagaaggagggagagggcacgatggtgccggaggcgctggagaagaaggtggtgttggatgcggcggagaaggaggaggaggagaaggatagcgaggcggaggcggaggcggaggcgaggatctccaagctcgtcggcgacatgatcgacaacgtctgcgccgatcacgggatcccgctccccaaggtcgacataaagaccgtcaggaagatggccgagtacatgaacaagcacttcgccatcaccaacaaggaggaactcaagatctgggacgagggcttcatcaacgagcttgacggcgacgaggacaagtactccctcttcaagatcatccgggcctccgagcgcgtcggcttctatggactcctcgacctcgccagcgacatggtcgcccgcaagatcaaggcgggcaaggccatcgacgagatccgcaagttcctcggcgtcgagaaggacttcaccaaggaggaggaggagaagatccgccgggagaacgcctgggccttcgaggagtagacacctggctgttcttcgtcgtgattgttgttgtttcgtaggtgtgtgttgcgtacttgcatctctggtagattcagatcgaatcggggagttcgtgcatcccgtcccgtgcaagaagaacagagtcgattggctgtgttgttgaatgctttgaactgctggatcgcttgcatgatcgtgaataattttgcttccatcaatgctgtttcctgtgtttgcttggcttcgatgcagttagcctccttattaattgttcgctgtctcctctgtctgctcgttggtttggttcaattgcgttgatgtgattccaatccaagagactggattgcagatttgctgcttgatcgatctgggatgtttccctggtcatgaatttgtattgggaagatttttgttgcgttttggattctggtgtgaattgaattgagaagggaaaacatcgttgcaacatttttcagaattctgcatttttgtttcagagatgcattggactgatcctttagtactctgtctgttgtttggtttatgaaccgaacaggctgcatgtctgaattcttctgcgtctgaaggactttttttttttaacgactcgcacgagacggtgcgaagttttattgataaagcaggaaaaaattacaagattacaaccctggagggtcgtaaccaggaaaaaggaaaaaatataccaccacccacacatcaacagcgccaacacacaagcccaatataccaccacccacacatcaacagcgccaacacacaagcccaggagaaggcaagcaccggaccggccgccgctaagcgtgaccgaccgccgctagaccaacaaaagaacccagacgagatcgccccctaggggatgccaaaacgacgtcttcaagaagagaagcaacggaaagaccgccgccgctgtccgtcggggctcaaaggagccaagactgggctttcgcccggcaaccaccctcttgtgaatccacggctggtgccccgatgctccaccaccattcaagctctgccgacatgtgggaccctagcaccggaatgcgtctgaaggactgaagcacttcttttctgaattcttcttcatctgaaggactgacgcatttcggttatgaattcttctgcatctgaaggactgaagcacttcgtttctgaattcttctgcatctaaaggactgaagcatttcgtttcagatatgcatatgtggactgacacccagtatgttctagtatgttgcattcttcagtatgttaaacatttcgcttcacaggagtagttgttttgagttatgaagttagcccaattcttccctgattgcattatgctttcttgtgcatcatgtagccatttatttagctagttgatgcagttgttgtttcgctcaatagaggatcatgtctgcaacttgcagttaggagtgtttatgggctcctttggaatgcatgggcttttattactccagtcaccataaaaatcttgtgagttcagcagggaactaacttagtattaaacacacttttgggggaactatcaacaaattaattaagcttagtcgtcaatttaatcctagaaagaaaattaattggggagtagctcaatatagtttcttcgcacgcgctctctacagctaacttaaaagttcacaagttgttttacaaacaaatatagttggtctctcactttctactagagagatcaaagatgagtgatgtggtgtggtcactagtcacagtaagttttgccgaatgaaatacagtaataatactccagtaagtttgccgaatgtgcgaaactctgtcctgcaatttgcaggtcaggtaaccggaaaatggcgtggcataatattttctaaaatatccttaattaggcacatttcttggtttctatagtgaattttcagtgttagttttacccaccaccttttcttaggaggaaaagttaagatggtaaaatttctccttactagcaccaaacctgaagagattta

SEQ ID NO: 40268 - DNA, 25636 bp, Oryza sativa
  unsure (1)..(25636): unsure at all n locations
tagcggccgcgaaagcgaaagccaacacgcctccgtctccgactctccgcctcctccgcgctataaaaaggcgcccccccataaccccattcggcttggaccactcaccgatcaatccgtctcgtctcgttccactgcttcaccgcgagcgaaaggggagagttggggttttgcgagcgagatcgagcgatggcgacggggagcggagcagcggcggcggcggcggcggatgcggaggagaaggagagcggcagcaggatgatcaccctgacgagcaacgagggcaaggcattcgttgtgacggaggcgtcggcgaggcagtccgcgaccatcaggagcatggtcgacgacggcggctgcgtcgacaagggcttcccgctccccaacgtcgactccaagaccctcgcgagggtgatccagtactgcgacgagcacggcaacaaggagccccacaccgtcgacgagagagcggcgctcgccaagttcgacagggacttcatcgccgagctggacgccgacaaggccttcctctacgacgtcaccatggccgccaactacctccacatccaagggctcctcgccctcaccacccagtgcgtcgccgacaccatcaagggcaagacccccgaggagatccgcacggccttcggcatcgagtacgacctcaccgcgcaggacgagaaggagatcaaggaggaggatactcacgcatgacgcaccagctagctgcccccgtaagccgtagtgtcctcgtcgtaacgattgttctctcgtagttgcgcgttgtgtctctggtggattcagatccaatcaagcttactgcctttgagttcgtgcatcctgtgtccaagtagaagtgtagaactgagtcggctgtgtcgttgaatgcttttgcaactgctggatcgcttgcatgaagtgaatattttgccccgaaattgttttgctgtgtccgcttggcgttcatgcagttagtcttcttgttaaatgcttgctctgtctctaactctgtctactcgtgatgcttgggattccaaaccaacagatttggtttcagatttgcaatgcaacagttctcagtcctcagggatgttttcctgctcacaaatttttatcaggtgcaagtttgtgttgcgttttgcttgaactcaagtgcgaattgaattcaggagggagaaacacatcgttgcaattttatctgaatgctgcatttcgttttagtgatgcatggattggtcctgttcgaactgtaattttttgccccaaattgtttgctgtcgctcggttttcatgcagttagactactcggtctacttgttggcatccaacccaagagtttggttgcagattagcgatatctctcagtgctcaaacttaccggggatgttttcttgttcatgaatttgtatgggttgcgttttgcctgaatttctggtgtgaactgaacagagaatggaaagcgttttgcaaatttatctgaatgctgcatttcatttcatatatgtatgtactgattagtaacaatgaccaactgatcagtttttggttcagttctcaacagtaactgatccttctgtgttgcaaactgatccaactccctgcatgtttcatgtttgcaacctgatcagataaagtttcagagatgttacaaactgatccttcagtatgtctgtctgtttggttgattgacccaactccctgcatgtatctgaattcttctggatatgaaacaattcgtttcagatatggatgtggattattaccctagtatgtcacaatttgttgcattcttctgcatctgtagcattcagtttcagagatgaatgggcttatatgaagaatcatgcttgtaacttgcagggactgtgtttacaggcttgagtacatgaattttatatatagttttcgtatgaacaaattacttcagttaccataaaggtcctgtaaggtttctttatttcagaaggggctaacttttcagagctcttttagggaactatcaacaaataaattaagttcagttgccaattgaaaacaacaaaatttctagaaagaaaattcacatactatgtaacctaatttaaaagttcagatgctttttttaaaaaaattcacgcactatgcagtaaccacaaaagctccaatgttgcgccgtgagccaaggaaggggacgggactagtccacaaaagctccaatatcggcatgtccagcaacctctgagctgctctgaaggaagaagaaacaactctagcacataccagttatatttgttgttgaactcggagtgaggtcataccactttttttagataatggaagcttttattgaactcagtcaattacatcaaggtgatccaattatcctgagaacacttccggcctatgcataactaagatgcacacagccgaacaaacaaaaccacactcgaaaggaaaaaagaatgacatggagtattgagaaccatcaatctaacgaaggaccaccaattctaagactagattgtcacctatatctctgggtaaaaaactccttgaccaccttctccaaatgttgacatgccgcaactaccatatcccgtgaaccaggcttctgtaggatagcccatgtacaaagccaatggataagagaatatataacctgcaaaggtgaagatatgatttttttttatcaaaaaccacattattcctgcatagccaaagcgaccaacaagtagcaactgctcctaacagaacatgtaatttcaaattatgatgaattccatcaaaccagctcccaaacatatgcgctacacaatgtgaggtcataccacttgacatagatgttctgatgcatgccctcaaaatgaggcaattacagatgtaactggtccaggattatttatattaattgtaatcaatcgagttgtaacctcatttattattcatatagcaaggtatataaattgagcaagtttcgagtttctagtaaaaacaaataatatcctagactagaatatgatgatcatatatcaaggttataacatatcaactccataatactccctccgtcccaaaataagtgcagttttacactattcacgttcaacgtttgaccgttcgtcttatttgaatttttttatgattagtatttttattgctattagatgataaaacatgaataatactttatgtgtgactaaatatttgtaaatttttcataaatttttcaaataagatggacggtcaaacgttggatacggatatccacggctgcacttattttggaacggaggtagtatatcttacaatctttgtctaccccaatgctgtgcattgggcgagtcaatcttgtctaggactaggtatatagtgttccatgtaagatatatggcgcctagtaatagaccacagaatgagtgtgtcttgtggtgagaaagacggtggctggcacagagatatccaatctcccaaacaactctcaataccaaatctgcatccggattcccccgtcgaggcatatcctttatgaaagtatgtacctggaaacacgcagatcttaggggaaacaacacaacactcaaagttaatttcataattgaaaagatcagcactgaaaaattccatccaaaatacatcaagggcaggccaagacgaagcaatcaagcaactcagaaagtttgtaagttaatttgcaacggtgatcaggatgtacaaagaaattaaacttttcccaaaaaatattaaaataaaactagtaccggcaaataattagctagcccatgatttagagaaaggaccaacgaaatgtaacaaacttgacatatatctagacaaaattaactaaagaaggtcctaaagctacaacgaaactaactaggggatacttgatcaaggaaataactcgactagggaggaagatgcctcccagctcttaaaaagaaattaaaaaaaacttgactacggaggaagacaaatttcgaattttaactcacatgtttgtgaaaatatatataatagattgatctatcttgacaaattttttgataaattttttagtgtcatgcataaaacggtatatttacgtctatgcatgctgcgtgcgatgcgttgcacttgcacgttgcacgttgtaaccccacccaagccgtcgatcaggcctccggcccatccgcccgcccgtggcagcgttggggagagtcgaccgaccgacgcgcccgccgatcgatcgaaaccatatcaattcgttcgcccggcgggtaaaatgcggtacatatgttcctgttgcgtgccacgctgggagtttcgatatatcgatcctgcgcaatcacatgctacagtacataatcacgttagcgtcgtacctattcccggaaactctaatggcgagcgatcgccccctagtttccttttttagcaccacattactttcctattttagtaaatttatacgtctaaagtttatacacctcaagttacacatctaaagtttagagaccaaaaatttatatatccgattaaaatttgaatttgaattcaaatatttttttatatatagtatttctatacatctaaagtttataagtcaaaagtttatataccccgtttcaaatttgaatttaaattatatctgattcaaatttgaatttgaattcaaatattttctatatatagtattttcatacatctaaagtttatacacctaaagtttatagatccgaagtttataattaaaagtttacatacccgatttaatttgaatttgaattcaaattttttatatacagtatttctatacatatataaaaaaacgtgtgtgaagtggtatggacatgatcgtgggtcacatggtctcgatcatgtgcgtggggctttttcagttttgccgtttctgatcgcgcatgcgtccgtcccgcgatcactcgcgtttcaggaggacccaccgcttcctgccaccgagtcggccgtcgtcgtattcttcggtgtatctttttttttttcacggtatatatgcatgtcacttgtattgtaaagggaggggaggcaatcattctagcaacacaaatacaaaacatctctagttttagtctttgccgatagacaccgtaacttctttaatttgctcgtagaaatcttaaaagcatgataatttgctgaaatatagtgtatnnnnnnnnnnnnnnnnnnnnaaactttaggagttatagaaagggattgatcgccaaaataaatagcattggggagagatgattgccctgcgtcgtagctcactgctatagtaccctgatttactcacacgcagactacttaactatcgtatcatgtgggccccacatgtcagcagcaaactctttccttatctctcacacagtcatcctccctttgctcttcactatcctcactagcccgggaggcatgctgcgggcggcgtgcacaggggtggtggccgatagtgtcctagtgaactcattgcaagataaaaggcaaaatccctcctctctcctgtcacagtggaggacgacagtaagaacggtgaggctaagcttagacggagaaagcttggggacgtgcggagctcgagcttgatgaggtactccaagcctggggaaggttccaacaaggcttggggcagcttgggagctcaagctcgagcacccctacgactacttgctctcccccaccgttgaatcggcgccgacagcgaacccacgaatccttcgtcccaagatctcaatttaggctgtgtttgtttggagttgttctcaactctcccatctcgttttctgcgcgcacgcttttcaaactactaaacggtgtgttttttgcaaaagtctatatacgaaagttgcttaaaaaatcatattgatccatttttgaaaaaaaatagctaatacttaataaatcacgcgctaatagatcacttggtttttcgtgctcaggagatgggttcccaaccccctccaacgaatacagccttattttcttcgcacacactctacatctaacttaaaagttcataagttgttttacaaacaagcatagttggtctccctttctaggttgtgtttagttccacgccaaattggaacgatgtgacggaaaagttagaaatttttgtgggtaggaaagttcaatgtgacgaaaaagttataagtttgaagaaaaaagttggaatctaaacatggccctattagagagatcaaagatgagcgttgtggggtcactggttatagactcagtaaattttgctgaatgagatacaatataatagtacttcagtaagttcgccgaacgtgcgatactctatatatgttgcagtttgtaggtcaggcgtgacgtagtatttgctaaaatatccttaattaggcatatttcttggttgttgtaggtgaattttcagtgttagttttacccatccacctgttcttaggaggcaatcaggctgtgttctttatcacctgctcccaatttatatcccttattttctgcacacacgcttcccaatcggttaaatggtacacttttttaaaggaaactatatgaaaattacttaaaaatattcatactattttattttttaagtttgttttagctaatgtttaattaattatgtgttaatgtattgcttcattttgcgtgtggggatgtgaagtttccaaccttcacctcacaacgcaacctaagatggtgaaatttctcataactagcaccaattactgtcgttcatcgatactaaacctgaggagatttaacgtacgaattcttttcccagccgaaaaataaaggaatatgggagcacgtacagtacgatagcatggttctcaacatgggccgagtccaatacaaattctctgcccatggaccacaaccttctggcccaacacagcctgcaaacacagaaggttctcgtgcagctggcgagccagctaggcttggagaggaggaaacgtagcggccgcgaaagcgaaagcgagcacgcctccgtctccgcctcctccgggctataaaaaggcgcccccccatttggctcggaccactcacctatcaatccgtctcgtctcgtctcgtctcgtgccagtgccactgcttcaccgcgagcgaaaggagagttggggttttgcgagcgagagcgagtgatggcgaaggggagcggagaggcggcggcggccgcggcggcggcggaggggaaggggggaggagccggttgcggcggcggtggtggagatggagggagaggacgcggtggtgccggaggcggtggcggcggatgcggagaaggcggaggagaaggagagcggcagcaggatgatcaccctgaagagcaacgagggcaaggcgttcgttgtgacggaggtgtcggcgaggcagtccacgaccatcgggcacatgatcgacgacgactgcaccagggaagccgtcccgctccccaacgtcgactctaagaccctcgagaaggtgatcgagtacttcgacgagcacgccaacaacaaggccgacaccgacgacgagaaagcggcgctcgacaagtttgacaaggacttcatcggcgagctggacggtgacaaggccttcctcttccacgtcaccatggccgccaactacctccacgcccaaggactcctcgacctcaccacccagtgcatcgccgacaccatcaagggcaagacccccgaggagatccgcacggccttcaacatcgcgtacgacctcaccgaggaggaccaggaggagatcaaggaggaggatgcctgggccttctgaggagcacgcacctgccgcgtaattgttctcgtagttgtgtgttgtgtctctggtggattcagatctgatcagcttacctttgagttcgtgcatcctgtccaagtagaagtgtagaactgagtcggctgtgtcgttgaatgctttgcaactgctggatcgcttgcatgaagtgaaatattttgctccaaatacttttgctgtgtctgctttggtttcatgcggttattcttctgatgagatgtctgctctgctctgcctctaaaaactactctgtctactcgttggcgtgtggttcattggtgggattcggtttcagttttgcaacatttcggagctcgatcgatcggggatgtgttcctgttcatgagtttgtatcgggtgcaagtttgggggtcgcttttttgcttggattcttgtgtgagttgaatagagaagggggaaaatgtcacgccatctgtttcactctgttcttcctttctaccgatctctgttcgtaacaaaaaatcgctgcaactttatctgaatgctcaatttcgtttcagatattcatggactgaccagttagtagtgaccccgtatgctgttctgttgtttggttgattatttgcgcaactccatgcatgtgcctgaattcttatggatctgaagcatttcatttcatatatgcatgtggactgaccctccagaatgttctgcgttgtgtgttcttcagaatctgaagcatttcgcttcacagatatatgaactgatgtcccagtgtgttctgacttctgagttgtttggttaaattaaacctaattccgtgagttgtttggttcaattaaaacccaattccatgaacatgttctgctttcttacagatcattcagttgatatcccgctgtgtttgctttataaaatttctgtacgtgtctgaattcctcagtgctgatccaaatgagttcgtgttgctttgagaaattatgggctgttcgttgcacctgttgctttctcctgctctgtgtttctgagttccatgttaaattcctgcacaatcgtaaatctgtttgaattggcattatttctgaacttgggatcagaggatttgcacaatttcaatttcagttgaaacacgtgattcttactatctgagactaatagggggcaagcttctgataattagacagtgatttctgctatgaattgaatagagaagagaaatcctcgtttcaactttatctcaccgctgcattttgtctcagagatgcatggactgaaccattagaactgatgccttagtattcagtttgctgtttgctgataaaactccctgcaaaatttgtctgaattgaattcttgtgtatatgaagcatttcgtttgagactgatacacagtatgttgcattcttcagcatctgaagcatttcgtttcagacttcagagatgtatggacttactacttaagtgtgtcgtgagttgtttggttaaattaagacaattcagagatgtatgaacttactactttcttccgcatcatgtagccatctgcccatctagctacttgagcagtattccacgtactagttgttttgctcaactagtgcacatttttgtaaatgctagtgttgtgtttacgggctcctttggaatgcacgcgttctgtatggttttcgtatgaattactacagttaccatgaaaatcttgtaagatttattcatttcaaaaggggaataactattaaaaactcttttgtgcaactatcaacaaaatgattaagttcagatgccaatagaaaacgataatattccaggaaagaaagtaattaagttctgttatttttagagaagttggctaagacccccgctgcaaggcggtcctgtgttgtcgttttgttctccttctctctgttctcccctgttctctccctcgacagtttaatgccgatcttgtaaaattgtaacatctttctttcagtcttaataaatttaggtcggccgcctccttggccgtcccggcaaaaaaaagtttcttcgcacacactttatacagataactgaaaagttcatttgttttacagaaagaatagttggtaacttggtatctccctttctagagatcaaagacgagtgatatgggggtcactggtcacagtaattggctcttgtccagttgttgttgatggagccaaacaacatgtgtgaaataatagtaatactccagtaaatttgcaggtcaagtaacaggaaaaatggcgtgacatatttcctttgttactgtagtgatgtttcagtgttagctttatccatcaacgtaatattaaaaggaaattaatacgataaataattctcataactatgaaccacttggttgttattactagcatcaattactacagttcatcaatatgcccggagttctttctcttcgatttaaatcttaaataatggcgatatatcaccaacgatcaccgaagagaaaaaatacataatatgcagtaggaattttcatcatgagaaaaatacaaaacatatcaacctgaggagattcaacaaccatacagatactcttcccaagggtgggaaaaaagaaaagaaaatgggagcatatgtactgtacggtaacatggtcctcataaatgggccgaatccagtacaaatttctcggcctatagaccataaccggcccatcattatgctcagccagctcggcttgcaggagagtaaacgtagcggacacgaaagcgaggcaccgagcaacgcctccgctacaagaaatttcatttcggacccgatacagtattgtttcggtcgaaatttttatttttattttctattgtttttataaatttggtaatattttgattaaatttgatcaacatttgtttaaaattttggaaatttcggactttcaaattccgtgacctcctgaatcggtgaaactgaaaaattaaaccccgacccgaacccgtaatccggcggctatatattggcgccccccatcggcctccgacccgatcaatccggctcgtcccacctcacccacggcgagcgctaggtagtcagtgagagaagagagccaagttgatcagtgagcgcgagagcgagcgatggcggccgcggcggcggccgcggcggaggaggaggaggagaaggagagcggcagcagcaggatgatcaccctgaagagcaacgacgagaagctggtcgaggtgacggaggcgtcggcgaggcaatccagggccatcgcgaacttgatcgacgacggctgcgccgatgtcatcccgctccccaacgtcgactccaagaccctcgcgaaggtgatcccgtactgcgacgagcacggcagggcgaactccggcaccgacgaggagagggcggcgctggggaggtttgacgcggacttcgtcggcgagctggacaaggacaaggcgtccctcatcgacgtcatcatggccgccaactacctcaacatccaggggctcctcgacatcacctgccagcgcgtcgccgacacgatcgggagcgccaccgccgagaagatccgcgaggcgttcgacatcgaggacgacctcaccgaggcggagaagaaggagatccgcgaggagaacgcctgggccttcgacggcatcccgtaagccgtactgtgtcctcgtcgtcatgattgctgatctctcgtagaggcctagctgtgtgtgttgtgtctctggtagattcagatcaaatcagggagtttcgtgcattttgtccaagaagaacagagtcggctgtgtcgatgcatgctttgaactgttggatcgcttgcatgaagtgaatattttgccccaaaattgtttgttgtgtctgcttggctttcatgcagttagtcttcttgttaaatgtttgctctatctctagctgtctactcgttggcatctggttcgatggtgggattccaatccaggagattcggttgcagatatgcaacatttctcagtggtcagtgctcgatcgatcggggaatgcgtttcctgctcgtgagtttgcattgggtgcaagtttggtgttgcttgcttggattgtggttcggattgaattgagaatgggaaaaaaacatcgttgcgattttatctgaatgctgctttcgtttcaaagatgaatggactgatcggttcgaactgatccatgcatgtgcctgaattttcttctgcatctgaagcgtttcgtttcagatatgcatatggaatccctagtatgttctgtgttgcattcttctgcatctgaagcattttgtttcagaaatgaatttcaccatttggattgatcccctagtatgcatgttctgcgttgcatctgaagcatttggttcagaatggtttcagatatgcatttgggttgatcccccctatgttctgtgtttccggatccgaagcatttttcgtttcagtgatgcatgtacagatctagcagtatgttcttggtcgtttggttaattggcatggacgcatggtaggattccagtccaagagatttggttgcaggttttgcaacattttagtgctcgatgttttcctgttcatgaatttgtatcgggtgcaaatgtgaaagtttggggttgcaatttgcttggattctggtgtgatttgaatagagaagggaaaacattagtgcaaatttatttgaatgccgcattcgttgcaacttttcctagtatactgcctttggttgattaattgcccaactccctgtatgtgcctgaattcttctgcattcgaagcatttcgtttcagagatgtatgtcccaacatgttctgagttgtttggttaaattaaacccaattccctgcatgtgttctgctcatgctttcttccggattactcagatggtatcctgctttgttgtttgatttacaaaatttcttctgaactcttctgtttctgtagatgttctgaattcttctgtgctgattcaaatgagttagcaactagccaatacttggctcctgttgctttgagaaattatgactgttgattcacctgttgctttcttctgttttgtgtttctgttccctgttaattgctgcacaatcgttaaccggtttgaattggcactaattctgaatttggggacaggggatcacacggctacacaatcgcaaatctatttgaattggcactgtttctgacattggggacagcgtattgcacacttttagtcgacatgtacatttaaaatctcagcctatggcaaacttaagtcacttgggtgcctggaagtattcccaggcctgaaatatctgtttgaatttcataaagatgaaggatgtgtttagcttgcagaacataaaagtttacgattagcatctgcttctgttgtaattctaacaaaaagatcagatatgctttcctgcatcattcagaaatcagaataacaacagcctgcatgcttcatttttctactttattctgaatgaaccatcccaatattgtacaaactaatagcaatccaggaaacagtgagaaatggcaccacgggcacggctatagaagtcaacattagcagatctctccctaaaagagtcactgataaatcacagcgcaatgcgcatacaaatcacagcgtttcagaaactagatcatatgtggtaaaaatcttcagaggtaatagtaagaaagcagaggtgcagcaaccgtggctacaatgagcatcgccgagaccggagattgggccgccgccgacttcggtgaagatggcgtgccggtggccggtgttgatcctgacccagaaccggaagaagatggtgcgggtgctgcaacattgatgcagaattgtgagatggccagataccacatatccaagcaattataatttctaaaagatgaattggtgaatacatgtcagcagggcagaatatttcattgggttcagaactccaggatccaaattttttgtttgtaattagtagaagaagtcagaaaatgtttatcaacgcaaaatatcttcttatcagtcatgaggtcttcggagagctttcactttcagacctcacattgatttcagaagtcagaactttcagataactttagataatgaatcctcatcaatgtgcagtagatggtgagttggttaccccacagaaagtttgttcagttcttttttagtgtgcatgatggattacaaaatttggctgccaactatgccaggcaccacaacaaccacaacgccaggtagcaggtacaccacttgcatagagaacataataatgggaaaattctactaagatgatcagatctactagtagtactagtagcgagtagtgactaatgaggagaggaagtcatcaggaaggaccagccatctactctgctgatgatttagaatttaaagtttcttttgttttttatcttgttttacttttttcatttttaaataaaaatgaccattctctgggacaaatttcagttatagggagcaaaactgaggataattaggcaggaaatcctttatttgattcatttacatcaaaattgaaatcagatcgacaagaacaatcagacagggattcaggattttgctttacctccagtaggagaggcaccgggaaatttctctgccaagaaaaaaaaaagagatcaaattatatacatatacaaactataaatcgatctataaccaagtactactatataaagggaaatgcaaagttttactaaccatagtcacccaaaaagacacagaagaataaaacgaaaaaataattgaagaaacaaatcgataaattgatctataaccaagtactaaagggaaatgtaaagttttactaaccatagtcacccaaaaagacagagaagagtaaaacgaaaaataaacagagatgaagaaacaaatcgataaattgatctataaccaagtactacggagtactatataaagggaaatgtaaagttttactaaccatagtcacccaaaaagacagaagaataaaacgaagaaaaaattgaaaaaaaaaaacagagatgaagaaacaaatcggaggagtgagttggttgtactgactgttgcacttgctcagggcggaggagtcgccgccgcaggcggcggggagggcggcggcgcgggtgtagttgatcttgatgccgaagtcctggccgagcgcgccgcagaggcaggcgacggcggccgggctgcccagcgcgctcttcacgccggcgcagcagtccttggccggcctcgcctcggggctccccggcgtgatgtacgtcaggcaccccgccagcgccgtgatcgacgacccgcagtccgacgccggccccgccgccggcgccggcgccggcgactgcgacgccgcgccgcacgccagcgccagcacggccaccaccaccaccacaactacggcgcgcgacatagctgtgccggccgagcaatcaagaattcaagatggtagctagtggagtgcgtgcggcggggcgagattgcagtggtggtgggttcgcggcgaggactccggcgagattaattataggggagaaagagatagttatcgcggccgaatgtacagggaatcggttacgcgctggatggttgccgggaccatcaatgcggcacgtggcggcggctggggttagtatagtgcctgttcacttttatgctaaaaaaataccttactaaattttaatattgtcaaaattttggcatagttgtcaaaattttggtaattttggcatgattttattatataagttaccaaaatttagtagcaaactaaatatagccacttttttggtaactttatcaaaatttggtaaggttgaaaatatcatcagaatgaataggcccttattaataacacccatttgagtttgactcgttttgaattaattttgggataattagccgtgatatttggtttacgagaattgtttaggtgcattcaggtgtagatagatgccctcttttaaaaataaccgttcagaataaatcattacttccaagttggtcatgttaattctagatgggaatgataccatgtagtacttcctaaacatttatatttagctgggaggacagcagctgacagccaaactccggtgtccagtgtgctacgtgtaacgttgcatgcaagcatgtgtttttccagcggcgactgcacatgccgcagcatcaaatcgggccatgaattagcgtgcaataatttttttccctcgtagtatctaattttatactctcataatataataaggtatttttgactagcagatcactcatcttatttaaaaaattcgtgcaaacataaaaaacgaaaagttgtgtttaaagtactttgaataataaagtaagtcaaaaaaaataataattctaaatttttttaaataagacgagtggttaaacagtgcgagaaaaaactcaaaatcacttatattatggaacggagggagtagaaatagagtagtactagtagagcaggtgcaatagcagactattaaccagatataaacatattttaataaggtaaaagatgagagagaagagcagtaagctacagatctgtggccagctgcagcatgaatttatagacgcaatgtgtatatgacaggtgagaccatatattaatagtatagtaagtaactattgtataaattggctattagattggctatagattaattggagctagtagtgagctatactattaaacttgctattagggaagtgtgagaggatcaaattaggctgatgtgcttatcaactcgggggctgatagtctccggctgaattttgcgatactatgcttttgtacatggttatttctgctacggtgacattatgtgttcttagaattttgaactaaaacgaagcagcaaatggaactgtgccttacatgatgtttactagttttttttgcatacgtatcttatatagcatatccgcaacctgttacgccccaatcctaatttgggtgtggtgggggggggggggagttggaccgtaatcttcaaatcgtgctggtgctgcaaatattagttaacgccgtgtttagttccaaaatattccttaaaacttttaactttttcatcacatcaaaactttttcacacacataaacttccaactttttcatcacatcatttcaatttcatccaaacttttaattttagtgtgaactaaacacaccctaagagcaagtctaatagtacagcccactactagctccaattcatctataaccaatctaatagctaatttatacaatagttacttactatactattaatatatggtcccacctatcatacacactgtgtgtcttggagttcgtgctgcagtggctacagatctgtagctcgctgctcttctctcccatcgtttatctcattaaaatatgtttgcagctggctaataacctgctattatacctgctctaagtgccttcatataagagcaggtacaatagcaggctataagccagctgtaaatatattttaaggagataaatgatgagagagaagggcagcgggctacatatttgtagtcagctgtagcacggactccaagacgcatcgtgtgtatggcatgtgggaccaggtattaatagtatagtatgtaactatgtataaataagctattagattgactataaatgaatgaagctagtagttggctatatactattaaacttgctctaaaccatgttgcaaagctttaataagaaagtttctgggcatcggttcggagctttctccaaagtaaaatgcgcccgctagcgctgatcatgtcagtctgctcaatgccaaaaatctgaaatgggcttcttaagtcttaacatgtgcagataaagtacagctacaaaaggaaaactcgttcgtcacacgctacagcagcaaaggaaccaaattaaactttcgaaaattttccaaattttcgaatttggcaggagtcatttccaagattttttttccaaattttcgaattcggtgggagtctacccgcctcctgacacacaccacccaaataaataacagctggctttggaggaagtgggacgacgaagagaagtggattcttctcttctttttctacaagcacctcctatttgtctgcgtagctagcaccagcctcccaactctcctcgcccccctcctccggaacgtgctcctctaacgtagaggaatctacgttagagggacgtccaacattggcgaaaattcncctcgcngccgctatcattcaacatctgacggtagagagcgggtatagcatatgagaagcctggttggcccacaaacaggcacactttcagcccaactcgccgctcgttggccagcatgtccttcaccgccgggcggcggcacaatatcccacgacggcaccctccgcgtgaggttggcggttcacgcccgcgcagccgcactgtcttcctctccgccgaccgcgattctacaacttcgtcgccggcccagccacccgagcgctatgtcatccagaaggcgtaggcgaagctcgtcgactaccgtggctctggcatgagcatatcatggagatgagccatcgtgcgaaggactttgatgccgctattaataaggctggggctgatcttcactcgctcctcaccgtgcctgacacccacgaggtgctcttcatccagggcggcgccacctcacagttagccgccgtgtcgctcaacctatgcgcgtcaccctgccgaagtcttctccagctcatggagtgacaaggctttcaaggaatccaagaagttcaagcagattatggaatacatcaacatttgcagcatctacggaaacgtacacaaacagttggtgatacttctaataaatagggaaaaaatatccaaggctccaagccactagattagattaaaacagaaagcaaaaaaaaaaaaaccaagatataccagcccaagcaagaacaaagcaaaaccaccctcgacagtcgacaccatcggtaaatcagcaactaggaaattcgcaagcaaaccaagatggggatccggcaccaggaagcctagctaccgttggatgctgaatgaacggagatgcgacgtgggatgtccctctaacgtagaggaagaggagctcgttccctactccagtcctgcaccaccaccgagatggctcgcctcagtaaggcctggtttagttccattttttttcaaacttccaatttttcaatcacatcaaaactttcctatatatataaactttcaacttttccgtcacatcattccaatttcaaccaaactttcaattctgacgtgaactaaacacaccctgtgtgttggaagtttgatttcacgcaaaaattaaaagtttgattgcaattagaacgatgtgatggaaaagttaaaagtttgtgtgtgtaggaaagttttaatgtgatggaaaaattgaaagtttgaagaaaaaatctagaactaaactcggactaagattccttggtctgtgtggcgtataggggtggatagcgagccggctcggctcggataacgagccggctaacgagcagctcgactcgactcgtttgaaagctcgagccagctcgttaggctcgcgagccagaactagtatgctacagagaagtagagaacgcagcagcaacatgaaatggctccaaaattatctgagaaattatcaaaagatataagaaaaagtctacaatctcccatcaagaaactctaacacaacaacaccgaaatctttcaccacgaaaagcaaaatcagaaaagcctcctactgtgacagagaagtagagagcagaaagcatcctttcgtttcttcatgctccatcatccatggtcatgactgacaaggatgcatggccgatggcaacacaggatggagacagggagcagcgctggtgcggcagctcggagtggccgacggcgactcgatctggattggagtttggagatagatgagaggaaggggaagcgatactattctgttcggtagacgcatgcacgggtgactaatgtacttgggctgtcatggggctttgtttatgggccataggtgtcctactgatttatcttatctctatgtgtaagctcgttaagctcgcgagcgagctggctcgttatgcctaacgagctgaaactgtagctcggctcgtttcaaaaccgtaatgagccgagttgagtcaagtcgagccgagctcgtcatgagccaagcgagctaacaagtcacaagcttttcgtccagccctagtggcgtcgtgtttctcttatccattgctacgcgtactggtactggtgttgtgtacttgtgtggcggtgttgttttctttttctccgttgtgtgtggagacgatttgatccgatcttgggtgagtttctcccgtgttctcgcgggcgtgaaagaactgatgtttctactgtgtgtgttgggttttaccatgtggtgtagtgtggtgcgcgtgaacgatctgatgttgttgagcctgcgcaagtttgctcccttctgtgtgtctggtctgaagaatctgggtgttttctcgatcgctgattttagttcgctctccgatgctgctcgctaggaactgatcgattttagccggcttttctttacgtcgttgttttctgcttcttttcaccgttactgttgttttctactcccatctctctatactatatctatacggcatgaaggatttctcattcgctcatctttttttttttctaaaccaaaatcactaggttgtaagaacgaggcccgtttgctgggtagagtggacagcgtgttttctccctcgtttgtgagcgccacctttctctacggcattgtggtcggactcagtctgaatggacgtggacttatttcccttgtccatccgatcgaggccggagtcagttgcacaccggagagagcgttcggcatcggtactgggccagataggtggaagacgacccatccagttggcctcgcgagcattgctttgagtttttgggtgttgcgggatgttacctcatgattgtgtcgcatctgtccatgaggcgtctccctgatctatactcactcacccgagtagcatcttggctgatgccacttgtcttcctcgtttcgatcgagtcgtattttctgaggtcgctacattcttccaggtactcccaaggaggctatctatatgtttttatttcttcaatgttcatccaaatctcgaaatgttgatagatatggtgttcagagcattgagtgggtcatcttcaccgtcatgacgaccgtcgtgctcatcggtacacttgtcatcattctcgtgagtctctgttatatttcttttactcagtattcatatccgtgaattcgtattgatccgattgatttttttttcctctcagcttcctgttacacagaagggaatgatggaggaggtgcccctgccccccagtatgaagagatcagaggatatgatacgagaaagcctgcaccttctatttccatttgtacaaatgaagagatcagaggatgatacgagaacgcctgcatcttctatttgatcttgtacaaattttaacggattatgttaattccctacttaggatgctggatgtgaccgtggttaggagttgagatgggaggatttggcgccacaattggtccatcaccatgcggtccactgacatcctcaccatatgccgcgaagccttttgtagttcacttgacgttgtttcattcttttgggttttcccattttttattaatttcagttgatgttgtttcattcttttggcttttgggttttcccattttttattaatttgctacgtaattattttggggctccaaggattcttttcttctttccaaatatgattgtaccaaaattcggtagctgcttgtgcgattgtgtaccaccttactctgctaatgatttatacaaagtttctcgcgtggtccatcttgttactttcgttaaagaaggccattgccagaggcaaattcacttgttggctgtcacctaaacgtgttgcctgttagctgcatcctgtggctttcttctggcttagatgtgccatgtgaattgctacacaaccgttagtcagtttgaattggcattgtttctgaatatgggaaaatgagacattttgaggggcagactgaagacaattaggcacgattcgtttatttacccatcaacacaactaatgttgcctactattgatttatttcagctcatagtagctttgtgtgagattcagtctagtgctgtaccaacagcatcaagctggtgggattcccaggcctaagcctaaattatatgtttgaatttcatataaaggtacagaaaatgctcaatttgcagaaccgaaagttccactcatatcatttatttactcgtattataatccgcttctgttgtaattgtggccaaagctcaaatatgcctttctgcatcattcagaacaatagtctgcatgcctgcattttttactttattctgaagggggcataccaatattgtacaaactataaatctgatagaatccaggcaatagtgagaaatggcatcatggacagagctaaaatcaacaataaatcaatagcagaaaggtctctccccaaatgagtagccaataaatcacagcgaaacgcgtatacaaatcacagtatttcaaagtgaaaaggcaacgacaatgcaatcgagacctgcataagaatatgcacctgctcaatttccccaatcccatcgaaattccaattcaaacaactcaaggcacacaagaacactgcaccaaaaaaggcccagctaagggataagcattaaattatcaaaaattaaagggacacaacaatgttttgaagaaacgaggaggcaaaagacgcttattgcttaagcagttttcacttttatttttgtcacggcatattcataaagtaatgtctgtggaccaaaattttcagaactgttcaaaaaattctagacctatactctatccatggcatcagaagtcttacattgaaatgaactaatcatatttcaatacccaacaaaaccagttaaacagacaatacatctctagttttcttcagatgaacaagtgaaatgtactatctaaaacattaattcacatggcagctatatgagcagatttaagctttgccttccacaatatgattacaagatagtactccaaataactgaagctagcatcctggtgcacaagaacaaagacagaggaggcttttcattctggtgacattccaaagcaacaaataactgaagctaaccatatgcgaatcactcgatacagtagagccaactacaattgtatctctgtaagcccccccagacaagtcaattcagctaatcagatataccatccagtgatcccagaccactaaaatagacattattgcgtgattcaacaagataaatcagtaactaggcaagctacaacaatgcaatcaagacctgcatcttcttatacacctgatcaattgccccaattgcatcgaatttcaatccaaacaaaccaaggcacccacaagcgtagcatcttcgatctaaggataacagtaggaaccaaaaataaaaagggcgaacccgttcttccgctcgggatcactcgagcgcgacggcggcgccggcggccttgagcttggcggcgagcgcctcggcctcctccttgggaagcccggatcgcaccacgaccggcgcttctccacgagctccttcgcctccttcagccccaggtccgtcaccgcgcgcacctccttgatgatctttatcttcgccgccgcctcgtacttctcgatcttgacatcgaacgacgtcttcaccgccgcggcctcctccgcgccggcggagccggaggcggcgtctccggccgcgccagtggccgcggcccccgatgcggcgctcgacgtgagcgagaggcggagcttgagccgcaggagcgccgagtagtcgtcgagctcggcaggggagagttccaggagctggtccgctatgcgcgacagcttcgggtcctccccggcggccgtcgccgtcgccgccgccgccgcggtggagaggcggcggagccgggggatcagcggcgcgaatttggaagcgaagagtggcatttcggtaaatcccgggaattacgtggtgaggggttagggtttttttggcccattcgacacgacccttatacgagaacacaaacacgtagccccaaccattccgccttccgatcacgaaagcgtattcgttctggcccgtttaggacgagcctcgtaggctcgaaggcgggtttcagtttttctctgcggctaccggaggcgtattttccgcataccgtggcccacctgtcattgagagtagtggctgttccgctccgagacaaggactcgccatacgactccacaacacactgcctcctgagtcctgactccccccgagcgccagtctctctctctctctctctctctctctctctcctctcgcacgcctcggcggagcggagcggagagcaacaaaagcgcaaaaaccctcgtagagatcgaaaccgccgcggcggggtgggatcgcgtgttccgatcgtgcggaggcctcccgctcttatcgagaggctttcgatccgcttgcgattttttttctgggatttttttggtgcatttttttcggtttttttgttttccatttcaggtggcgcgtgggggatcggtggattcctggagttgctggtcggtggaaatcgtttctcttcgtgtgcgcgtttgcgtttgttctggggtttttgttttgggtggtgggttttgatccggttgctgcgggcttgtaggttggattttgcggtttgggagaaaggtggtgattcgctccgtacactgttgagatttctctgtgactctgcgttggtgttgttgctaggtgagctgcgagcttccgtccgtttgcgatgtgccgatgtttagggttttacttgagggtccatttgatattccttattatgttttagagcacaatctagggttctagactggcatcattacgctgcatgtaaatgtattatcaagttgggggttagggatttaggtggggatcacttgtgattggggttgaaacctgaaagtaatcggagacgtctgcaatgcgttatgtgtatatgtgtttcgggtatgctgctaaagtgaagtctctaactgcctcatgttgttttgcatgttccttgtgtgcggaaatgtcgtatgtaatgttttcatgcttaatataggaattgttctcagctgtttctcccttgtacttagcatacagctcgtatcaaatgtaaaattctgttttgacatggagcatatcagtataggaatttttcaccagaatctgggagttggatcttttgaagaacaaattttgtctgcatataaactgctacttcatcagaattcctaatgcaagaatgcatatacatggcatgacttaactatatacatacttgtgcagtttcaactgaagattacagttattcagtctgttcttgtttcattataactgtaatttccagttctacatgttagaaggctgcacattgttcctatttaattgtatagccactttgattgtgataagtgtgaatttttggcagtcacaatgtcaacgtgtcctgtgctgaatgaccgaccaattgatgagtggaaggttactgaattgaaggatgagctccgtaggagggatctatctattaaaggtttgaaggatgatcttgtgaagaggcttgctgaggcccttcagggggaggttattgatggcggggaagaaacagtcaatggaactccccctgtggagaatcagacacaagacggagctcttgttttagatgatgcatctggtttccaggcttcagcagaacaaaatgttgatgaaggccctgctgaggttgctgcaaagaatgaaggccttgtctctgttatagaagctagtacagagggcggaactcttgttttagatgatg

SEQ ID NO: 40269 - DNA, 6228 bp, Oryza sativa
  unsure (1)..(6228): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtttttggttgcaatgcttgtcatggattcatggcagtattttgtgcaccgctacatgcaccagaacaaattcctctatcggcatatccattcacaacatcatcggctgatagttccctacgccattggggctctctacaaccatccattggagggactccttctggacaccgtgggtggtgctatctccttcttggtctctggcatgacaccaaggacttccgtgttcttcttctgttttgctgtcctcaagacagttgatgatcactgtggactttggttaccgtataacatcttccagtccttgttccaaaacaatactgcctatcatgatgtccaccatcagcttcaaggctcaaagtacaattactctcagccttttttctcaatctgggacagaatactggggacccacatgccctacaacttagtaagacggaaggaaggcggttttgaagcaagaccactgcgagactagcttgaaccgatggaagtgtatagaactccagcaactcagtgagatacaatgctctacctccctttcatatgtttagaacctcatagggaccaatctaacttcgaagatgttgaagctgttcaagtactcccagattttctttttcgcgtcttgctggaagcaatacgctagtcgggatttgggaagacactgaagctcttgcgcgatgcttgttcttacacctgctgttaatctagttagatcggtcacctggaatgtgtgtggtactgtatggtttgtcttgatggcttttctccttgtcatggctattttttgtgcagagctggcatttacattgctgtgcagatagtgtatttggaatcacacttctgtatgtacccccaattatttatgtaactgaatatctgggcatggttggtaacttcaaagttcaaaccaatctttatctactactgtatagtagtttgtttgatcaattacagatcaactttgatggtactcatgtttccatttctaagtgtagcttttacagctgttgaaaaccaaagacctcctgaagcttaagcttgcatgttgggttacatattggttgatctggagttcatttcacttgaggcttgagaatgtttgtgtttcctatcataagatttgtgttttgcaacaggattttaattaaagataattatcatgtccaatcattattttcttgcatatagattcagtactcacggctaccactactcccttctgaaggagtataggcccttggacagtacatcatcattagggatgcaagcgggtcgacccacgagctcacttaaaggttaaataagtgataacccatgggttttcgcgccgtggcctgacttaccatgcctcgggatgcaagtgggttaacccataaacctatttttagattaaattagtaggtaactcacaagtcagttggtgagtacccgctaattttgcttataagcgagcttgcgtgttagcccgcttgcatccctaatcaacatcactgtcatccctaatctcatccatctcttatcgttgcagacggtttaatgggggattaaaacgcaaagcatgggacctctagctattagcggccaaaataggggccaaaatgcaaattggctcgttgcatttggaggcccaaaatctcaaattctcaaggcttcttccaacccacgaagcccccaaaaaaagcccaaaaccagtagcagcagcggagcggggcgccgtggactgacggcgacgtcgccggagaagcagaggcggcggcggcggcgggcgacgaaggcgacatcacaccgacggcgatgtgatccccgcgagtgatttgtgccatcattggatgccacgtcacgcgtcggcagttggcacgtcgacccgcgtcgtctcaatttattaagattaattaattactactacgactctacgagagtggtaagtaacaacgagtcatcgcagaaagcatcagctcacctgcgaagctgagatgagccccaggtgttcttctatttctaccggcaaattcttcgtcggcagaaaaaaaaatcaagagaacactacaccgaaatgatgataaagcaaaatattacagcatttgcatctcatcatctcattaatcatagtaggctgcagtattttgattatttactatattgattagaactttaacacatacaaccagatttggaatttgtgatttaatcccagatgctgtaactcaatagtaaactcatagaagtgaagtaattaatttatgtgtagaagaacaccaccttatttctattttgggagggattatgatcctatatacatagctaaatgatgagattttagagagggagagagatcgagttggcgctagaacccgcggtggccggagtcgtcgacgtcgtcgtcctgcgagtagaagtcgacgatctccgacaggtcggcggcggctgattcgtcgtcgtcgtagcccagcatccccttgtctccggccgcctgcagccacagcaggtgctcgaacagcagcacgtccacggcgaccgccaccgcgccgccgcgggtccgccgcccggccgccgcgaggaggcgccgcaccggcccggcctcgagcacggcctggtcgacgtggaacacgctcctctcccccttcgtcgtccccacctccaccctaatcacatcccccgccgcggaggaggagtcgaggcgccggtaccctccgccaccgccggcgccgccgcggcgggacgcagagcggaggaaggtgtagcagccggcggaggacggacgcggcgacggggcctcctcctcggcctcggcggccgcggcggcgtggccgtggcggcggtggtggtggtggggcatcgccgattcgccgggtttcgtggcttgcgggaggagcgaagcgattgctttgtggtggtggtgtttgtgtgggcgggtgtgtgcttcttttcttttcttggggtggggagcctttttatgcagtgggtttggaactaacggtcggcttacggggcagctcggtttcctccctcgttccatattggatcatgtgatttttggtttctttttcccttacattggccttgattgtagtgtgcttttttgttcttttgtttttttgaatttgttactaccttgatccaaaatgttactccatccctcccaaaattataggacccaaattataggacgtcccctttttaagaaaaataaaactcaataacttttgactaataattttactaactatatctatactgagtattattgagtattatgcatgttatatcattagattcatattttaaagtactttcatgtgatgctaattttatattcgttgggatcatagaatgaaataaaatattgattaaagtatgttattgaatatcgtgtaaaaaatataggtcttataatttgagacagaaagagtactatttcgtaccggataatgacgtatcttaattctacgaatctgacataggtaataatattttgagatgaatgtagtacaaaactttcgacaatttttcttcaaaacttttagattttcaactctctaagattcgtgttggaaccgaaggtatcaactattatatatgcttcaagatttgtgatgtatttctaacatgagtgcatccatgtgagtgtaattttgtgtcgtaagatctaaatttcagtgggtgaagttatacaaatatgattccaacgcgacgcttgtagtgcttcttttccctgatttttctgcatttttcaacacgaataaaaactagtacaaagcactttgtaaaaaaaaatcgtgcatttcaaacatggcttcgctaacaaaaaagtatttccacctaaccctactttgaaacaaaacaaatcattcaaagctaatttacaggtatcggctcaattcatgcgtcatttgcaaaataagttctcgatctttaaagagatttcactgtttagacaggttttgcaacaaactggtactgttcatgaaatgctacagtggccttggtgccatcaaccggacacgtaggttgtgtgtgttcattagagttggcgccatgtgcaagaatactgaagtagcaatggctcggtttttcagacaaccactaatcaccgcactgatctagtactccctatctcctaaattataagacataagacatatattttttatacatggtatttaataatatacttggatcagtattttattttattttatgatcctaataaatataaaattaacatcacatgaaagtagttcaaaataaatttaatgatataacatatatagtacttagtatagttatagttatagttaatatgattattagttaaatctatcgagtttaatttttcttaaaaaggggtgtcgtataatttaggaagtattcttcttataatctactgctccctatcagggtttcaaatttcaaaattagggtttctaccgagggggagcgatagaaccgaaatttcagaaattttagaattttttcgtacgaatttttttgaaattttgactaattttgaatggatttgaataaaatttgaccaaattcacaaaaatttacaaaaaaaccgaaagttttgggcgagatatgaacatttcggtggggggcgaaatttcggaaatttcgaaccgaaatttcaaacactgctccccataacttgattagcttaaggattagtacacgagcaaattaacgtcagaaagtggttgttagccggaaaaaaggctcctcggattgaggtaattaggccaaaaggagacccgctcaaattccaaaatgtttggtggagtatataattagggcaactagttaacagtaattttcaaggtgcaaaatcgaacgaaatgtcgaatcgtatttattacttcagacagaaccagtctctggggtgtttgggagagaggggctcaaaaacataagtcccaggctaaagtttagcctctctcttccaaacaccctctctagctacgtgttgtccatttggaatctgttaacttcagctggcagaggtataccatacccatcattcgcgcgttacatcgtcagtttgcgtgcaatcaactcatcgtccatattacacttggacgcataatcaaaggaacataaattaattcaaaaaatttgttacgacactaaacatatactgtactacttctatgtcgatcgaactgccacgtaaggttaccatgcttattatattcgattattaatttgttgattaattaattaaagagtctggtttaattagacgtacgtgtgcacacacgttgcgactcgtgatatgtttttataaattttaatcaggcagctgctgcctacgtggcctggcacgtggcgtcgtcgccggctgcctcgctccctgctccggcgaccgttcctccgggagacccacacgtgcgcccgacgtgtacaaccgccgcgaagaaaactcgcagctaatccatgctctagttcacctcttctactctcgatctccatcaccgattcaccgatcggtcgagtagggcagccatgggcggatcaaggaacaacaatggcgggaaaacggcggaggcggcggcggcggcgagcggcacggccaacaccgtcgtggcgctcgtgctcctcctcgtcgccgcgtcggccgtcgtgttcttgctgtcgccgccgacgccggcggcgacgcggatcggccgtcacggcgacggcggcccccgccgcgagccggtggagctggccatcgggctcgccggacacgagagctggctcgacgccgtccgcgcctgggcgaagctggcctgcctgaagctccggccgccggagccgcggtaaatctcactctcatcatccactgtcatgtcaatcctactcaggtcatgtcgatgaaatagcgttattggtttttgatttctttaaacatgtttaatc

SEQ ID NO: 40270 - DNA, 11855 bp, Oryza sativa
tcggcatatttagcgaaaaaggcatatagcctagtggttatagtgacctgagtagcacccccaagtttataagttcaaatattcataggggccaatttcaaattgggttatttaagggctagttcttcttcattcgataggctaattttctatttaaaaaagctggatatatccggttggatatagaagccggctaaaaaatacatttctctaaataaaaaaaataaaaagtttatgtaattattaattattttattataattattttattattaaaatactttaaacgtacttatacaaaatttttaaataagataaattggtgaaacatgtgtttaaacgttaacctttaaaaaacgaagggattatgtatatattttgcaactagtacatgtatacatgttgtgttgcttgtgtgttttttgggccagtgagaaagtggcgtggtgctgttcgaggaacggcgcggcggtcgaggtgtgtattctcacggcggcgtgtgtgtgccaaggtacgatctgcgcagcccggcggcggtgaaggcggcggcgaaggaggccctggagatgggcaaggtggcggtggagcacgccgcagagtcggcggcgacggcggcggaggaggcagtggggaagaccacggtgaagctcaagaggaagttgtcgccgccgacatcgccggcgggggggcgcctcgacgaagacctgtgaccctgtgttctgtactgtaagtgtgacgtgttgaaaatgtgcatgcttttaagttttgagtaaattccctgtgtacccctgaaaactcactcaatgccttccatatccctgaaatttacccgatcccttctatgcccctgaaatttcagtttgatccctttcatgcccctaccgttacattttccattatttcactgttacgtttggttgcaaatgtcttttttgcccttgatgctttaggtttaaatgtaagcttcaaaaacaattgaaaattttgtttgattgcacagcatgtgcattttataaaactaatgagactaaataattagtgcagaaaattttgacataaattttgaaaataaaataaatgtaataaattaaaatttttatttgaaattttaataggataatagatttttttatctggagcatttataaaaaaaatgttgtgaacattggtagtcctatctttatttgaatgctcctcatttttatgacttttttataaaacaaataaatatgtattttttattttattatctaaaactattttttgggataaataatgcattgcacaacaaactcataagtataatagtctcatgcgagaagcttttatatttttaataatgtaattcatgaatttctttgttcatccaaggttaaaatggtcatttttatagaaaatagacggtcaactgacgggaggggtatgcaagggatcaaaatcaaaatttggaggtatacaaggaagtaaggaaaattcagaggtatagaagggattaggtaaaatttcaggggtatacaagggattttctctttagtttttctgtacccatgtgaattacagtacgatgtgttagcgtcttgtgatggatgatgatgcttggaagttggaaggtggattggagttggacgtattcggcttcagtactttggtttacaatctgcaaaagcaagcataataaaaatgatagaggaacaaacgcactgtttagggcccgtatagttccccaaatttttttcttaaaaacataacatcaaatcaaatctttggatacatacatgaagcattaaatatagataaaaggaaaaactaattgcacagttatgagggaaatcgcgagactaattttttaagcctaattagtccgtaattagctataagtgctatgtttagggcccgtttagtttcccaaatttttttcttaaaaacataacatcaaatcaaatctttggatacatacatgaagcattaaatatagataaaaagaaaaactaattgcacagttatgagggaaatcgcgagactaattttttaagcctaattagtccataattagctataagtgctacagtaacctacatgtgctaatgacggcttaattagtctcaacagattcgtctcgcggtttccaggtgagttctgaaattagttttttcattcgtgttcgaaaaccccttccaacatccggtcaaacgtccaatgtgacacccaaaaatttccttttccccaactaaacacacccttatcttgaatggtgatgggtgctaatcaaccgactaacaatataattatggcgtgtatgtacccaaaaaagtgacagaaatgacgtattatactattttttgaaggataatatagtacaatataattatgacgtattgtactataggagcatttctaaagcagaggaacaggtattgcagtacataccaggacagttgtcttccaatgcatagcaaaggttttaacttcaaaccaggctaaccagcggcaagcaaatggttcagatgcggcttaactacagcataatttcctaatttcctcacctaaatatgtagagagaaagagagattctctcctaggaaactagaaaaactcttctgggagtaattactgcttactactactagtaagtatgcatacaggtgagacacaggagaatatacagaacaaatttgatagtgttgagatgatgaggtcttgggaatggccaccactcattccgggcagatgcttctgaaaatgggcagcctgcgtccattgctttgaccataaagagtttgaattatcaactcttcatcctcctcaattggctctgcctgcgcagatgctggctgagctgaaggtgttgttgcttcatcaggttttggtgttgaaagctctgccctggctgcttggatgacagtatcttcccgtgatcgaatgtcagcaggtggcttgttggggatgcctcgagctgtggcagtaggatgatcggcacttggctgccatggggagaagagagaactgatgtcgttgaagtcttgataacctggagcacctgtctgcccgcccgcctattcagaagggaaaatggtaaaaagccatttattgtcaacagcgtgcaaaataatggtgttagcaatacaagtgccctgaaacaatgatgtttgtaaaccatatagcgtgctaccaatagatttaattgaacaatgaagctgaagaaacatgccaaccatttcatagaacaaatcaggtaatggatgatgaaaagaatagcatagtataaataactggagataatgtgtcctgtatcacaaatcccgacttatcaattacactgaaaaagaaattgtttctaagctcgtaaaacataaggcatccgttaagaaaaatgagaaggaaaaatcccacggtgaagcttaacagcagggctagatttaaaaagttacactggcaagtcgtcattacacatatctgtcgaaaactgtagtagtagttctatttgtataattgtaatgttctctggtcagcaacaaggacaactagtggtgagcaagtatgcaagtgcacaaggaagctaaaagaaaactggattgaaaattgttccttcacttcaagaagattagacaacacatgtctatagtgatgaacaagaaatgcaagtgcacaagctaacagaaaactggatcgaaaattgtttatccacttcaagaagattagacaacacacgtctataggataaatcatgactgtctgattctgatccctatctggatagcaagaacgattacaaaaggtaacatgacagttatgcactatttctcactattgaaacagagggttacttaagcacaaacagaattctcccactctttttctaaaaattctagtagtacactatatttctgaaatgactgaaaatgttaacaggacattacaagcacacatctcacaaaggcatgcaccacctagaatgaatgttatgtatgctaaccggttatcgccttattaaatgcataatcaaatcccatcatacagaataatgaaaacaacaacatctactttaattaatctatcaacgccacaattaaacataaacagttacatgttaattaatctgatgcaaaagatgtattggagacacaaatgccattaagggtgtggcctacatgtaccatacaacatttatgtagaacagtactaaaattagttgacctgatgtactatagtaatctgtttcctgttttctatctcatcaatcactacttcacagttggacttaaaatcgtactacatctgtaatgaagcatgaattgcctgcagaagcatatacacttctatcctaagctcctaatgatccagagttcggcaccagtttttttcttttctcctcccatttaagatagaaggaatgaaatatccgaatcatggaatcaacaataaagctactgcaatgccaaatcatggcattaacaaagatactagagtacatcagtgatcagtcgtgatttttttgcaaccaaatcagatcgtcatatttttatccgattgacccgaaatgcgagcgaaactggatctcgagagcaaatacagtgcgtacctgtcgcttggagtcataccgacaacctccagcaaccaccacgtcgccggccggcggcggcgggtacaccggcgcggactgcggcgagtagacgaggaggcggtggtccaggtcggtggtggccgcggaggagaagcaggcgcggcggtagcggaggagcgagtcgtcgagcccgaggtccatcccgcccgacgacgacgcggagccggagtacggggagacgccgtccacgccggcggcgacggcgtcgaaggccggcgtgaggtaggccctcagcgacggcgacgagaagcggcgctgctgccgccgccgcgccgccgactcggccatccacctgcttccggccggcgaggcggcgacgaaatcgaggtccatcacgacgcccccccccccccccccctcccccaatccttcgcctgagcagcaaaattagggtctctagtgttaaatcctcgagacggcgaaatttaaggaagagaaaatttcggatggggaaatttcaaatatcgaaccgaaaattagggtcactagtgttgaaaaaaaaacttgaaaaaataatccccaattttctctcgatggcgcatgcggccaatcaggcggttactagctcgcgattaatacgcaagtccaaataatattggtttcctgtggatttcttcgattggggaatcgaataaatttttttttaaaaaaacggcacaaatcgtcagcgaaatggcgtcatcacatcaggatagcacaagtaaagcacacatatactattcgtaaaatccaaaaacctcgaacaacagatcaggatctaaaaaacaaaaaaaaaaccttcagaaacgataaaattccggacacgttcgaacctctcccacacaaaagcgatcatcaatccaacaaagaaaaaaaagtaccaaatagcaagctttgattaaacaagcaccgaaaaaaaaaatccccaccctcccaaaaaaaaaatcgttagaatactattcgagaagtcgcagaagagattcaaacattcaaaactcgacggagagtgactcactcgatccgagggaccgaggcggagaggtcggctcacctttgcggccgtggaagcttcctccggtggcgctcgcggccggaaggtcacggtgacgccaccattgctgcgtgctcgctcgctcgggcgggaagtgaagacgaactaggaggaaaatacgaaggagaaaggaggagagcgaggtgggggtagaggatatgtacacgtggcccctacgtctcctcggattccgttattttggaccagggaggcaaggcagtagtggtccgttgttttgggcctggaagcattggttgggccgagcccatctcttggttggtttgggctggttggtattccttttggtttcggccttttctttcctctctttcttttctttaactgtattctcacaaaaggatagatttgactgttcggaaaagaggatatgcttgagttcatccgaaaacatcacaatttcttcatacgtcagttgttggcttaggccccatttgatttcgatttattgggtagattattgtcacagattatttaggagtacttgattataagaataaattaaatattttaataaataaaattaacaaatagcttaagacaagtggggttctttttttttattttgaaagacaagtggttcatataatatactagtagaagaaagtttattatttttaacatacatttttttaaaaaaaattgaagagcaaataatccattttaataatcgttgggcttaatcaaatgcagctcatactattatattgcaccatggaaaaggatggatgcacatccctagacaagtatcacatagaagaatgtatattgaaactggagtactggacaacacagtgagcatcaataaggtaacttcccaacatcagggagcacatacaatactagtagtacctaatatcacctcgccgtataggatcagccacatttgttcagtcagaaggaaactgttaaatcacactacacaccaaaccaatatattccgtacaacatagaaaggttacaagagttaattacacaaagaatagtacttattctatattttggatacaagctgtaaactctttggtacaccatcgccccttttaattcctgtatgatgctactacaacaccgccaatgcaatatgtacaaccaaacaaactatgagactcttaaaacaattgagatctcatatacaaacagctaaacttggatatgagatatccaaacttgatgcaaataggagtatgtcaaagaacctcctaacacacgctgaatagtaggcatgctgagggggcatgcatggcaggcttgggtttagatcccaggcacaccaataatgcaggaaaaaaaactgaaatatacttataacagtttcataggctattaaggagagcccttttgcaagaaggctgctgagaagtgtctggcctcgaccctggcgaggtcaactcaagcacagacagcaaaaaattcctctcctggaaattcaaataaatataaatgtaaatatatttgtcatatggttttttcaggtaagtattatatgttcgatatgaaccggccatatcatatgtcaagcagttgaaagcttacactagcagtaaattttggagtcggcatgtcatctgcgtacggcaggaatgttgggactgtatgagcaggcgaagtgaattcgatacatgaaggattgttacatttgacaacctcgcgtaacttctcagaagctggtgtttctgcatttgcttcaactggggtagttgtctgagcaggggaggctaattgaatacactgaagcctgttatgttcgagaacctcgctaagattctccgatgctgctatttctgcatctgttttagcttgaataactgtgtgtacaggagagctgtattccacacattgaagcaagctatcttcgatagcagcctcagtcaagttttcagatgttggtatgtcttcacctggtttagcttaaagaatttagttcattttctatatgtggtttaaagagcattttaccaaagtaataattaagagcataggttaccagggcacggttccatattattgtcttctgtgctcttatcatttgggcagtcctccattttattgtcaggaaccatttgtgatgtaacttccatgctagtttgtgaagaattttgcttgttctccacatcaatctgttcggtctgctccctgtttgcacagtaatggtagatagtgtcaacaactgagaaaatagatttaaccaaaatgatgaccagatgatgattattaccttaaatcctggtcttcttcctcttcattctcataggggtctacaattaaatcgtcaagatcctctaggagtgaagccattcccgacatactgctctctgacatgtcattatcatctttcttatccaaatgatgctgtagttgctgaaacaggcatagcacagtttatttcaaatagagtacaaggctgcaagcctaagttccaaatttagaacaagttggtgctgtcatacctgccaggcttcgtccatgctttggcttgtattttcagtatttattttcgttgctagggagcaaagcaagtcggctcgctgcaataaagtagcaatttttggatcatccttgttcaaaaaattaccctcatgcttaacgcctgcaattatgcacatagctgtgattaaagctgggacaagacaaatacatcaaactcaaatgcacattatagaggaaaacaggcttacaattctgttcccccgcaaataattgttttgctgcagttttagcaacaagattttgggtatccattgtattcatattatcttgattgttttgataaacaattgcaagaggctgtcgagaatcttgtgtgctcttgtcttgtccaactaatctcatatttggtgtcatattctctttgaaatcagaattacatggcctagttgcagaagagaaaaatgtaagttgcttcgcatgcttaatagaaaatagtgatgctagtgttatgtgtacctcatctgcttaataggtggtgcagagccacttgcaccagatgtgagacacccagtttgtaccaatgccctctttgaacttgtactggaacataatgatccattttccttgaatagctcgtcatccttggcccgccttttgcatagagtagaaaaccgattcttcactgcattatcagttctgttgtggacaaacaaacaaaaaacatgtcagatattttattacatgtatttttttcatcttgcagtaaactgcataatacaagaaacccacctgcctgagacaacctttgctatttcagtccatttgttcccaagaactttttgagcctgcatgacaattccaagtagagaagaatacatgattcaatcttgttaaggaatccatggtagaaacaaataattatgaaaacaaccacaaatctatgcagaacaggtggtttagggtttccagtatgcggagttccaagtctgtcagagcataaaacttgcagccaaaataataagaagaaaaatatgacattgcaaaactaatcaatgcgcaagcccatctagacttctcttatatatacaaaaatataaatcctatctcctgctatttacaaaagaatcccattcttttcccaaaaatctgaaaagctgcatacgtacatgctcaattccatgggcatagcaatatgcctggcctgttgtctcactgaggaagtaaccgaccgcatatttgccaattcagaaatctaaagtttggcccaaaagttacatcacaaatggttcctaataataaaatcaaagtgtctgccaaaattcccaaattcatgaaactgacgcatatttgccaaatcagaaatctaagtgttttatgcagcaattcctaacttcagggaaattcagtgtctggaccaaataattaaaatgtcacaatatcaatatcccacctcacacaatagcaagtcctcttctctggaccaccctcctttcttgcactccgagttcaaataattgtaccatctgcagcagtaaccaagcaaagaaaaaatgaacagggcggcatgcatatttcgtaaaaaattcgaacgaaattccaataaaaccactcttttagtcagaggatggcgaggtacactgtacacaccttctcctgcactgtctggccgtcttgtccttgaattgtgccgctataattgtccagctaccgaaaggaaaaggaaaaacagtgtaaaatatggtgattaaatctagaaaaaaaaagtcaattgagatgggaagtgggaagaattcatacttatcagttccatgaagcgcaatttgagtacgaagcacatcatcctcctaacaggaagaaaggtgcaaacatcagaaaaacaatttggtctaaaagttaaacaaaaaatcgcagacgcactcccaaggaaaggttcgacagcatctgaagctaacaattataattatattataattataattaattataattatgtaggcacaagttcttggaaatgcaatacacttttcaaaaagaagaaagggacacatattcaaacttcgactattctcgatgctcacaaatatcaccttagaccaaaaaaaataggcaggagtcgaatcaaaccaaagtccatttagatagattatgcctaactatgtgaaaaatctactgttcgttaggcaaaaagaaggggaataattgctagaggcgtcgagaactaattcgacccccatgttctaggcatcgaaatcgagcgggaaaggcacaaattccaggaagtgtgatgcacttttccattatctaaaaggtacacagattcaaatttcaattatcctcaatgctcacgaagaatattgccttaaaccatagaattaggtgagaggaacccaaccaaaatcttgaaaagtagacacaaattcaaactccaattattctcaatcctcacgaatatcgcctaaaaccacaaaaattaggcgcgaggagcccaaccaaagtccatttcgataggtcatgcctaattacgtgaaaaatccactgcatattagcccccaaaaaaataaagaaggggaatgattgctacaggagtggaaccccaaaatttcaggcaaccaaatcgagcaggaaagcgcaaacgcacccaaaaaaaaaactcccaaaatccagaaacacacgactcgatagaccacgacaactcgtacgcacctcggtgctccaactcacgatgtggcggtccttcttggccgccgacgccgacggcgcttcggcggaggcggcggcggcgggtggggtcagatcgggtccggtcgccatggtccgggatcccgcatgttccgcgcacggatcccggcaggccgaggtaggcagccggcgggcggcgggcggcggcgagccggggccggctagggtttggggaaatgggcgcgagtggagggaatttttgaaccgtggattcgagaggaagacgacgacgacgaccgagttgggttgggttgggtggagaggaggaaacgagagagagggggggtggagtgtgagatgggggtaaagggaattttttgtgcggaagcggaggtggaggggtttttaaagttggtggggggccatatggctgttttgggagaagatgatgacgacgactcgactccctacagaatggcggcaccggcacgtgcaggtttttgaggatggggcaaagggaacggtaaagaatggcagttgtactggtttgtaaaatcaggttacggtttgtaaaatcacgcttctgataggcaacaatggattgcttcctaaaatgatttgtatatggagtaggtgattatcttaaaaatatgtagtaatgattttaatttttttttggaaaggttattaatgggtctattcggcaatgctgctatgcagctgtaacggctgcgctgtacagccagccttatatactttctctatcatgcactgtagcacagctgctgcacagcagctgcaatttagctgcagcgaacaaacccaatagtcttttgtcatttgagagatactcataagattcataccggtggtcgaataatgatatcctaaacccctactaatatattcaagccgtataaaaggaggctatagttgtatttcttgtatactctacctcaatatctattagaattacatatttcctacttcctccattttaggttatataagacgttttgactttagtcaaaatcaaattgtttcaagtttgactaaatttatagacaaatatagtaa

SEQ ID NO: 40271 - DNA, 15064 bp, Oryza sativa
ccacgttcatattgtttgaattagattgtatcatatttaagataccggtaggtgcacacatatttctctcttcttctactacttgttttcttttttggtacctctggtgaattgtgttcatgagttgcatcatgcgtgtcatgcaacgggggctatatatggtgagctcttgtgacttggtttatggtgctacgctcccactacgtttggagggcgaaatggtcgatctaagcataagaatcttgtgaaattggtaagcacactgaattgaaatttttgagttttcatttttcgaattttcagtgtagctagcagatgccttcgtttccatttcggcgcgagttaggattactttgaaactatatgctgttcttatccctgtatttaattggtaagctcaccgccgtgtaactttcaggttgcgtgcgatttttttttcaacaacaaaataaaaaaccgatgagttagagagacagagagcagtcttcagagcaaggtttgaataagacggttctcaggtctttaggttctgaataaatataatcttcaggttttgaataaatatactccatgaaggtctagcagtaaataattaagatggtttgaactgagcatctgtagttaggcaaccttctagttagtgaaagttgccatttatccactatacgtgatagtgacctctagctatattactcattttcaaaggtgatgccaacggctaatttcgaaagtccaagcttcatgaaaactactcgctccgtttcaaaatatttgacaccgttgactttttagtacgcatttaaccattcgtcttattcaaaaaatttaagtaattatttattcttttcatatcatttgattcattattaaatatactttcatgtacacatatagttttatatattttacaaaaaattttgaataagacgaacggtcaaacatgtgctaaaaagtcaacggtgtcaaatattttgaaacggtgggagtatttaatattatactcggcactaccatcagtatcaggcttcagagaacttggcaacaggtagcattgtaaaactgagctgaattctgaaacaaaccgggccaacggccaaccaaccgaagcaaatattcctgctttctcagtcccaaagtaagttcttttttatcccttccgtttatcccaaaataaattcattttgcagcaatcattgcaccggagtttatgaaagtaaggaataaatatattatgagtaggtaaaatgtggaataattatattgagatttaataaagtagatgtattctcgtattttgttttttaatgatatgtgtggatagctgaaaagaattattttgggacagattgagcggtgcactgttccatttcagttgaccggtgctgatcaaaggctcaaagtctcaaatagattaggcatcttgaaaagctaaaacaagtatccttgcgaaaagccaggtgtcacccaagtcagaccctttatagatgcgactaaaacttttaagtccttatcacatcaaatgtttagacactaattataaatattaaacgtagactattaataaaacccatttataatcttggactaattcgcaagacgaatctattgagcctaattaatccataattagcatatatgatactacagtaaacattctctaattatgggttaattaggcttaaaaaatttatctcgtgaattagttttcatttatgtaattagttttgtaagtagtatatatttaatactctaaattaatgtctaaatataaggactaaagttaaatccctctatctaaagaccacctcactcattcgtgcatggtcattgcaatcgcaaagaggcttttgtaatggcaagagctgtacatgtactacttctactgttgctgctcatcagttgcaactgtgatgagcaggcagcatgcaagagtgcagcgcatgtgctgatctgatgtgcattttttgcgaggtgacgaactgcatctgctttttttcccttgctgtgaatctgtttttctgatgagtagagcagtggtcatctttttttggagggcctttacgcctgtcagatcctgtcaggaccgaaagtgtccaacgaaaccattaaccatagagaatcctatgcaaagacggggtcagtccccacctcggttcttggttgtcccagctggtcttcagtcttcacctcggcctctgtggacatgttgcagtcttgcagatcaagtgcatatagcagcagtagatgaaaagagaagtcaaaaaaatgaatagagaagatcgtactaggagtgtacatggtagtagtaactgctgagtatatgtacatgtatgtagtatgggagtagaactacacggtgaactcgcaggtggcttcgggctcaccactacgagaggatcacggtcactcactcactctgcagtatctgcagtagcagtagctaacaggtggattcggtatcatatatcagcagcaactactgtatttatagtactacagacaatccctattattagaaaatatgttgtcatgcaggggagggagagagagagcgcgcgcataaagaagagtggtctatcatgatgatcatgtattctgcgagaaacggtggaatattaactggaagaagcggtgccaacgtcttagggttcgtgttgggagaacgcttcgttctgccacacaatgtgataccccttttatggtcagatgtagagagtgaaggtttggaggagtagcggctagagaacagggaccggatagatggagctaagggaggaagacgaggggacgatgtggctagatctagagggtgggatggtcgtagctagggggcatgatgggaggacattgccatcaccgaccagggagacgacgagtagatctagatggcggcgtcactatgtgagtatgtgaacatatttggatggcgacgacctctatactcgacgatggcttgcatagagcgtgcagaaaagagctcccattgattcaaccaccagcatggagaagtggtgcgatgcggcttctaacgacgagaaggaaggaacgtgtgtcgttggtactcaagatcaaggaggagtgggcttgatcttgagagcggcacaatgattcagcgacggaaggagaacactatatagtgtctagtgacagaagaagtaaaggccgcggcaacaaggttttgccttcgcttggaactcatcgagagtcagaagtaagcgcatgttcactttgatgccattttcaaccataccaattttttttagcaaaattgccaaaaaatggttatgtttaatttgttgccaaatttaatcaatatataataaattctgccaaaattttggcaatattgtaatcttgctaaaattttggcattgacaaaacttggtaaggtttattttggctacaatctgaacaaaccctatgagggaaagagaaccaaggggggcaagggtttaaatgtgatagaattttctcatttgagatttgttttgtaagctaaaaacgaattagaaaactatataagaacttgaattaaaaaaatagaggtattataagaacttgtaagctacaaattttgaacttgaactatataagaacttaataaaaattgtgtatttactttcaatactattatattttaactgtaacaaaaaatacaaaattatgacaattttaagacaattaatttattagaattttttatttttttcgctctttatgtagaatgaatgtgaagatgtggctttacatgtatatgaaatattattgaaattacatgtacaattatttctaaaatttttaataatatttgttagttagtgtgtacggtgtgtatacgtgaaggcttgtgtgtatatgatatgttcacaaacaaatgtggggtgattgaggataagattaggtaaataaaaaattaaatgagtggtgctttggtaagggaagtagttttcaaaagtacttatatttatgtttagattttaaatggtagaaaaagtttatatttattaggaaatagagaaaagtacgaggcttccattttgttcgcccctgcgaattactacaaagaagggaagcacctgccaaaaaatagcgcctgtatatgtctctctcgatgctgtttacaaagaattttcaaatacagaagatttgagtcaccgaaaaataacatactagcagctattatgaggatatgctacgcaaatgcgatgttgtgttagggcctccaaggaggctttggcatcgtcagagcagacgagtagagaaaacatgcagccctatcgtttggcttgtcggtggaataagccaaacaacatatttgtaaacgaaaagtaatttgttaataaaatttttatgtataagttcttagtaatttaaaagcaaaatctgaaaaagcccaaaaataacttcaaatttaaggttaaaaatttaaatttgggttgataagtataaacataggaaaaatatgaggccgatcgactttctgggtttgatttaggcccattcgtttcatccagacacagctgcagcggcggcggccgtggttaactgggccgaaatatcaggcctttcccaaccaagcccatcatttggttcccaaacacttgatttccagaatgtcaattgcagagcagcaaacttagctacagttttgagttgatgagttcaactgttttatcaagaaagcagcattgctgcaagggacagtaataaacattaagcaacaaccacaaaacagcacagcacaaaacacgtaaaacgaacttattttgtccaagaaattaaaacatgtgacctgtttgatctaaggaaaaaaaatgatcaagttgagacatcatatgttggatcatcccatcgtcatttctcttcttgcgcggatcttggtcgcccccatcgtcgtttggccaaatatagataatacgtcattcagtgtattagtaaaataataataatttataagtaagacttttatatatgagttcttagcaacttaaatatcaatgtaaaaaataaagttaaaattttaaaaatcaacttcaaaatcagattttaaaattcaaattttgaccgtggctgatgctgtatggaggagatgacggggcctccgtcacccggaagtactcgccggtatccgtcctccagtaggtgtagcctgtgccatcacgttttggcctcctacttgatttcattataactagcgattagaatctgctgcttgtatttgagtatttcaaagcttgcgactactccttactgagataaacggtaaggattcagaatctggattgcacatcttcaataccaaaccactggcactcaagatagagatttcagaatctgtgacggcactcaatatttgtgaagacacaagtacacaacaggaagtgctcccaaaaggatcataccaacatttaaacgcatccaaaaactgtaccacacatctttactgacagtctaaaactacttctggtgatgagtatcattttcataattttgaagcctacacaccacagacactgcaatatgtaaccaccaggcatgaacatcaagtggaattatactacactacacacaaacatacacaaacaagcctacacacacaatctgtagttctgtactatcaagcatgaacatagaactgtactactgtttaaacactgaattttcagaatgtcattgcagaagcaaagattttgcagcaattgagtctgaaagtttcatttctttcctttttttttctttcagcaagttgcactgcaagggacaatatggttacagtagcagcagcaaaaagctagtacaaaacataaaactttgcaactacagagcacactcaatcgatcatcaaaagggctgttcagagacagatatgatcataccaggaccaggaacccaactgaatgaatgaatgaacagaaccaaaaggctgaaagaaacctacagttgtacacacaccaatcttctctaaggatgtgttcgcagttggttgttcccaaccgggaacagtactcacggaaaacggagcaattcattagcacgtgattaattaagtattagctattttttttcaaaaatagattaatttgatttttttaagcaactttcgtatataaaccttttgcaaaaaacacaccgtttagcagtttgaaaagtgtgagctcctccacgcgactgcacacctcgccggcgtcgagctcggcgatgccgggtcccctgagaagggcgacgcggccaaggaagtccggcgagaggcagaacagcgggaggaggtcccgcgtcaccacgccatggccgccggcgccgtccgcgaccaaggggaagagccccgaatcgtagaggccgaggtggaaggcgaccagctcggcggacctgctgccgcatcgctccatgtccctggactcgtcgaacaccaccatggcctccctgctcggggattttgaactatttgccatcttctttaatggcgcactctcaaatgccatcttcttcaataatgttgattatttgccatccgactctttatattctttctattttaccattcttccctgccaactcagcaaacttgtgtgacaaatgaccttactgtccctcatctcctttcccatctgcagttcgcagactgtgccatcaccggcctcgtcaagtgaagaagctattgctttgcttgtttgcttggtcgattggtaatttggtatatatgcaagtaattaatctggagggttgaatgagtgccactgttgattgctttacttaatgcagcgctcgatcgaaagcttggtctttttttctttagtgtgttttcttctctttatcttcgatgcttcatgttggctctacccgaatatgcaacacgaaagcgctctctgccatcatgggaactttgtcgctctgctagcttgacagttcgatttacctgataactgatgagaattgctcgtccgagcggttgcccgcgaatcggataaaagccaaggtagcggtcaccggtcacgggcagtacgcccttccgtgtaggcagtcgccaactcgccatcgccgtcggatcaagaagtggcgaggtccgcttgaagacggcaccgtcgcaagaagaatgcggaggaagaaccgaaaagacgggggtagtgaagtcatttgtcacacaggcttgctgagttggcaagcaagagtggctaaatagaaacaatatagcaggtcagatggcaaatagttaaagtcatttgagaagatggcatttgaaaatacaccattcaaaagaatggcaaatagtccaaaatccctcctgctcgagtagtaagccaccaccgcgcacgctctgccggtcgctgccaacgctgacctcgcgacgccgtacagatctccgggcgtagccgtgctccttgcccccatcctcagcagcaggcacctcaagttgatgtcctcctgggcgtctgctttcagatatcgccagggaaccattcgacggaatgcctcggcggtggagcaccgctggctctgctggtcggctgcatccttcacaaggtttaccgaattatgcagaatctcgtcatcaacctacaagaacaacagattcagagcatcagaagtggaatgaagcaagagaaacatgaagattcaccctgcagcagcaaccgattcagagaatcaaagaaacgaacaatacgggaaagggagaaacatgaacaggcacctgcagcaaccaattcaaagaatttgaccatgaacaaagcgggagaaaacatgaacattcacctgcagagactaattcagaaccggaacagaaagaattaggacatgaacaaagcgggagaagcatgaacattcatccgcagaagccaattcagaaatcagaaccaaaaatacggagaattttgacatgaagtcccggcgaagaatctggacatgaacaaagcgcagagaccgattcagaaccagaacagagaatcgaacatgaataaatcgggagaactcaaatttcacggtccaaaactcccaagaaccaagaatttgggcaatcattgaaccaagaacaccgccgcgatcaacatctcgcacccaagaaatgcctcaacaacaacggatggggaagaaaagcagagaagcggtggttgtaccctggaaatcatcaggtatgcgcctggacgagccgcctccatctccgccgcatacaagcaatcgctctctgcggagaacaccagcatgccaacgcgctcgcatctggtagcatctcgtagcaggacggtcgctatgacaactccatagcgggtgaagaacgactccaggtgtaccggcgatatgatggaggctacacctccgaacaccagcgctcgacgcaagaaagtggagtcctcgccgagaatcggttgacgctccaagagcgcctcgatgaggtggcgcaagatcgcgctgtccatagaggcggacgcgaagaaggaaagggagggagaaagaatcgctcggtcaggctggaggaggttcttcgtgatcttggtggagaggctactggttcttgatttcttggggagagaagcactgaagcagaggggagggcgagcgagttgggagttgctggagggagtttcagcccgtatttgcgaattgggcgaatacgggctgaaacttcgtggtctaggccgtaaccgttttgcagattaatgtgccgattgcagtcagtatggagcaggaaagcacatattcaggaataaggtaaacacttcttttaggggtgaataagttcgctttacgtccctcaatttgttgccgagtctgaaatttatctgaaaaccgtaataccatgtatagcacattactcaactcgcaaaaccagtacaaataagctcccaaggcggtttggatgacgatttcagctaacgtggcgttgatgtggcatttaaagtcagaaaaaatcatgggacccacaactcaatgagtatttggttaaaaataaaaaaattatagtgggacccatatcatcaccctctctttttcctatcttctctcccttcctcatctctttccctttccttgttgtcgtcggcgcatgccgccgctgtgctcgaccttgccgagtgtttcgctcatttcactctgggtggacgaggtgcacatggaccatggtgcccagtcgtgatgggtgctcagagaagatggcgcgggctcctgccgtgctagggcgccacagggaatagtcgagggaatcgagggtgggaaagggaggaggaagtggtgggcaaacccgtcggagctcgagctcacccgaccgtcgtgtgagggagtgggatggcgtcattgaggagcaactgtgcgacaggggcagtgtgcgcgcggacgaggtgtgtgtgaaccatagtggccagcgggggcaggtggccaagggaggtgaaggtgagaaagggaggggtaggcaactagcgaacccgtttgaggtcgagcttgcctggcctccatgcaagggaggtggagatgggtgagggagggagatggctcggttgaggagtgaccatatgacggggggacggcgtgccggcgtgcgtgtggaccgcgggggtggtggttggaggctagggcattagcaaggcacgggctgccgccattctggaccaccatttgggggggagaggggtcccatacgagattgagcattcattgcgccccgtgccatccctattgccaccgcacatcttcccgcaaccattccacctgtgctacaatggatatctcaacaagactagcacgaatctcaacaaatatatttttcaacggtacaaaaggactcaacattaggggtggattctaaattctcaaggagataccttctctattttttttcatcttactcaaatagttataaaaaattttgaaaaaaaaagagaatatctattaacatgtgatataccactccataaaaatgcaagttaaaattgaatttttacaagttgcaaaaaaaatacaactagtaaacgtatattgacagttaaatatatatttttctgttacaatgtgtagaaattaaatttgaccttacatgtttgtgaagtaatctatcacatactaataatctatcttgttgaatttttttaattttttataaccatttaagagacatataaaacaacgatgagacgtcccttcagaggttttgaatactttcccccctcgacattatcaaagcgacacatatcaaacagccaatctctactagtatattacagtacgtctaatgagttcgagtcggtttttaatttcgttcacttttagaaatacatatgtttatttgattcggtttaatttgttcgcttttagaaatacagaagaagtcgtttaagaaatctctttataaaaaaaaactcgcatgctaacatgagacgatcggactcctaactgaagcttatgattttctaaaaatatatataacgaagtgaattcccacagtgaataataagattaaaatagccttcaccaattgcaacacacgaacatttttttcgaagtagtaaataaataaataaaaccacactcggtagatagagtttgacagtgaaacgggttgtttgataatctttcaaatgctcactcgtcggacaacttgatcttcttggtcgacggcgagtcgccctcgtcgtcgtcggtgtcgacgccgacatggcctctgcgcttcggctcccacgcggcgtcgagccgccgctcttccaggaatcgctccatgaaccccatgacatcctcgaactcccccgcgtcatccgacgccaggtcgaacaccttgctcgacagctccttcatctcctccaccctctccagctttgcttcgagattccgccggtgccgccgcggcatgaagcagtccgccatccgcgacacgccgcggtgggtgatcacgcggaggatgtggcggcacgggaggcgatcgctctccatcttccggcagctgcacgtcacggccatcttcccgtcgtccatgtcgtcggtgccgagcgcgccgccgcggtcgcaccattgcaccacgaagggttcgccggcggcggcttcctgcttgggcgcgagcaggtagatctttacgtcggggctggacatggtgggcagcgtgtcgacgacgacgaagccgtccatcttctcgatctcctcgcggacgaggtggaagttggccggggtgaagcgccgcgcggcgtgcgcctcgaggaactggtgattggtggtcagcggcagccgggacatggaggccgcgtcgtcggcgcgcaggcgccaggtccagtagtcggcgtggcgcaccaggtcgtgcagcgacatgtcgtcggcgaggcccgtgtggaggcccgtggcgagttactccgtccgctggtcgctcgccatgccgaggaagagcttgtggcgggtgaacgcggcggcccagagctccctcgtcgcgtgcatcgtctccagccagccctcgttctcggctgtccggtgtccgccatgaacacgctccaccgctgtcgaacgccgcgggcgagcacgcgtcgcgcgccagcgacaagaagtcgtcccgcgccgggccatcgacgaggtgctccccggcccaccgctccacgtgccacgctcacacgcggtggttggactccgggcacacggccttgatgtcggcgacctccgcgtcgccgccgtcggtgatgacggacttgggcacatccccctggatcgactcctgaacgcgcgcagcagccagacgcacgagtcgacggagccgtccgcgacgacgccgcagccgaacacggcggggcggcggtggcggctcatcccgaggaacgggacgaacgccgcgccgcacctgttcgtccggaacgtggtgtcgaagacgacgacctcgccgtagtagacgtagtcccagcccagcccggagctcgcccagaagatcccctccatccggccatcggcggcggcgaccttgtggtcgtagaatccctcggggtcgtccttgtctttctcgcgcagcgccgcgagaatctcgtgggtttcctcgctctccatcagcggcatctcatggagcatgcgccaccacaggttagtcgagtgaattgaggcatgacatgagatggatcggggataaggagaccgcaacctctcgatggtcgacgacggcgtggaggtggaagaaggcgacgacgccatgggcggcggcgacgggaggaggaagagatggagacgaagcggtttaacggggatatataacggaatatcgagggtattcgaaacgacaagtctaaaatcatgggagtagttaacacttaacatatggagtggtactcaccatttcccattgcatatgtgttcctttccaaggagaaaaccatcccatttttagcggcacgcttgctaggattttcggagcaacattctagataggaatttctttaaaaatttgttttaaatccgcttttggagtagtagccattcattagtattcactctattccaaaatataaggcacaaacactcttaacacaaagaccaagaaataattattataatctttttcaaaatataaggcacaaccactcttaacacaaagaccaagaaataattattataatcttgtagattgaatcatcctaataaatataatgtatgcatccaatagagttagcgaatgtgggagtgaaggatttaaaaaagtagtaatataatgaagaatgtcatacttaatggcatgcatgcattcataccttatactccctccgtccaaaaaaaaggcaaaccctgagtttccttgtccaactttgactgttcgtcttatatgaaatttttttataattcgtattttcattgttgttagatgataaaatatgattaatattttatgcgtgacttgtctttttaatttttttcatatttttttcaaataagacggacggtcaaacattggacacggaaaccagagtttatctttttttgggacggagagagtattatggaacattaaaaaaaagtgtttgtgccttatattatagaatggagggagtatttacctctgcttttggagtatcgcgaaatcagtcagcgactctcaccattcagcatgacacaaacatggtacaacgctttattatatgacaggtataccagagtctcagaacaatacttgcagccaaaatgtttgcattgctcaattatttttatgacagatttctgtaagttcaagcgacagaaaacgagcgctgaaatatatttagagccggttgtacagtccaagcaattccttcagcttcgccgcttcagggctgaggctgtcgaagctgacagagctcggcatcctccatctccagttccctttctgtggatgtaaaaaaaaatgatgtttttagaattactgctttagcagtatatgtgaattatacaaggtgattggatgcagctgttaacctgtgtagctggagtattcattctagcagaactgtcgaggccaagaatgtcctgcatggttaccatggatgtccttgcaactgaagagagggcagcagtgatcagtgcccatgagatttcagtcctattagcctcaggcagatacttgaacacctgaaacaagaaggcgtgaatatgacaatatggttgaaggtagtgtaatatgcctatttaagaaagttgggagacactaacagtctgcttctcttcctctggtaaagtttgccaccaaccaataacctgaggaatacatggttgaagagcgtcagcattctttgtatgcttgtgtcgctagcagcccttgacaagatattgaaaatagacagctttggaataatttagaaactaaccgtgtcattgtcgtgtgttccggtgtatactacttgatcaaattcatggttatggggcaagtgtggattgtcagaaccaccgccaaaagctgaccacataaaagtgggagtacgaacatttagacatcgaatctatatattcaagtatgctcacaatgccttctcaaaagagaatatacacataatctggctttggaacattaccaaactgaagaactgccattccaggagcctcaatagacttccttaggtcaacaacatcttctgttatcaccccctacaaatagtatgagatgatcagataaagcataagcatgtcagaattaaatgtttcaagttttgagtagaaccattctcgactatattaacccgtgattattatgaggaattctcagttaaatcacatttttgacaatctacagctaatgctgagtagcttatgaatgtctggttgcagataaaacttgtgtagctgactcaaataagacttgtcttatggagaaattatgtgaatttctacttccatattggtccacaaaagaaaaaccaatcatggttttattagataaatgtaaaaaaaaaagaatgcttaccaggtcttctgctattatgtttattctaccgacagctttgaataatgcatcaaaaaatgcattcctcggtccagcctactgccaaagaaaaacagaaaagcgtacatcagcaacaaatatttctgaaaaaaataagggggatagcatgtacatcaagtcaatgctcaccctccagcttccaaccagcgctacttttgactctacatgcaccggtaacaaattagaaatttgaatctatttacccaaaaatatgtactcctattatgtagacaggctagctggatgtatttggtttaccagaaggaactgcccaaaaacctgcaagcccccggaaatggtctatacggaactcatcatacaaatcaagggcacgattaatcctttttatccaccattcaaatccacctgcttccatagctttccagtcgtacaatggactgtaaagttgcaagtttcacaaaggaaatgctgttaattgtattcaacttttttcctgatcacattgacagggagcaaaggattacctgttccaaagctgaccagtttcactaaatgcatcaggtggaacaccactaacaaaagtcggaaaaccattcttgtcctttacaccagaaaaaacaatcaagaaacagaatgtatagcattttaagaatccgatgacacatgactatgagggaaaattattgaggtgta

SEQ ID NO: 40272 - DNA, 27459 bp, Oryza sativa
agtacagaggacggaactcttgttttagctgatgcatctggtatccaggcttcaacggaacaaaatgttgatgaaggtccttctgaggttgctgcaaagaatgaaggccttgtctctgttacagaagctagtaaagatagtgcaattgctactacagaagttagtcaggaagcagttgttgccgctgcagaggttagtccggaggctctagttgctgttacagaggtcagtgaggcccctctagttgatgtggccggaactaatgaaaattctctaggtgatgcagaagcaactaaagaaggtgatccagaatctgttccaagtgacagtaatgtggtgaaggaagtatgttcacatgctgaaattcattgtgaggtcattgcagagaagactccagacaatggcagcagcaagaaaatgactgttgatgacatatcatctgatgataccagtactaataccaagttggaggaatcatctgctaaaggtgaaccatgtgtcagtataggctgtgagattctagaacaggaaacgaaatcatcacatcttgatgttattttgtcacatgctgacgctgttgcaagtgcagaggaaatgattacagagagcctgattcttaagaaagattccaatgagaatgatttaatgtatgagaaggaccaaaaggattctgaccacataagcactgactgcaaacccgagcagtctggaccaaaggatcaggtatctgaagtcaaccaagatctagagtctcaaattaagtgtgtgtcaatttctcctgatgatatactagtcaataaaaacgacaatgtagaaggcaacatgaacgctgacaattttgatttaggactagagtctaagcaggatattgtcaagccatcatccagcaatccctcctccgttggtgatgatttgcagacaccagatgatgacaaagagatatctctgatcgacatgtctctgcaagatactgatatgagcttgaaaaagaaagaaggcagtcctgatagtatttatcctgaaaaactaaatttggataggagttcaggagatgaatcaatggaggaggatgcgatggaaactaagcacatggattccaaaacaatacctgattatctcgaaggaaagagtgaggtcaccttagagcatgtgagttcaggagatgaatcaatggaggaggatgtgatggaaactaagcacgtggattccaatacaaaagttgaacatgtgagttcaggagatgaatcaatggaggaggatgtgatggaaactaagcacgtggattccaatacaaaacctgattatctcgaaggaaagaatgatgtcaccttagagcatgtggtaaaagaggtgatcctccttgatactgtcactgagggttcatctgtagatcaaaaggaagctataagtcaagagaagccagtaatgccgactgaaaagaggaaagctgaaggtctgtcttcatccccttacagtgttcagtcatttttgcagtgttatgatgacacctttctgcttttgtttcatttgtttttttctatgctttgatgcacattatctgagatctgtaagtgtccggagtgaagtgcattatatctactgtttgatactagtatgttctatggaacaattgtaccctttttatgctcttttacattttctgtgtatacacttttttaaaattacttaagtaagatttctcatcataatttcacatgcttcagtcctcaagttgataataattgatataaggttgaaatggtctctattttttgttttaactcactgttgaatgcacagatcaagaagttgttgcaaataatgagccaatcaaacgtcagcgcctatggaatgtggatgatgtcaaacctgagcaagcaacttccaaactaagtggttctgatgcttctaaagttgtacacccgcctgctcgaagacgttcttttggcaggtctgattcaacagcacgtggaaattctccgaaggagaggatgggtgaggtttctcttcctttttagtaaagtatatacttcaccattgttaccaaattcatctcttgcctattcatatttcagtaccaccgcctcagaaacctgcaacaacttccttgagaatcgatcgatttgtgcgcccgttcactttgaaagctgtgcaagagcttcttggtaaaactggatctgtttgtagcttttggatggatcctatcaagactcattgctatgtcacagtatgtccttaacttgcaaatatattatgttacatctgcagaatattatcaaaagtgcattcatgcttataaattactatggcatttccacactgcattctttttcagtatattacttcaggcttcaaagcatttcatcatattgctgtctgtactctttgtaatttgcaacggtataattgtattgatttgtcttcttgtccacactgattttcagttctcttcggtggaggaagctctggctaccaggaatgctgtttacaatctccaatggcctccaaacaatggcagttccttagttgctgaattcgttgatccacatgaggtgaaggccaaacttgaaccccctcccccacctccagcacctatcaaccccacagcagctacagcaccttcccaccaatccaaggccaaccaaatcatgcctcctcatgctgctgatacatcaagggggctattacccacaccaccagcacttgctaggcttccaaccttcaacaacgcaccagcgagggagatgcttccgcccgctccaaagaacccagaaccacctgtggtggtgactcttgatgatctctttaggaagacacaggcctctccgaggatctactacatgcctgtttcagaagaggtggtatctgccaagcttgcagcacgcggcaaagggaagaaggcagcgtagggtggctcaaatttgctgctgctgctgctgccatgagtggtacaatttgacacttgaagaggcttttgcaagggttaggtcttgagagccgagaaggtcattttggttgtacatacaactaggtgtagttttctgcatctccgaaactgttagctgttgctcgcccatgccgatctggattgtatgttaattgtgcaccttttgatcgatggagacgatgcttaccttcaatgttgatgaactgggggaatgcatatgtgctaagtcgcagcatttcccccctaaactcgtcgcgcaaactattggttccgtttgtgaacctggcaatgttttgtaatccgttcttctgaactgggtggatggctgcatgctgcttcatcacaaaagaagataaaaactaggtggttctatttgtgttttgttctaataaatcacggcgtgattttgaatgaaaatgcacacaaaaactgtaaaaatgagcctctaaatttgttctcgcaaaaactaaagtaaaaaacatctgcataaattctttgcaagtttgcaaggcttaagataggcttcacaaagaactcgtccatgggccacggcccatgtacttttaccggtttatcggcccaattcgaaccgtaaagaggaacgggtctccgactcctcgtagttttctctctcttttttcctaactcgagtctttttcttctctctacgccagaattatctttctcatctcctccctcacgcaagcgactttgcagtaacaaaccaaccaaccctcctcgccgcggccgccgccaccgcgaagtcggcgacccgtattacgctgccggcagcggaagccctccctaacccctcccctctcctcctgccccgtcgaattgggcgcggggcctcgagatgatggcgtcccggcggggcagcggcggcaacaccagcagctgctgcgcgctctgcgagggatccaacctcccgtcctgctgctcggcctgcgtgaactccaagtaggatgttctacttgtgcccccctgattcgatcagaggttgattgatggcctccgtgtttggattgatcctaactctgtatggtgctgttggattttggggtttgtgcaggctggcggaataccacgcgaagctgcggatgatgaagaatctccgcgactccctcaacgcccgtatagccacgcgcctcgatgccaaggttggtggtgccctgaattctcccccattcccccgagactgtaacaaattaggtctcgtttggtggttagtttccacgtatgatgcctcagtttggactctatgagactatgacctgggtttagttataagttctgcatgtgtaaaatatcttgttgggtcgagaggcgtagtgtgtatctgaaactaggatggcaatggttgtatcgattgtgtctgaatagctgtatgctgtaaagttttggtgtttggttagaccattatcctgaaagactgcatctttgacttgtttatagaggaaaggggacgagcagagaaactggagggtgagcaaggcacacgatatcaaggagctgagggatcatctcgctgaactgaaaaggcgaaatgcgataggttaacaccgtgtactcatcatatgtgttaagatgccaataagtgatactgagttctgattattgaattgatgttcttgcagagaagaagaaagctgagcaggcatcacgtgatctcagagagagaacggcattgttgaatttggcttttgtcacggtatgaggctgtctttcttagtgtttccctttgattaaaaaataaaaccctgacaggttacttatctttcatatatcttgtttctcattgccagctgaaaaagaagcgaaatgattcatcggtgatgcacaccaatgccatgaaagcagcacagatgggtcttgtgagtcatatttgcttctgcttctttacttgtttgattggtgtagtaagacctcatttgttatccattatctatctggcctattttccctgttactgaaggactttatattttgttggcagatggcaactacctcagagcatttaaaaatgcagtcaaaagctatgaagcaactttgcagattgttcccattgcgacgagtaagttttatattgtttttaacagcatgtagcttctactgaaatttacattttccactgtctaaattcacatgtttgtggtattatgctgttatttgccctcttcgtcatgttcaattattaaattttgttacctaaaaaaaatccttttgataatattgtttaaatattctctggagttccattaataaggatttgtatgtattcatttcaatctgtaggttattaaggatggcgaacagaatgatggctacaatggtccatatgatgtaatatgcaacgctcgtctacctcgtggtctcgacccacattcagttccatccgaagaattatcagcttctttggggtacagctgcgcataataataatatattgaaatatactagtatgtgtatttggttctcaattctgtggaacttaacatttatttctttttgttccaggtacatgttacagctcctcagtattgtagttcctatcctagccgcacctgtcctccacatatctggctttggggtaagatgaaattcagtgtcatgactatcaacccttggctttagcatgctacattgggagattcagtatatttgtcctgtagctgtagatgtggatgcatttacaatctgtctgagactagttaggatcatggcatttttatgcaaattcatgcaaatatattctgcatgcgatgcttgtttagatttttatatgcatatgctctcaatcgattattcagttggttgtatggctgatatattcaatttctttataatgtattattaggcttcgtgttcacgtgtatggcagcgtagttcctactggagcacacgacagtcccaaaggtagtatatatgggaaagtgcagcacatctctttctctgcaacacacaaacattctgatgtgataatgttttcttcttttcagcaaagtctacccactttttatacctaggaaaaataattgctctgttggtgaggataattcatggacggaaagtggttcgggtaactttggtgttcaatctgttgattcagacaacaaatcggttcttgactccaagagaagcaatagctttaacttctctattgcatcttctcactccatggagaggcaccaagatttgcaaagaggaatatcattactaaagacaagtgttactgccattactacctattactataactcattgggtatggatgtgccatccaatctttctacttttgaagcatttgcaaagttgctccatatgctatcatcattaaaggtccttcgcacaactcttcaatcgaacgttgcttcaaggtataattaacatgttattggattacaatgcataaatgtatctatgattgcatattcttggttatcaaaaataaaacagaagttcaattctctgttctgcatgcaggtcagagaagcaaggacagcaactaaatagatctatatggaaagcgagctccgctatctcatctaacagcagcctgatggacagtgtgaacacagctataatggtaatctactagtagcctttctttttgctttttatacattgtgtatactttcaatgtggttacatcacaactgataggatctctgctttaatcagcctagttctctggacaacctcctgctgaactcaacacgagcttcctgtatagcggtaaaccgacgaagcatggtggagttccagacaacattttagaaggctgggatatggtagagcgcgacgtcctaccaccaccaccgtcgcgggttgaagacgttgcgcaatgggaaagagcccacaccttcaatcgcactggctccaaaaagaagtgatggttaggcgctcatgtattctctgaagccaggctgttaatttaggacactgcaagcctctgcataggctttcagctgatcataaggtttttggttgatgtacagaactgaccataacctgtgacaatgaatatgcagagaagagggtgtaattgatcagctggcatctgtaaagcaccttcaatttgtaaatatacatgtaattgtacagtacttcctatccaataaaaaaatatagttgaaatgtgcctgctcattcatatgctcattctccacacctgcaactacaaaatgagcaaaatgaagaacatcatacttgtacttggcttgaaaaatttgctgtatgtgtgttcttttgcagcaagagtgaaatacacgctgtaatcagaaaggaaatggtataaatcgcacctacattttttttaatttgaattttagagaagagaagtgatccacgtgtcaccatcgcgaggcgttccctccatttcaccacaaaaaggaaaaaaaaaagacggaaaaactgcgcctccaagctccgacctctctcccctcctccgcgccctaaccctaggccctccgcgtcgccggcgatgagcggcctccgagccatctccaccctactccacacctgcgccgccgccgccgcgggaggctccagtcggcgggtcgctctcgcgccgccgctcggtcggagcttccgcgtcccgtggagggcgccctccgcgttcgtcttcgacgaggtcgcgagggccgcggggggcgagcggaggagggtgtctacgcgcgcagcgagctgggattcggagaaatcaccgtacgagacgctcggtatgatgacactattgcccccccctgctggtgagagctagtggatatgcagttggaatcaggattggtacctggggattttgttgtgtggaagtgtggaacattatcgattttgttatcactgccttcgatacgatggagcttcaatggtgatcagtattggggattggttgccagaatctgatcgtttgatctagctgtttgatgccaaaattgtggattggttgctagtttcttatcgtttcagtgtgccctagtttattttagtttgatatgtactgtgtagtgtggacatggaattagccgtgaaacttatgggtgcgtctttttggtgcggtgtatggttcgaagagctggacagggatgcagatgaggagacaataaagacggcatacaggcgattggccaagttctatcaccctgatggtatgctctttacagttatttctacttttcctatcaagcaatcttctgttcctgtttattgctatcttgccaagttttggttgtaagcctgtaaaaaatccgatctcttgcctggcatactttgcgcagcataaagctatttctgcatgtgtaagtgtgcatatatctagcatgagattttagtggaatggacaattatacaaaattatggtagtgtagagttgcagaatatgtactctaacattatgattcatccattcataagcatcaaaattaagtggtcctcttcaagcctattaaaaagccaaaagggaatatgcaccgataaataaattcaagactaaccaaagtatgtctagcaaagcctggcaaaaaaaaatatgtctagcaaagagaagtgataggttggtagtttacctgctgataaataagtgaagtgtgcaataaactggtgcatggcaatacaggagggcactttttagttgattagtgctatttggtattcatggccaattaatgttatttggtatgcatggcccaatagtttttttttttctgttcattccatctgattattttgtcctcttagtttatgatggtaagggaacccttgaggaaggggaaactgccgaagcccgcttcatcaaaatccaagcagcatatgagctactgattgatgaccaaaggagaaagtcatatgacagagagcatcatgtgaatccaatgaaggtctgggtttctttggccacttattgattattgtgtcaaatttctatatcattttgataatttgaaattgcgagtgttgaaatgtattgcagagaaattttagtcaatagaggcttttctgttctgaaagcttctttttgtccattcgtcaggcttctcaggcatggatggagtgggtgatgaaaaagcgaaaagcttttgatcaacgtggtgacatggcagtagctgcttgggctgagcaacagcatcgggaaatgacattacgtgctcgccgtctctcacgatcaaaggtaatattagaacatttctttgtcattgttatcttcatgctttttatatctaggtctgattttataagcactggatccagattgatcctgaggaggagaggaaactgtttgccaaggaaaagaaggcatccatggaattctacagcaccactctaaagaggcatacccttgtcctgcggaagagggatattatgcgcaaaaggcagaggaagacaagaagaaagagatcagtagacttctagctcttgaggggcttgagctagatacagatgaagacgacaacataaatttcctaaagtaactacgcaaatgttctttcacaaattccatccacctctcccagcatatactagaaggtttcgccaaagttccatttagtgaatatatattgacgcaagaaaaaatgagctcaagggaaacattggatcataactgttggaaatccagaattctcccatggagcagaaagatgtggccaacggcgaaatccatctgggccaactgctgcaacctgcagcccagtgattcaatcaaagttctttatgcagatcctctattcattgtttccagcagatggactgtattgcaagggatatgactatcagatatgtatacttgttacatgcgaaattgtaattatgctagggtaattttgtaaccttcttgtttgtccgagcaaaacaaagtgcattctctgtgtggtgcctctagctctgacactttgtaaatactacagaaaacatccaaagctattgtttactgggcatgaataatgttgtttcaaatcatccatactcccttcgtactcgtaaagaaagtcgtttaggacaatgtttaagtcaaaccttaggaatataaatcatgaatgactctcaagttgttgagtttgaaaatgtaaaatttatatgaatagatttgtcttgaaaaaatacttttataaaagtatacatatatcacttttcaataaatatttttatagaaacaagaagtcaaagttgtgtttttggagaccgtgtcgctgtccaaaacgattttcttccaaacctctgaaaatcccacatgcagaagatggaaaatatgatgatgatggcatggttctaattttataaaatttaaatgacatcgttacaaatatacgaattataatggtatatctgaataagtatatttgcaatggcacatatcaaattaacccaaatttgtttcactggcctttgctggtagagcctccagcttcagcatcgcagtcatggcgtttgcagtagcttacgaattcgtaaattgccaatgaaaaatccaagtttcctctacctgactacctctcgacggcgtaacaaatcttgaggagaagcctgctattttgtacaaatggggggttttatatgcaaaagctccatccatcggccaatctgggacgctgaggtccgatccaacggtcatgaatggcccagtgctggaccgcgccatctcactgacatctggggtcaggcagtcaacggcgccacgtgacgtcactcgccctccccgtcgccggggatagacggttcggcgccgcaccatcatctccggcgagcttggcctcctcgagctcgtgagcgcaggcaagcctccacgatcgcagcaactagtgccacttccctatcccagctgttgttggaatatgaagtaaattgcttctcttttcttattagttactccctccgtttaaaaaaacttaacctaatattgatgagacataatttagtataacgaatttgaataggagtgaccagattcgaaatacgattatgtccaattccatactaggttatgtttttttttttttggattaacctctcacactggccattcatggctggtccaattaccagcctcgtcatgacgtcatccggccgccatggcggcgtggggcagctttcatcaaggcaacgacgccattgggctcactcctggagaattaaatcgatttaattcttcatttctcagctccgacacaatttcaattagccaaagctacgccatcagattggcaatctatttacagcggattcagcagcgtggtcggatgaatgctgaagaaaaatccagcttcagaacctgctcttggatgcgcagaatggtacattggagaagctgatctgtttttcttttaactgtttgcattcattcatggaggccagtatcactgatgctgacgacgatggctgcctcgccattcatttcgtctcgctgcgacgaaccagggacacattcagaacagcttgcttagccatcaagagctagtagcccctagtctactactagtccattggctgggacctactatgagatcttggaacttctgcaaacactaaccaggcaaccagcatgagaagatttggattcagggtgtgtttagttccacgctaaaattgaaggtttgaagaaattggaacgatgtgatggaaaagttaaaagtttatgtgtgtaggaaagttcgatgtgacggaaaagttagaagtttgaagaaaaaagttggaatgtaaacagggcctcagtttggactaggcctcctttggattggaggatgttcaaatccttaggatagcgccctttggattgaaggaatgcaattttgaaactcttatcctgaattcctttgagaagtcaaatgcactctctacattctctcttaacctgacaaacttcctccaaaactcatactacgttttatttcttatgaaccatccatgggcattatttcttatattcattcatctgttttgaaatcctatttaaattgatgcgattttcatgttcccacgtcttgagcgctttcaaaagaaaaaaaataaaaggtttggtttagcgaaattcggaatggtgagatgatgggtggtgactacggacaggagaagctgtacactcatgtgatgacagatgtgtcgatacagaaaactgcttcagacaaggaccacagtgagtgagtgaggcgaaaaaatcataatggctccatgacccatatgttctctgctcctgcaaccaaacgactgcccccagatgcttgtctggtaaccaaacctgggaccctcaccaacgtgctcacatctctccctgccaggtgggcccgacccggcctgggcccagccgccagtcgcagcgagccgttgccgcgatcgccgccgtccacctggctcggcatctgatacaatgccaatcaacggccaagatgggggggtggaggaagcagcttgaggttgggggatcatggccaatgcctgtctctccacagcaaacattgaaggctacagcaaaatggaccggctcaatgaacgcctcctcctgggggtgttcattcattcaataaatcctgagccatgctgcaatgcaaagcagctgctccagaagatcagaaactgcatgtgccctgttgtaaaagccagcaatggccaggccaaatcggagtaacttcagaattgcatgttacagctacagtatttttccaaatttcgacaaggaagcacagctgagaacagttcagaacagggaaatttttgatgagttggaacctcttgaactcatgaagaaagatggcaatggtatcaatcaatcaatgggatggatgggatcaaatcctctttacactactcgagttaccaaccaaacaaaccctggctacaaggctctggaaaacccacagaaaaaattgggatgaacgaaaaatcggttacatgtacacgggaaattaaaacgaaactcacacggttatggaacacagatcgtcacagaccgtcttcatgttaggcctctcatttacaggaagaatacacctaagagagatcgcaagcagctcgtccatcacccttggagattcttccaagcccgtgatgtctcgatcgaaacaatcagttccccgtccttccctgttgcacatttgaacccagtcggtcagatcaacggccccagattgacccgaaattatgtccccggcactcttccgcgtcaacatctccataacaatcaccccaaacgcgtaaacgtcagctttaaatgatggcattggcttggctgtgtttgccagttctggggctctgtaccccaatgcccctaagttaagtatttgctcagcagtgccacttggagtcatgaaccgatgcaggccataatcgactagcttcggggagagatcaggacccgtcaagaatatattggttggctttaggttgccatgaggcagacccttctcatggtgcaagaactggaggcagcgtgccaggtcgatggcaattttgagccgttgagaaactgacaagcgggagtatcttcttggagttgactctgcagcacatgcgaggagatcaaaatttcagcaatggaagaaacaaatgttgacatgaatgacccagcaaatatatggaacaaataagatagtaataatcaagcagacaatgtaaatataggtattccattgtaaattaggaatgcatgtcaaccaaacaaggaaaaaatccattgccgattcaagtgagcatgggatagttaccataaagataaagagccaagctgtcgccattgacgtagtcagaaataatgagtctttcttgctccttaggaccccagtagaaagctctccacgaaattatatttggatgcctgatggtcccaatcctctttatctccttagtgaagtcctttttatgctttacgaggccaacacgcagccacttcactgtcaggacatggccgctttgtagtgcagctttgtatgtcgtgccatgactgctccttccaagaacctctgctggtgctcgggacaggtcttcagctgtgaaaaccaaagtgctgtctaggaaaatcaattctccgaccaaccgatcgggtgagtacacttcaaatgccacaggttcctcatggaatctactatcaataaaatgtggtgatgttggtagcacaacccgtggagagggctccatagcagggactgcagcagaggtctcagccatacctgaactcgagggttcagtgacttcttttggatcagcatagccgtactcaacagcagcttcagctaatagctctttctgagcagacattgatctagctgcagctgttaagagatggtcatttgagaaacttgttttagttggtataacattatctttcggaggcttgaaaagatttggtcggcttaacctccccagttttagatctctaatagtaatctgacctctaaatccatttcttccgcaaagctcttgagacctgaccacatagattgccaatgctatgaagatcacaagcaatgcagctccaatgcagccaacaataagagcaactcgaacgccagccttatgtccatgagacgattgactctgagcgactccagtatcatcataatttccagcaggaaggccatctggaaaaactaataggtcatttccaggtctaaagcaggttatggggaatttttcaacacttttaggaacagttccttgtagatcattgtaggacacattgaatatcttcaaactagcctggggcatatcaggaattctgccagtaaagtgattatgtgatagatcaagatactccaatccttgaagtttgcttatctcacttggaatctccccagacaactcattcattgcgagagtaaggaactcaactctttgcaagttagaaatatctggtggcaacggaccggacaaagaattacttgacagatcaacgatcctgagaacaggctgaattagtgcaatcgactctgttgaatgtgtgctctgaaatggaatagtcccagtgaagttgtttccggaaagatttaacactgcaaagtgggcgacagaaagaagaaaggcaaaacaggtccgccaagagcatttagactgagatcgaggaattgtaacttctgataggttcccaacacggaaggaatagatcctgataacaaattgttccgcagcttcagggagactaagttctgaaactgtgaagcatcatttgggtagcttccctccagtttgtttgaactcaagtcaatcgtctccacggtaccatcccaagcacgcaatatagctagctccccagaaagctggttcccactcagatcaactgagctacacttgccaacagtggatggtaaggaacctgagaacgtatttgaagagagattcagcagcttcaaagtcgtcgagttcacaactggaaccgatcctgcaaaattacaagcgtgcacgaatcatttagagctgtagacaaatgaaaatgacatttatgaataactgtacaagaagagagtagacatagcaaggcagcaaactataaacagatacatatatttttcaatagtagatctcatgccatagcatattagcataggaatagtttgttacagtcttaattgaataatttctgtgtaaaagtcatgttagatggcaaggatccatcagcaagttctatggtagaagaaatatgtggcaacatgacagctggttcagaataaaaggtttatttgactgagtttatcaatgagcaccaaaaatgttaactacttaagactatgtttaggtctataaataaataactatcgtttatacaaactattacagaagcaacaaacatgaattacaaagaaagatgctaaaatcagttataagccaacaatgcagcttcaccacgagtcacaagagacaactatgcaagaagagtcaattgttccatatgctcatcaaatcctcaatgcaaatgaactcaaccagattcaagatgcattgaatatatttttgccaacgaagtctagaaatattcgtgtcgcaaatgttacgaatctcatttgattcgcaggttgtaatttaggcatcgccgctccacattatcgcccgtatccaagccgtcgcccatcgatcacaagaacaaaatcgaccacttcagcttacgctggggggttcctagtgacagatcaaggcatttttgacaaagatagcagaaccatttgactagcaaaaggaagatatatacctgagaagccattcctgctgagatcaacctcgacaagccgcatcgagttctgcagcatcgcctccggcatcacaccggaaagcgcattgccggcgaccctgaaaaccgccagagagaaccacgcgtcgatctgcggcaccatcccagcaatcccactgttgctcaaatcaagaacctccaggttcttgaaggcccccaccgtctcgttccggaagaacccgccctgcagcttgttgtggctgaggttgaggtacttgacggtgttcccgatgctggacaagctctcgagctccaaatcgacggcgccggtgaagaggttgtcgctgaggtcaatgtactcggcgttgcggagctcggcgagcagatcgccggcattgccccagaaggagttgctgcggaggtcgatgcggcggaggttctgcagctgccggatcccgtcggtggggaagcccgaggagaagttgttgtgggagaggttgaggtggacgaggccggagaggtcggcgaggcggccggggatggggccgtagaagcggttcccggagaggtcgaggtggcggagcgaggagaggtagccgatgccgggggggaggcggccggagaacgcgttcccggcgagggacaggttctggagcgcgcgcatgccggagagcgtcaccagcttgagctccccggcgaggccgagcccgtcgagcgcgacgccgaccaccgcgccgccgtcgcacacgacccctctccacccagacgggcacccgccgcctcccccgccggcgtcgggcgtcgccggcggcgaccaggatcccagcacggggtccctccccctgtccgaaatccccttcttgaactccagcagcgccgccacgtcgtcgcccgccgcgccgccgcctcccaacaccaccaaaaccaccagcacgaggagcgcggccatggatgcgggtgcgggggtggccacagctaggtttcggcgtgggagcaggtggtggcggcggcggcggcggctgccattggaggggggtgagaagcttagctgagagagagagaaggggaagagatgtgtgagagaaagaaatgcaaatttttggaaatgcgaggggtggagtgtaataatagcaagcaccagctggggaagagagagagagagagagagagagtagtgtatgccagtacagactggaaagttacaagtggttgtcttgtgctgtagaagttgtagattggtgtgctgttaagcttagcttaactgtggctctgtgactttggacgtgtttagatcgtagccaaaataaacattactaaattttgggggtgcgtttagtttctgaaaaaaagttgaaagtttgaagaaagttaaaagtttggaaaaaaagttggaagtttatatgtgtaggaaagttttagatgtgatgtgatatgatggaaagttggaagtttgggggtagttggtggtgaactaaacacggccttagtattaccaaaattttagtaatattatcaatttttggcaggatttcttatttatttatcagagtttggtaagaaactaaatggatgcacatatttttcaactttgccaaaaaaattgtatggtttgaaatgtcatcaatctgaagaagccctttatttacttccatgagtgttactgtgttactccatcgttccataaaaaaccaacctaatattagatgttacacatattagaactatgaatatggacatacctatgtacagatttattatactagaatgtgtcacgtataattttagattcgtttttttaaacagagggagttctgttttgtgtcattgtgtgagtacttgggttatggagcatattgtgtgacaatgtgagagtaaaaacaatgttgtctttagggtggttatacttatacctttttcatggtttcatgtacctggtcttggaagtttgcttttgtttattggttggtttgtgcttttgttatattgtagatatgttttgggaaaggttgtttgtgcaaaagaaaattatgtaactcttaccaaggctaacgtagcatgttgcgggtaaatctagatttcctgtaactcctagctagtaaaatcaaacagtcgagagttttgtatttaagagtttttgtaagttttccatagttgagtgtgagcaatttggtaagcgcaagaaatgaccgcttagaatgcaagttgaatctttcaccattgtagatctttttttccctttgtactgtagatgtgttctagtgtagtactagtagcgttttgttgctcatcctaaagtgctttataactatattctttaaaaaaaagaagaagaaaaaacatgttactcacgttattcctgaaaagacaaactcaatttaactacggaaatatttaatgtcaaaatatttattgttacagcaacttcttgacatctcaaggtcaaggaagagaattagggaacatgcaataaaaaataacaaaagctaccattcatttatacattagttagattattagagtgccacccattggggacaatcagtaattcaaaataaataaataaacctctcaaatgtgtgcagacactgggcactggtagaaaagcaagagcccccacatgacccaaggctgtttcaggctttgacccctttcctccagctcagttgagctgcctgccctcttgctttccattctttcctcccttttccttacctccaatgctctctttcttcatgccactcaacaacacattagactataattttttttagaaaaaaatccaaacagaactggaaaaaaatcgacagtttataaagtatacaatttttgtcatggacaagtgtcatgaggtgatattcttctagtttgtgcaaggttgatgtgatgtagtggtagtagtaaatggagtgtagtatttatttcagtagctcacagaggtttagagagacatgaagaccttagattcaggagcctgtcacatgtccaattatatatttctggtaccaggtagatcaggagaaaatttctacctctccagataatttcagtgcttcatattgacagtttacaagatattttatattgtgatcttcctctgttcatccaattattcgatttctgtcaaaattggcgttagtcctttcatgaatttggctgatccaggatctgtgcagtttttgcttctgaatcttgccaacatttcaacatgccatttctgaagtttaaggttaaggatgtgatgactgaaaggacggtaaaacagtcggtgcatagtggaattagaggatatatattcatatcctaatccagatgcttgctgttaggaggaaatataggctctgaaaatgacatggtgtagaggagtactaatcaatcggagagattgatgggctctggagtttggagtttcttgacatcaaaatccagagttgtctgtgatagagacggtagtgctaacaagaattaactagcaggataagttgaaaagtgtgtcatgtttggatgacacttaattaaggttgccatatttttagattaagaggggccaagcatgattggagttccataagtcaaatattcttccatttctttcctctcgtttggatgtgtatgagggtgacagtgtgtgtcctgactggtcctgagctggatgtaattcctgcacgaaatgcctaattggtgcaacaaacgggtttaaattacagtcaatatccagccatgtgttagaagcagatgttttctgattactttaattaaggccatgatcacactataaaccatatgcggaaactcgaaagattgtaattaagttctactagcaattagacagactattatatatgagtcgtatacaattttttttagataatgatatgaatcatatgtacaattacaatttatatatcttttatggataattgcaacagatgtccttttgcagtcgttatgaagtgattaggaagtttcttaacttgattaggtgcgggattatcagtactgcataatcatgccgtgtttgctctgaattgcggtttcttggggaaatgcaaatgctaatcagtaactggatcagaacatgctgcaggtactaatttattcagggaattaagtaatgtttcacaccgaagactcaaatagcaccgagtagattagttgaggctaccaaaccctgagctgtaaccgagtagaagaaccttgacgtcttaaaacacactaaaaaaaatagaagaagaagaagaagaaagtgtccatgtcgaatgctgtttttttttttctgaacctcccaacactctttcaacaaccaacctgaagaaattccaaaaggaatactggattttggatttttcatttacatgcttcataaactggtgcattttgtgtaaaaaaaattctatatgcttttttcgaaaaacttttctaaaccattttttcaactttatagtagttaatttatttattcatacccttaaatagctataaaaatcatattatccattaattcatcagtttaaactatctcaaacagggaaacaattttcagtggtacttttttttaaaaaatactacagtggtactggatgggagaattattgttgctgattgcaggaaaaggactgcaaagaaagatatgggcagtacaaaaggtgaggattaaccaggacactttcactgtaaaagagagtaaccaaaagactatcagtgtggcagttaaagctgctcagttggctagttgtcccggggctttgcttgaatttgaaaccatctgaagaaaaaaaatgttgccgctgctgctccatgagatgatgtttttttcatgcgtcttttgcagctaaacctgggacctgagctaggttaactccactgtcatgcatcatggattcacagtgcaatggtacacgtttgtagtactgattaagggtaaactaaagcaatcaatctggaggcttgagaaccaagcttaacctgaataatgattagtattggtaatcatacttaaactgaagaacatttttcagactggcacagtagtagtattggtaatactggtacggttttgccattgagcgatctttgttggtgggccccagtgactaacagtccgttctgtccgtgaaaggctgtatggacccgtgctgtcagaaggataagggttagattgactggactggctaaagactcgtctttcagaaagtcttctatgcacatatacagagacaaacagatctctaaacaaaacaagaggctggcagacagacagagtgagtaagtggatgattttaatctaagtaaaagtggttagtagcattattagttaaagaaagcatggaggagcatcaccagcaggacacaatagaatatgtggaagtgagcaaaggcgaggacgaagtacgaagaccaccgccctagagctcatgctcaccgaactgtttccgagctaaaaaccggtgataattggttttttaattcggttttcatggaaaccgttgaatcccgataaaatccgatcaaattttgttgaacttgaaaataaaccgagtggaaaatccggttttcgcgaacatcgatcggttttcgtcggttttgtgaatctggccacctgggaaatgcaatgtgcatgcaccaggcaggtagcgtgctgggtggtgttgtgttccatgcttccattacatggcgccatatgctttacaggagtaatcctcgcggattacagcgcatgcgatgcatcttcttgtcgttccatccatcgtcgccgcgacgccgcccgtcacatccccaccaccatcaccaccaccactagtcgctctagtgctaattaattctgattaagctggtgtaattgatagtgtcatgaatataatctggtcgaagttgagtagtaggcgaaatgtgatgttttttttagataatgaggcgaaatgtgatgtgtatcccctcacgtgtttagaacagggtcatatctgctggtcaaagatctagcgccctcacagttcaccggttacggctgattggcggatttcagattgtgatagatgatggtagatcagaacatgagaatcagcaagtagtgcttggcgaaaattcttcagccatgatagaggacttaactgaactaactgaaatcgaattgcacggtcataatcatgatgtgtagggatagttaatcaggcggaccaaaccaaactgaactgaagattagagaggacataattacgaaaataggcaattgcacgagcgacagggaggagcgagagcagaggtcgacgatggggtggaagaagaaagaagaagaagccgtgcatgtcaacatgcgtacatgcaggcatgtctgctacgacaagtctacaatactgtactacgtactacttctgaaaaaaaaaattataacatatgctctttcttttcttatgaagatatagattttatctcggtttttgttagcacgttttctaaattactaaacagtaatgttccgcgtaaaaaactttttatatgaaagttgctttaaaaatatcaaatatatccatttgttaagtttgtaataactagaaaaaatacacgtgcgtcgcaacgggtgatactattttaatattattattattatacggttcagttaggatgaaattcactgtgagaattcgcttggatatatttttagaaaatcatgagctgtaattagaagtctgactttcatattaagttagcaagttttaaaaaagaaaattcttatacgacttcttttgtatccaaaagcaaatgaacttaaaatccgattcaaacacggatatgtatttcaaaaaacaaatttaaaaaccgactcaaatacgaataacatatcaaaataccaacgaaaacattttcaatttttataatagcagagattaaaacttaattaatcatattctaatagcttttttgttttacgtgtgctaactttaattttatgcattaacttaacttaaaatatgagaatatatttttatctaaacaataaatttttttatattttgggacgaggtcggtatatcaatcctgagcgtgtccatgtgcgaccaggatgccatttaagacaacgaactgtaggaaggacacatatatatacggccccgcgcgccgtcgggggggccccttgtttgatcgatctttcatttcggtgtgtccatgcatgcatgatgcgtccacgcatgtgtccatgtgatcgccgaagcaaaaacagagtggaccatctcccttgtctcctcccgctgctactgctcgtgcaagtgatcgagcttccgtccatgtatacgtgcgaggtgatggtcgagattatccggtataagagacagggcaatagtacagatacctgttaagctgtaaaatcttccatcttagaccgagtttagttataaactttttctttaaacttctaacttttccattacacttctaacttttccgtcatatcgtttcaattttaactaaacttttaattttggtgtgaactaaatacacccttagtaaaatagaagataatatgtacgatagtgagctgtaagtagttcaatgtattgtcctctagcgcatatatatactatttattcgtttaatctaacaagtacctagtgtgtcgtcactgtaaactctctagagtgagcagcgtcgcatggaagcatatgaggtcgtgttgcagccggcgcttttatctctctttaccatcgtttttctttcagctcagctcatatctgacgtatttggtgttggagccggttaagttaacctactctatttgttctatactgtggtaaagttatacgtttatatccatatccatcgtctagaacaagtatgaaatattctctctataaaaaaagttaaataggaatgtggcataacctagtataacgaaacatttaaaaagacctaatctagcgaatttaggtttcgttgtacagtactaagtattaagtcgtatcacatcttcatttgtattgaacttttttataacaaataaagtactaatgaaatactacatctatcccaaatagagacgagaaaggagaaaggagtaagcaaagtaagcccttgtttagttccaaacttgtttctttaaacttttaactttttcatcatatcaaaacttttatatacacaaactttcaatttttcaatacatcgatacaattttaaccaaaattttaattttagcgtgaaaacatacctaaaataaaatcatggcgccgccgtggcgtgggggcgcgtggcggtggcgtgcgtgccaccggacaaccggagagcggagaccaattgcagttagcgtaggcaacatcacctgtgtgcacgatgattagctagggccggccgggctgtgtgtgggctgtggctggcacggtgggaaaagaaaagcggcgtgacggaggagagcatcggaattcgcgtaaagcgagaggggcacgccgtggcgtggcgtggcgtggagccgtggaagtgtggagcaccggcaccaatcatgcgccgcctcggtgtccgcgtacggcgcgccatccgccccccacccccaatgcttgttgcttcccctcccaaaccaccccttttttcttttcttttcgccctttttgttgggaaacaaacagtaacacgcgtccgtgtcgcatcgcagctcgatcggattccgttgaattctaccaatttctgtcatattgtttcgcaccgcacccccatttcgacatgttctcccagcaagcgtccctgcctggttgtttaattaacgtcaattccattccccctcatatgagtacgtacgtactcatggcaacagataccgactctcggtatggagcaaaagcacgcaagcaaagccatacagtagcagcatcccagcggcgtttgcttctgtacgccccatcatccgctgggaccggaccgggacggccatgccatgctgcaggagcaggaaggagaggcaactctgatcgtgattgcagatgcaggagatagcaggagtagtagatctcacacatctcatatcaaatgtgagtctcgtctcttgcaatcctaatccccagccgcatcatgtgtcgccttcctccccgtccccttgctatttgccactaccaccactaaccacagtttgtctccccccctcgcacttgaacgtgcctcccctgccccacccatatgggcgtacaggtgtacccagtgcaagcaaagcaatgctgctgctactgccaaatgtacaactacgtactactagtacagacaggctctcccttcgaagggagtgaagagtgcccgagtggctgccctggaatctggataggatctgcttgcctccggtgagagagatgagagatcagatcagcacacacattcacagctgaatgaataatgagacgaggaagacgagtcccggttttgctgctggtttcgttgtcttcctcttcgtgtaaatcggagtggaaaagaggcaacaatagatgttcagatatatacatgtgtccaggagcaaaatgtagggaagcgagagctattgtttctttcatggattactgcaacacaaataacaatgtcgatgtttacaacactacagttacggtacacaagtgagggagaaagagagggggagatcctaagtgggaaatgtacaggattgagctggtcagattttctttttatctaattcgttttgcacgagagcttagcttagccttgttccttgtagggtgtccagatcagcttgctaacgtcgacctcgaggccaccccggccggcggccttgaggtggcggtcgagaaccttggggtcagcgcagatgacgtgctgacctttccggtactggatcaggtccagactctgaagcgtgctcaagatgtcgtccgcttttattgccgtcatatcgctaagctcctgcattcaagcgcgacaacctgttaggaacagtttagggctgcgtaattggataatgcaaatcgaagctaattgatgatagaaaatgatggatctgtggtggagttatgggctatggattcagctacagaggaactcaatgtgtgtgtttcttcatgatttgaaaaaaaaaattagtatggaaagtaaaattatacagtagttagtacaacacagcctattgacttttcctacagatctgtttgcaccagtgactgtactagtgcatcagggagcaaggatgcaggaacaattatctttcagaatccaattgttcttgtgtgtcgtcaaaaggtttgatttgcatacatccaaaagttttagagggccggggcaagatgaacaggaaggcacaggctgacaagccagagaacacatggatatatgtccttccgtagaggaagtttctgcagattacactagttgcatgtgatcctgtctacatatatttgagttcaaaagaaaaggatatacacctcttcttcagaatggtttaaggatataatgcagcttggagaatctaattgttgatttattctttcatgcaatctttaagagctagaacaatggttctaatgccagaagtaagttgagtgaagatttttattagttattatagctgtccatgaaactgcagtgggctatatctacatgaatgattatttagatgtggacaaatattgactgatgacacatgaatttcagcttggtttgttggatttaatattttattgtaatttgtaagaagtaaactgggtgtaagaatctacagcctcccttcagactactgaactgcacatatctactgtatccatgaaaagtagcacattagatttgagttggtaatcaagatctcatggatatccacaaacatccaaactgtgaagtgtagcatcaaatggtctgtttcacataatccaaaagttttcaggccccagggcaaacgaacaggaagatgtaaggtgaaaagcctattaatatgcaaaccaatgtccttgtgtgggcaagcatgatcttactgttcactcaactggctactcctgacctgaccattttagcctatattaatctgaccatttacacactagaaattaacctgatgacactttatcctacatatgattgtaagtaatagattggctgagatcatcaatgaacaggatcagatagggataaaaaaaagtagtatttgatgcaatgccaaaaaagaaaatgacgcctgtttttatcatgatttattcaaatgataaaatggagagagaaaaaaactatagtgttagatagaggagaaggaatgtggtgattaccttaatggatatgttgctcttatgtttctttaaaatctctagaagcactctagtccaataacctctataactgagcagaccaagatcagaaagagggcgctccggtgtccctactttaccttccttcttagaaagctcatagg

SEQ ID NO: 40273 - DNA, 10155 bp, Oryza sativa
aagtgtcttgtgatcaagaaatagtttggtcaagataacaaaggttctgcccataaactttgttcttcttgccatcaacctgcaattatgcaaacatttttcttattaaaatattaagataactaaatgaaaaggagaagttgcatgatttccattctgcttttcttaaaactttttaaggcattatgccaacagcagagaactggtttcagaaacttgatcaacatagcatgcaagctgccattacaggaagctaaaatggatatcgaactaacctcaaacatagacagggttccacttctgtatatttcatcaccagggggatgtttaagatcacattttttctgtatagtaaagagaatggaattaatcattgattatgacttatgataatttaacatggaatatcagaacgctataaatgaaacatgtgcacaacaaacaagatataaaatgcattcaaagatgatcatagatcaagtgatcaactcaggaacggaatatgctgcacatgcagcgaggttgatctgatttatggtatttgtaatgtcaataagtaccagccatgacttgaggacatttaaggagatttttctgagatgccagaaacataagtagtggggcagaggggttgcattttacttatgaagttcgttgtactaattattaaatggctggcgacacacaacagttgcaatcaattcagagctagggaccactagaatggcaaaacaggcattttttagaacccacaaaattcacagtaaacagtataattactgcagctttatgaggaaattcctgcaatacaaacagggccttttaaaaaaataaagattaagagaacatgtttggcacctaatggtacaatgaacaaaaagttaagatagatgggccgaaaaagcacaggaggagctaaacaagtgcaggcagatttgagctcatactcccaaatttgcattagcagagcctggctgaaaagatagtaaccctccatatgggaacaaataactaaatctcaccatgtgcctctgaagctgttccttgcgcttcatgaagttgaggcaaaactcacagaagaacagctttggagagtcattatactccggtgggaaaggagagaaataccatgtatctatctcatatctcccaagttctatcttcgctatatttttcacctttgtgaactcttcatgttcccgcaaactagcagcatcaagctcctcatgaccttgctataatggaaatggacacaaagctagattagtttcaggatactaattcaaaagggaaaccacaattacagtacaacgtgaagaaggaaccaacatgtgtttcatcaatttttgtagccattgcatagcaaactaacatccttacagataataaatcttcaagaacaaatgataatcaaattatccacagtgatacaatctattccatacctccacatgggtttcatcaattttacgcttctggtgccgtgtcatcttcaagcttgttgcctgagtacatattaaaatggagttgtatgagtattcttttgaaataacagagggctatttatgtcttaggatgatcatctcaggttttcaaccgtcacctggacagtatagcggccaatataaggaaaaagcaaattctactggtatgattgacaattgaacaacatgaatttatgttaccttatcttctaccttctcatcaacatcggtctcaacagtctcaagatcaagttgttcaagtttaacccactcatcgagcctcctattgactgcaagttcattacatttaaatacgattggtaagcataaatatgtcaacatgacagaactccacaaacccacaacagaatacgctgcagctgttatgaagcactaactcctatttcagctaacgaaatcgggtaaaagtttgtgattgtactgaaactattgagacacgagactagaacggccatttccggccccagcgaaaagcaatcctatattcccatatacaaattcatcactatatcacctcgaatttcataacccctaaactaattgaccatttaagccccagattccctcaatctgaagcaccctaaacctaaccctagaaacgaagcatcctgttgggggcgaggtcgcttacactcggtgtagtggacgtagtactcgtaatcggcgggggaggaggaggtggaggacttccggcgctcgatgaccttgacgggatggagcttctggtcgcgccaccggcacatcacgcgcgtgcccacctccagcggcagatgcgacgcccacgacgcggacgcggcggaggacctcagcctcctctctaccccgccgccgttcgaggcggcggcggcgccgccgccgccgcccgcgccgttgcacgccgtcgaggccgcggccgccgcggcggcggcggtgccgttctccggcgcggtggacgcctccatcgagcccatctcgtcgtcggagttggatcggaagttgtgcggttttggggctgggcctcttgccccggatttgggctttgggttagatctttatcatctccgtcgtgtggtccggttgggacgcatggtttattccgtggggcccacatgtaagtgacagaatgataccgtctcggttgtatttggtctgtttgatcctccccaaatttgaattgggtcaacggatttgaaggcccagctctgttttaactttaaactaatttagttttattgccgaattttttttaaaaaaatactccctctattttattttataagttgctttaattttttactagtcaaattttttttgagtttgatcaaatttatcaaaaaatttagcaacatctaaaccaccaaattagttccattaaattagtttataattttatagtttttaaaaagttctatcaaaacatagaatgaaacggcctacttttccaatttggtgtttgggctaacacactgacttaccaatttgtgaagcagatcaataactattttcaaatccaaacgatgttctcattcctaatgatgttctatttcttcattgggatttacaatttgaaaagagtaaagaaatttacaaaaattttaacgatgtaccttgttggatcgaaaccatttaggaataagttcactttgggtctctctatttgtcgtccagtctgattttcgtccctcgatcgcaaaaccgggtacaacaggtcctctaacttacgaaaccgtttaaataagttccctcagcagtatttgaccccggttttagctgaggtggcgcctacgtggctaatttgactcggttttcatctgacgtggcattgacgtggcacttacgtggcaattcgatccgaaaaataaaaaccctatgggacccacatgtcagtttcacacacataattaaaaaaaatggtgggccccacgtggaccccacctgtcatcctcgctaccccttctctcatcccctctctctatcctctctctccatcttctctctatctctctctctcccgtgagaatggcgggcgcgccataggggcggcggcgaggcggcggttggagcactgtcgccggagccggggataccgccgccgcaacttccgcgtcggccaccacgttgctcccatccacctcgcggagatggagcatgcgccgctccttgaccccgtcgagctgctccggggaacgcctagcggtcgctcccccacgtcttcagcgacgggaacgacgggaggagcgtggcctggtggcgagcgctcgacgccgctgcctccaccgcggcggcgccatccgcgacgggatccggggtcgaggcgggggcggctcggcggagatcaccatggccgcgggaaaagccgcgatgatgaacacgcgcgtggaggccgccgtcacctagacctccaccgactccgactccggtggcggcggcggcgggagagtcggccgagcgatgagggtcagcgcgcggcggccggccgaggagggccggccatgcgtgctctaatcacaatttttttgatggttaatttgctagtatttatcagtcgcctgattgatttttaatgtgctgtgtttaatttgatggttaatttgctagtatcgaggctgcgtgccccggcgtcatctcctgcgcggacattgtcgcgttcactggccacgacgcatcgaggtacatgagcaacggcggcgtcaaattcaatgtcccggtcggccgcctcgacggcattgtctcgtcctccgaggtcgcccaaaatatgctccctgactccaaggccgacttggacaagctcacagcgccaacttcgcggcgaagggattcaccccggaggagctggtgatcctctctggcgcgtactccataggcaaggcgcactgcttctccttcaacgaccgcctcaccgagccgaactccgagatcaatgccaactaccacgacaacgtcctgaacaagacctgctacgccgccccgaacgagacgacgttggcgaacaacatccgcgacatcgacgtggcgacgctggggccccggcgccagcgctccacccgccgctccacccgcggcctgctgcctcacagctccgtcgccgcccctctgcgccgcccgccgctgctcgccattctcaggggagatagagagaggggatagagaggagagagagaaggggtaatgaggatgacaggtggggtccacgtgggccccaccattttattattattgtgtgtgaaactgacatgtggatcccatagattttattatttttcggatcgaattgccacataagcgtcacgtcaacgctacgttagatgaagaccaagtcaaactagccacgtaggcgccacctcagccaaaaccggggtcaaatactgccgaggtaccttatttaaacggtttcgtaagttgagggacatgtcttacctggttttgcgatcaatgggcgaaaatcagactggcgacaaatacaggaacccaaagtgaacttattccaaccatttacaaatggaaggcctaaaataaacaaggcccatatggcccactcagctcaaatcaggctaaggataatcccctgtccttagccagagcttcggccgctctcctcccggacaccagcgcgccgtcgaacgtcgcgtagcaccagtggtcgccgcacatgtacagcccgtcgccgaccctcgggtcgcgccccgccggcgaagtcggcggcgtctggtccggctgcgcgaagccgatgcggtacgtcctcaggtgcgtccacgacgcgacctccccggcgccgaaccacccggcgagctcggtgaccacctcgccggcgaggtcggcgtcggaccgcccggcgaaggagccgacgagggatacggacaccagcgacctccccggcggcgcgtacgacggcgccacgttggtggcgaagaacatgttgttgacgatccctttgcctgagccgttgaggagcaggatggggtcttggaccgccgccttgtcggcggcgaagtagaggcagacggtgctccgctcggagttcttcttgggtttcgccggaatcgttggtagctgcggtaggagcttctcggcctccggctgctcgacggcgacgatgacgccgagctcgccggagacggtctcgccggtgtcgagcgtcacgctggactggccgatggccgcggcgcgggagttgaggcggacggagcccgccggcaggcggtccgcgagctgcgacgcgatggcgccgatgccggcctccggcagcgcgttgtccccgagggcgaggcgcttgaacacgagctcgaagaggcgcgacgacgtgtcgagcgccgggtcgaagaatatcccagccaggaacggccgcaggaaccgctccacgatggacggcgagaacccgagcttctccaggtgcgccgccgtggtcgtctccggcgacgagaggatgacgtcgtccggggtggacgccgcgcggagccgggcgaggccgacgaggagcttatcagcgagcgttccgacgggggagaacacggcggagagggaacgcagaggaagccggaacgggtcagacaacaggtagaacggctcgccggcgccgaggaagacgagcgctccaggataaaacggccggagccgcaacgccgggaagtcaaggagacgccggcactccgggtaggcggtgaggaagatctggaaccccctatccaaccgatacccatcgacctcgtcggtggcgacacggccgccgaggcggtccgacgcctcgagcagcgtgaacggcaccgacatggacgccaggtggttcgccgcggcgaggcccgctagcccgccaccgacaatgacggccttattaccaccgccgccgccgccggtggcgtcgctccccggcgcggcggcgcgggtgacggtgaggcggagggcggcggcatggtggcggcggagcttgggtggcgtggcggggaggacggggcgcgcggcgtggacgtgcatgggcgtcgcggcgggcgacagcgagtggcgggaagcgcgcgcgcgcgagggagggagaagacgagtttggggtttgggtggtgttcctgatttgtccatggaccggctgtggatatggtggtttcggtgcatggacccggcgtttggatggggagctatgggttgacgagactgcgtggtggggttgggtgtaggtgttctgtgtggacgtccgtagactgggttcagggaagattcgtcatggagcaaagcgttatcctctctctctgaactctgatttatgagatgaagaacagaagaggaacgctctgatagaataatggttcaatcctggaatgctattttctcgaaccctcttttacctcaacatttgtaatggtttgcctccggcaatgcccgctccctgtaaccccaagatctttctcttaaatgcaatggaagattcaagtggggaacatatcctctccggtgattattaaaaaaaagaagaagaagataaacagggtaaggctagtttttctcatccgaacacatagtatatagacaattacgtacccacgcacatttgtatgggcgcatgtacacatgtagctagccaaaatttaagattgatgaaattaccccaaatccctaaatgtcgcgtcgctaataagtgtcgcctaccactaaaatcatgattagctatggatataaacatctgttgtcgactgatatctaggtgggtagatgttaataagtgtcgccttccactaaaatcatgattagctatgaatataaacatctgttgttgacttatatctaggtgggtagattctactgcaggtaacctaaactggctatcttaggctcacagtttgtttaggttggttccagtggtaccgaaattaaacttgtgaatctcagacaaaatttgttaaaaacaatagatttttgtaaacttggttgttccacgtgatcaataccatttgccacgtaagcaatacttttgccacatcatcattcacgtaagaaaatcattttggtcatttgtagcatttcttatactttaggtttgtgtttggtttggagatgagatgagatgggttaggtttatttgtattttggggatatgatggacctagtttctatttggttctaggaatagaacggacctagttttctgtttggtttgagggatatgatgagttggaatgatcctatctcttgtgttggttggagggatgtagatggattgcttagatatagttacctcttcacattagttggtgaggtcatacacaacacaaaatattgaacatgaagaccacatcatttgaaaaaaaaaatacattcatatgactatatttggaaataaaatacaatcatatcatatagccaaccaaaaaccaaagcaaaataccgataattagcatacatcaatccttatatcaatgtaagcataggaagttcaagccacacataataaggagttccttactttggctatagaggatgatggaggatgcgaggagcagtagcagacgagagagaggatggcactaggacgctgtagtaggttcccgcaatcggtttttgcttctcgccaccaccaccaccgtcttcccttcctgccgtcgccgccaactatgagatgaggagggggagtggcgagagagagatgggaggaaggaggacagagaagggaggatggcacgggcgccactggccccatcgcatgacaccggcgttgccggctgttgcgcgcgatggcgccgccatcaccctctttttttctctcaatctagatggtgatacggtgaagggggagaaaaaagagatagggttaccctatcccacacatgtgtaacacatgtgatgcgcgactccggaggtgagatggagtgatccgctactttttttcaagggccaaacgaccccgaatgtagggagaatattcctttttgacccaactcaactcatgaagtccttcaactaaacaccagtaaatataggatggtcccagtccaactcaccaaaaccttgcagctaaacacatgctaagagtgtaattaattcagggctaaactatgtcattcatgcatagggttataatatgaaaacttcaaacctaatagagggttctaatataatttaatgtcttgttctaataaatccttataaataaatacgtgacggaaggaaagtaaattggacttatgttagcaattaacaacggcagtcacacactcgcacacactttgaattgacgaagatgaataataagttggcgcacgtaaaacgagaaagctactagcacataattaattaaatttaattattacgacttaacaatttgatatatttgatattttaaaataacttctagtctctccggtttcaaaattattgacatttcgaacatgatctcacataccaagcagtgatttattaagatatcaatttactattttacccatattaaatatagtattgtgctctattatcttatatatatatatatatatatatatatatatatatattcttgtgctaatggtaatcactaccgttggtttgaaccaatcacctgcatcggtgcgaggtaaagatccaattccctagcttttttacttggtttttatttgcatgcatgcagggcaaagcagtccaatataacatactaatacaaaaggcgtcaacaattatcaatcactgtttagcccgaaatttttgggctgatacgacttatcgttttagataatagtgagatcaaaatttagaatatttaattataaattatttttaaaatatttgtctttcaaatatgatgactatatgtatagattagtcttaaaaagtactttaataaaatcaaatatttattaacactttatacatattataatgaaaaataacggttaaagttattttttagagatcgtggtcttattcaaaacaataagtattattaatctgaaaagataccagactaattttttgattgaaggaagtatataaaaagttttagcacgaaattcacatctagtaatttgaaaaatgtgggcacaggaaaagaacaggacatccgcagcacacgaacccgcccgccgcggcgcgcacgcgtgtcggtctttccgcgcgccacacgcgcgttgctctgctattacacggttacaccccgccgaacgtcgcggtctctcctctaatcatggacaagcgaaacgttaagcaacaacacgcatcacggattaacgggccctaaaacaaaaatcaaacgaaacaagagggctcatcatcaaaactaaaaggaagaaaataaaaggtgaagaggaaatttcttgaaaaggttttcgttgcacgacgatcatcagtaaagtaatagagtatctcgtccgtttatggtgatggacgagaatatcgtacaggttggctacgtgcctactacgtcgcgtagacgtctccagagcatctttcctttctttcatcctccagaatatgattctgctcaaaactttctacgatcatttcgttttgaagcatccaacaccactgttttttttatatatattttgcatttttgtactcgtggctattcatatccatgagcacaaggcttgttttttatattctttttcttatcttccttttgatcggttggtattggtaatgattgtacatcatttttgcggttttacatggagacccatctatctgttctgatttg

SEQ ID NO: 40274 - DNA, 7170 bp, Oryza sativa
aatcgttgattgtacactaataactatttcctccgtttcatattataagactttctagcattgtccacattcatatgcatgttaatgaatctagacgacatatatgtgtgcctagatttactaacatcaatatgaatgtgagtaatgctagaaagttttataatctgaaatggaggtaatacagtttgacagatcaaggatatgtcttgatgtcataatgttagtattgatttattgtcgatgtgcatcccttgcatctaattttgctcaatcaacaactttggttttaactcgcacaatgcttgattcaagaaagagattaacaaatagaaaatgcttttgtaaaaggttaatgctagcatcctctatttaccaggaggagtatcactagaggtgctatatttaattgaaatgaacaagtcagccatactatcatgcgaatcaagttgaagttgactcctccaaaaattattccattagataaaggaagaattaatccatcaaaacaaattgcatgccgtacaagaaaaggtcaattgaaagaggtcattttaatcaatccatttgtcctctttccatgttcaatggccatccccgattcccctctttaactaatgtttgaataatttcttatttacacttttacataaaataatattccattttctctattattataattctaaaaatacctccaacaacacaagtaatcagaattacatacatcgtcccttaactcaacgggagacgataaaaagatcaacaataacaagagaagatgtttactgcaatgcttacagtcagcgttggatttaaattttagaatctaatatcgaagaaaagttactagataaactattaacccataacctcatcgatatttactctcttattatacagtaataatacaatcttaattcatcataccgagttatccaaaaaaaaatcatcatacggtagaagatcatcatcattttataattcttaaaagacacacacagacaaaaaaaaaaaaaggataaacagagaaagtaaaagttgtccaaactcgacagggaaaatttgcaaataggtcccacaacttttttcaaaatttcctcgtgcgcgaaaacaacctcaccagacacaaaaaatactccctcgctccatttccagcactacggcactacccatttctattcctcttcacctcgcggcggcggcgcggcgagcaatcggcgcctctcctctcggtctactctcctccggccatccccgttcatctctactcttcactccatcctcctccactccaccgtactgccctggggtgcagatcaatcgagacttggggctgatttctcgagttggtgacgaaccctaatttcgtttggattgttgcaagaggtttgtcccgccctctctcttagctgcgagcgatcaaattggcatcgttatcactgggatgagcgcaccgatccatcgagttcgtcgcggatttgattggttcgcggcggagcacgagtagcagttcatttcccccacgttatgtccagccctggaaggagtgggttctcccctgggttggcgcagttgttatcatctagagatgaagcgaaggttagttcccagaagtcgcacttggtatcgtaccatgacgagattgggcaccaggatattgagaggacgctagagcatatatttgatctccctcacaagtcggtggtccggcctccgggtccgattgatgtgggatttgtgcgctcggtattgcggaatcaggcaaggaagtttgatcttggcgggaaagatagccgtaaatacgatgatggtgttctgattgtggataaaggtgctgggcaaactaaggttgttcttgatgattcgagcatttgtggcaagttcaagagcatttggggacctttgcttgttgagagctcggcatcattcagcagcgctagggctaacacctgcgtgtggaatggcaagtggatgtatgaggttaccctggagacgtccggagtgcagcagcttggatgggctactctctcgtgccccttcactgatcagaaaggagttggtgattctgatgattcatatgcatttgatggccggcgggtgaccaaatggaacaatgatccagaacaatatgggcagatgtgggcagtaggagatgtgattggttgctgcatcaacttggatgctggggagatcagtttctacaggaatgggaattttcttggtgttgcctttgatgggattcgcaaagtgggacctaggaaaggctactatcctgcaatttctctctcagaaggtgagcgttgccatctgaacttcggctcacatccattcaggtatcctgtagatgggttcaatccaattgaggcaccgccacatttttgtatgtttgcggcatatcttcttagatgtttgttccgtctactagaagttcaaaatctggaaaaatctgaatctgcatacttcgagaaactaaggagggtcaagaaatttgcacctttacgtgaactatttcgaccaatttcggaagggatatgtgcagaatttttcggtgccgctgaaggaagccaagggtgttctgaatatatcacctggggatctttcatcacccttcttacagatgttttcagggtacgggagccgcatgatttcttatgccttgaccaggttcttgaactttttctacagttcccggggtgcagttcattactgcaggagctcattgtggctctttcttgtatgtgcaaagctgctccacttgtgttgacagaatgcccattttctggaccatatccatttttagcgctggcttgccacattcttaggcataaagatgtaatgcatctatggtggaagtcagaagattttgcattctcatttgaaggatttcttacgatgaagattccaaacaagcaggacttgcagtaccttgtaccttctgtttggtggcctgggtcttctgaagatgaggttagcatgacattatcgatgacaacactctccgatgcaattaagaaggtgaactttctctctcttccttagtcgcgcagagaaattctactaatagatgatatcttgaattaattatgccactgttataacttattctagcatatgcaattttctgctattttatgttgttggcttggatttttattattcttctcaactcttggatgtgcatgctatgctatttggtgattaaaatttgtattaccctgtaactagcccagtttgaaatccagactgccttttcctttagttttctcagcgtgttgcttccttgcttttgtgcacttgtgtactacctattattctccttacttatatgttcaattcatccaaagtttatgctctgttctattagagattaatgttttaaaattttaactacaaacatgatcgcttgcaaatagataaaactctctccctccatttctaactcttaaatctttgtttgtttgttatggtttgcactgtttttcttctacagattgaggataagcaccgtgagctttgcagcttggtgatatgctttgttccaccaacgtctccccctctgcttcctggatctgtgtttcggtcatttgtacaaagttcaatactaaaggttagaggtggagatcataggatggcttccagtgggactttcaatgacacggtgcttgtctcactgtacactgtaatcctccatttgttgtctgaaggattttctatggattcttctggacctgcatcatcctctagaataaattatggaactggtgttggatttctccacaaaggtggaaagcggaggtttcctacacagttattattgaggaatgatgcctattacaatgtaattcctagactcggtggatcactaaatcacctgttgatgtttcaccaaattgatgccaatgaagatgaggtgcagtgggatgaaggttgcatgaatgatgaagaaacacggataacacacactacagcacaaaaaccttgctgctgttcaatcacagatgtcactgttggcctgagatttaaagaaaatgccaagtacataccatcaacttcgaaaggcccatgcaagtccatgcatgaaaaatctgcacatattgcctctgaatgcagtgtgagaagtcttagtaatgagattgaagacaaacctatcacaagtgctcaatcagaaattgaatatggctatcaagcactacatcatttagaaagcatgtcgatgacaaaccaattttcatcagaagcactaagagaagaagagttgcttgattttatgctgctgttatatcatctgggtgtctcaccaaattttaggcaggcaagtgatattatttaattttttcttgaattaggtgaacaaatacaatgctgcagcaaggatccaccactttgcttacatagagatcctcaggatccgtaaacattacgtcatgtactgttcttaattcataatctatagggagttgtccttaatttatgcccttgcacatgtacccaagagtttagacaccatgtgctttccttatgtatgtgagctgcatggccagtatgtgtagccattttctagataatggcatcactttctgcaatactatttagggtgatttgaggattagccactccctgatcatgaaagccactattggggagtggcaaaccattagtcatctatactgtttaagaacaggtccagatgtgctaagtacttcggttgttcattagcttatttaactctcttagaaaaaaaatgaagcacgccaacctggccagtccatgagggtatattccaatgccacttatccattgatgcctgccagtgcactaggatacttaatactttcatattctgctttacattatggttctgattaagtttgttctgttcaggcattctattttgtgtcccagcaatcacaatccatttctttactagaagaaactgataggcagataagagaaaaatcatgcatggagcaagtaagacgcttgaaggaagcccgcaatagttatcatgaggagttggtggattgtgtcaggcattgtgtttggtatgatttctgaaaggacaaattattatgtcttcacatattgcatgacaatatgaaaacactacacttctgccgtatacaatataatttagatcatattttcttctgaatgattatacgaacatattcacaaacatattcctgttcagtaatttattatgtcgaaatggataaaaatatccttgaagctggagcttcttggaaatatatttaccttgcataatttaggagccaccttctaactcttataggtgtttataatgcttgttcttttgctttccttggtgtgagtaagattttcccacaggataatttgtacagactaaagttgatgaaaccattttgcagactagagagctaatttgttgactcgatatatggtacatgcaggtatcgtgccactgttttttcttcatggaagcaaaggggaatgtatgcaacttgcatgtgggttgtggagcttcttttggtgctcagtgattcttcttccattttccactatattcctgaattctatgtggaatcattggtaggtttgaagcgcccatttacagccaacttggttatttgcattgaaacaatatactgaagcctgcacttctgttgtttgtacaggtagactgtttccatgccctgcggcggagtgatcctccttttgtctctcctgcagtatttcttaagcatgggctagcttcatttgtatgtacagaagcgtcttaatgatttttgactcattaattatgtccattctttcttgataaggcacctaaccacacccatcattcagaacctttaaatcctgcattactaatgttcttgctggtttactttagtagcaaaaattgtgaggttgaatgcgtataacaggaagtttgatggattcagtgtttttatgtttattttatttcacaataagcaacaccctattgcacagaacaaaataaaactagctcactggtagctggccaaattgtgggcaagtttcttgtttatgtttagcattattcagtgttgcagtatcaactaagagctctattttcttatcattaggtcactcttgttgtcaaacactttgatgatccaaggatagtgagtccagacttgaaagatcatcttcttcaaacaatatcgattcttgtacagtataaagaattcatgtttgtatttgagaacaatcgggaggctataaacagaatgccaagatcacttctgtcagcttttgataatagatcatggatacctgttaccaacatacttttccaactctgcaaaggttttggctttgcttcatctaagaatgttgaaccttcatcatctgcaattttccaggtttattttaatattacaatcacttctgttattatattcagtcttctatttctgctgtgcatatcttactgtgtgattgtgtgagaactatctatttgatcttacattgtttttctttatgaaggtcctactcagggagacatgtattcatgaagaagaactgtttttatcctttctcaatcgacttttcaacacattaagttggactatgaccgagtcctctatgtccatccgtgagatgcaagagaagcgccaggtggattttgttttgtttttttattcccctttgtgcagaacttcaactctttgctgattgatgctttagtgtcgggtttcattttcagttcagtaacaccaagctcttttctcatgtgtcaaaatgcattaaaaaactgaaatatatctagatctgcgatgaaggtgtacactaataggatctcttgacaacaatcagttccagtcattaggtttccagttaattgctttttaaatattttatgccaagggggggggggaatctgtgtcattcctgtggtataaccatgcatgtggagctaaataatggtaatcaatgtcctatttttcaggttgcagatttgcagcaaagaaagtgcagtgttatttttgacatatcatgtagtcttgcaaggattttggaattcttcaccagagagattcctcatgcattcctgatggggccagatatgaatctgcggaggttggctgaattagttgtctttattctgaaccacatcatattagcagccgatgcagagttctttgacatgtaagtccacat

SEQ ID NO: 40275 - DNA, 1333 bp, Oryza sativa
ggtcattactaaaaatctagttagactgcttatttgcgattaatttttcgttgtatgcttatttttcgttgtacagagcaatgttctccgaggtgacgcttcccttgcaaagctagctcagcttgaagaattctcccattactttatgcacatcactatgtcagcggatggcaatgaagagcaaggtttcagcactgccagtaatgaagaggacaactgctgcatatgctacaattccgattcggataccacattcgagccatgccatcacaggtcctgctacggctgcataaccaggcacctcctcaacagccaaaggtgcttcttctgcaatgcagtggtgacttcagttaccaggatagctgattcgcgcatcgaatctcggtcacctttggcaccgtaaacccgaagagaagaaagatggatcatgccggatgtcttatccatttttgctcgatttggaggcgcagacagctcggagcctcggagttcttcccttctgctttcctggaagactgcatcgccatggtggtgaagtcagaaaggttaatcttttcccttgtgtaaagatcaggtaatagttaaaacaaaaaaagattcaataacaggattgcagaaggaggcttctgcacaaggtgggaagccagtaccacccaaagaaggattcacagaatcgtgaaatttttgtaggttgtagggaaaaattccattgtaaatacgagatatgaaacagaaaggaggtgtcagatctacatcaaccttttgtaattatgtagttaaaataaagaaatactagatggtttatattggagggacctctagtttttttccctcgtatatgttgaataagagcctcactatttttcttatgcttacaaggcaaattttaaattataaaacttaattttatagttgattttgtgagttttttcatcttagtttatttacaatatttgcctttaaatcgctaaatacataataataaaaattttacttaaaaattacttttaaattgctaatgaacgggtttgcgtgaacattagcggaaacaaatgagacctcatgctttaaaatgggtgtattctaaaatgcgtaaacggctagcctcgtgcaggggcccacgtgccagaggagggccgcacacctacgtgcggaccccaccatcccacggcaccgtccacgtgtagccgtgcaagggacgagacgagacgggaggaggggtccttgtcccgtgatccgacgcctcgtttcccgggtcgcccgcccgacaggtgggccccacgtgtcagccccccacacgcgcggccaatatctctcctctcctccattcccc

SEQ ID NO: 40276 - DNA, 2083 bp, Oryza sativa
cgcgaccgctccgtgggatccccgcgcggctcctctcctgccgcgcagcgatggcggtggcgcccgacaaggaggaggcggcggcggttgctctggacaaggcggtgaaggtggcggtggcagctcccgacagggcggcggtgcccgcggtgggcgtcggggaggagctccccgaggggtacgaccagatgatgccggccgtggaggaggcgcggcggcggcgagccggggtgctgctgcacccgacctcgctccgcggcccgcacggcatcggcgacctcggcgacgaggcggtcgccttcctcgcctggctccgcgacgccggctgcacgctctggcaggtgagtggagcttcgcattatcgcgcccatggctaatcgaatctgctcgccgattaagccgcgattagcgtctgattagcgagcttaattgcgtttttgcgttccatttgcgggacccaccacggtcagggatggtgggccatggaatgcgctctgggccctggtgggccggggaacgagacaaaatacgggggcccggcaagtgggctgcgagtgcagccgggcctactggcccagtacgtggagcaagcattatcgtccattctcgctgaaacataccgattgttgtttggtactgagaatctgcgagaccgggactgtagttgtttgctgattgaaatgctcacatcttatctgctgctgtcatgggatgtgtccgtcctgattgtcatagcaacggatgggaatgtgcaccaaatcacaaggttgttaaatcagtgctgtagcaaacaggaagaagagttaggagtatacagtgttgaaacatgttattactatgtggtagcattcattgcttctggccatgcttacaggttcttccgcttgttccaccgggaaggaagtctggggaggatggctctccatattcaggacaggtgaaactatatccagctaatcttgcatattgtgtggcaatcatcgaatggaacttatacgggtacacgttgcaggatgcaaactgtggtaataccctattaatttcacttgaagagcttgtaaaagatgggttgttgatggagaatgaactacctgaccccttgtaagtttgaactctttaatgattaactggaaattcatttctaaggttggcgtcaagcatttacatttttaaattgatggtagggatatggagtatgttgaatttgacaccgttgccaatctgaaagaacctcttattgcaaaggttagtttttcatgactgttcacttcagcatacctttctgtttcctccgactggatttgattgttctacttctacacttctactgagttcaaacagttgaaatgtgtacagcaatgttactactactgaattgatggaagcgaatcatcgcataattaaaattatagataaatcttttcttctaggctgcagagaggctcctactgagccgtggagagctcagaacgcaatatgactgcttcaagaaaaatccaaatatttcaggcaagaaatcttgatttgctaatttcaaaccatattgtcttagtcttccatactcttaaatgagaatagcagatacaatattgtcagcaaaaaactgggtaacacatcaagtacaaaactgcaacctattaaacctttagtataggcatcaataaatagctagtgttccccgcaaaaaataaaaaataaatagctagtgttgctatgctagaaagaccatcagataggtaaactggctcaaatcaggggtcaggtggtctgcttttacaaatacatgccttttccaactaaaatgaaaatagcaatgatcctgaaatgtatgcctgaaataatatacacagtacagtgccttagtcgttctttcctgccaggttggcttgaagatgctgcactttttgctgctattgacagaagtattgatgcattatcctggtatgagtggcctgaacctctgaaaaaccgacatctcagggccttggaagacatatatcaaaaacagaaggatttcgtaagcatttcaaactataatattttcattgcgatgaattattacagaaacaaatgccagtggact

SEQ ID NO: 40277 - DNA, 9184 bp, Oryza sativa
  unsure (1)..(9184): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgttggcttgttgctaattaatcgatcgatctctcttgggatcaaactatgctagttgctgatcgatctcctcttctgcttgactagttccctttggagacaaaagggcaacttttgttcttaggtatgggtcattacccccaagcataaataagctttgctagctagtggcaacaacaaaaccatcaaggcaggataaatatagagctttgctagtgagagtgagatcgatggagagagattgtttgtgtgtgtatgtgtgagaataaaatatttgaagtggtaaaaaggtgaaagttgaaaggtgtgtctttaggtgtttgtgcaagcatagcaagggttagctagtgtagctagtgtgtgtgggtgtgcaatgcatcatgacacatatgatgaggagaaagatagggaaagggggaaggagggggtggtaaaaagctgtggcttggtgcctttgcatttggcatgattagcccataatgtgatgcttcctgcatctgcatatccccccttctcatcaaatctcagccttcctccctctcccactgcaaaggtaagctactgcagctgctgcctctggagcctgcactgcaacagtgcaatgcatgggctgctactttctttggcctggacccacatgcaggcacacaccttcttaagtttttgaaaactagcttgttagttgttaaatagtactccctccgtttttaaatatttgacgccgttgacttttttaaatatgtttgaccgttcgtcttattcaaaaaatttaagtaattattaattatttttctatcatttgattcattgttaactatacttatatgtatacatatagttttacatatttcataaaagtttttgaataagacgaacagtcaaacatgtgctaaaaagtcaacggtgtcaaatatttagaaacggagggagtactagattgattggatcaaaatcaagaaaagggatttgctacaattgtcaattgatgttgtttgagccgtcatctcaagcggggtcccttgataggattagaatcacttgatcctgacttgacctggatttgaggctgataaaaagggtgttatatagtggggatcatgtggtcgaatttgttatcgtcttattgatcgttttgactagctaattgctatggttaaaattattatgttcttgctgactagacggaagagatcgatggattagtaatttaatttctatgataggaggagagtgatctcagcttgcgtcaataccaaaaaaaaaatatctgatcgatcgttggcgtttctttttcattatctgcaccagtgtaaaaatgacataatagtgtaagatagatggagtattaaatgcatagggccgagcaaatcaatccatttctctcaaaatttagtatgttcaaataacacgattcatggtagacacattgtctaaaaaggagttatagacaacaaaagtgctgctttttttccttgattaagttctgccttttcaaaacggaagctttcatgtgaagaatcctgtcatcttagatttgttaatttggaaagaatatacatagcttcgcttaaaagttagtaccgttttgattttaaaggaactggcgagatcaatcaaaaatagacagaatggtgcatcaaaacataaattaacaacgaaatatgtttctttctcttttcttgcacgccaacttccttgagaattgaaggaaaacaatacaagaacggttggcccgagaactactagcacacaataccacagattcactatagcactcgtgtactccttccgatccgttccaaaataattctatgttgaaaaggaaccgtcaagattcgttgtactattctattttaatctaggttgatctattttgaaattgatggagtactcccatatatggagaatttgctacattttacagtcgatctgcttctctttttttttgagagagtctctgcttaattctgatcgtgaatcaacaggtagctagtgtgaacgaggtaattaataatttctccattagcccgctacagctagctataaactatactttttcctcccttaaaagttaccaatatatattttcactccatattacgcacgcataggctagctaactatgcatccgatgatccgaaggtcaaaccattagtatacgcagctagcctttctactcgccttggatgccattctacgtatgtagtagtagcaatgtagcatagcacacgagacgacggtgacacagtagtgtctagctaccactgcactgggagctaagctagcgcacgcacgagagacaaccccagcatcgtcatcccccacgcgcagaacgagacacctccgtggattaggggacaaattacaatgcaaatcctcttatatattctaccaatgcaaatttcattgctatagcaaactagtaaaattgattaattactctgtacgtgcgtgctaatttgattaatcatctaggagaacctacgccggcgacgtagccatgatcgagctgggcgcgcgtgcgacgacgacggtgaggtgagccccagctacacgtacgcgggcggcgcggcgggcacgtgcggtggcggggcgggcggcgcgggaagcgaagagggagagaggccacggccagggggaaggcgacggcggaagcgacagcggctggaatatttgtcgctggatggcgccagcctgcttgcgtctgctcgctcgttgtattggaagactagttaaaagagaggagatcgagatggtggtggtgagattattaacagagaggtcaaaggagctagctagcactgcaggttaatttgtgcatctaaatctcacatgtttctagacatataggagagtatgctacatgcatgtatccactgatcgatcgatctctcgtgcacatgcatacgatctgatcagttttattgattccctagtttgatcgactacatcaggaacaaccccttttaatcccgggttgtaaactgagacgtccagtccgggactaaaaatatccatctttaccgccgatcaaaatagccaacaataaaaatggatttttattttttagtcccagttggtaagatggtagcgctaccatttttagtttcggttgattagtttttttctttttttccattgtttttttttgcttgcatttattgtcaccctcaaatccccacaaatcatctacaattgcccatccacaatatcatccacaatccacaagtcattgacaaaatcatccacaaatctaaaataatatacaacaaagtttacaaatcattctaaaaatattttaaaaaatcacaaaacaacagccgccgccggccgctcccgccgcccgacggtctcccctctcgtcggatctggcggaggggagactacctggccgtgcaccgcctcccatcccgctgccactgccgcttcagcggcccggtcgccgctgcggccgcttccgccgctcggccaccgccggaggagaggccgccacctgccatcgccgtcatcggaggaggggggaggaggggaaggggaggaaggggagggggaggaggtggaggagagaaaatgagataaggacgagaggcagcacgcggctcgggagagttttcatgtttttttttttaatttgggtcctggttgatataaacaattaggactaaagataatagggtctgacatgtttttgaatcgggactaaacatgatttttagtactagttcttactcaaatcgagactaatgtgatttttacgtgacttagcaaagatcacttttgtagtagtgtgtgtatccagccgtacgtacgtacgttgctggtataatatgtacaacatgtacatgactctttcgtgcgtatatagggtgctgtagttttaatttgatttgtaccgcaatttggtttgttggttcacattaaggccgagtttagttccaaattttttctttgaactttcaacttttccattacatcaaaacttttctacacacaaaaacttttaacttttccgtcacatcgtttcaatttcaaccaacctccattttaacgtgaactaaacacagcatcgctagagccagtcaattttggaactagccctagttaattcatgtcagtggccgggcgtgcaactgcaggcaattaatgttgtcaacgcctgccatatttacatgcaccctgcaggacgtaacgtatatgccggcatgcaacacaacatgtatagtacgtacgttacgtacgcactatatattgccatgcatggatggacttctcatgtttgtcttttgcaaatgcaaatcctttctcaacccatctgtaaattaattaacaattagtcacccttttaaaaaagaaaaaacaacatgcatacatatgcatgccaagacgaacagcagtttaccattccatgactttctggagtatagatccagcgtacgtacgtcaagctgattttttgtacgtatgcaacaagtgcaaatgctcaaggacgattctcaaattcaaaccaacatgcgtccacaactacattacatgcataacaatacaggttaagctctgcgtcatttagaaatgattagtttggatcgatgctgctggagtgctggtcagtacagtgtggtcacacaaacattggcgtaattaataaaggattcagattacatcaacttgcatgaacatacatacctaacacgtactgtaacatgcaatgcctagtcagctgatgtgtctgatggtcacatgcttgtctcacttagaattagattcctctttagctccatggaagcagtgtatgtcagggataggagatggtgaccaactacactgtttaaaatctctgactagatgagtataaaactatggatgtctagctatctgcgaggagctggtaattaattaactatattagttggctacagggtttaattatctatgtagttatgataattaaccgcaaaatttgcagagttaagtacttgcattgtactgtcgtgtctcgcttgtcacacactgatggaagctttcacctggtctctcgtagaactagaacggcgtagctaggataactagtagagactagagagagggtgtgatttttacttttaccttccaaacattttaaatttgagttctgtacttgcttccaacattgcggtaattaaggagatagagtcatagagggatcattcattaatacgatcgaatcgatccttaattagtttagctggctatatttcatttgaggtttatcatttcaatttctgaatatacatcttaaaaagcgcctttaatttgaagcaaaagatggtaatttaaccaagccactcaaaaagtaatcccacacatatatgtcgtcgatgctaattaataagaagattcagtcatgcatgactcaaaaaaaaaacaaatgctaattaaatgcatgcatgggtagtgtcatgaacatgtcatgtcagtcagatcagtcagcgtactaccggcaacgtgttggattttagagtcgctaggcgtgtatcagttaattacaattaaacttaatttgcacagctcttccgaaatccaatgtgatcgagaatatatcatgcaaacaagatcgcatcaagcagcaggcagctgcagtgaaggtcatgcatgcacattgcatgcaaaacatatcacaaaaagctagaagaagtgtgactggctgctggctgcaggtgaatatttggaagtgtgggaaggcgtctgcttgcgagctgactttagtcccaaggccctaaaccagatttatgctcctctaatagtattggtccccatgacggggaggataattagtctttttggcctttggggatttgattagtgttaactccttggactctagcgtatgaactcttgcaggccctaggatattctctcctcatgcccctagggctccacaggctttctaaagagacacaagattcctttccaaagtccacagaaaatttgcaactttttggtccccattttaattctaaatttcttgcattgcattgctagcagtagcaaggcagcttgggaggaagaggagcaatgtatatactttgggaaatgaaaactaacaaagaggtttggaaaaaagagaagccttgtcactatgagtatgtttgcttccttggattgaccttgggcaatggtcagtgtatagtttcaccgtcacaagggctggtggctagctaggctgctagtactagctaattgttgtttcttaattgaactatataggcaaattaatcaatctgatttggcaggaaactatatcgatcttgctagcagctattatattgaatgcattattgttgtatatattcaattattgttatatatagtatatagtatcatgttagttttcctttttttttacggggaatcatgttagttttcctgatgtatgcatatttacgtactgaaaatcaagacattatatatgtcatttgtatgctgagatgggtttaattggccgatcagatgaatcaaacaagcgtgtataaaaaaaaaatccctaattagctatagcattctcagatcgatagtatataatcaaaataacatatccttgatcgatcagttcatcacctaagcataaatttcttaattagtttttgtagagacattaattaattagagtgaagagctaggcgactttctcaaaatgaagagcagaacgtgcgggtgtgcaagctaggctagctgtagctaaaaactctactttggaaaagaaaattaaagtgcacaaacatataggatagctagctaggctccttttttccccctttttctctcgtgtacatgctgcctcgctttcgttctttctgagtggagtaggggaggcgttgcgaatgcagaagccacgtatgccaaaaaataaaagggagaaaattaaccaaagctggcgacgtcgatcgaccgcttgtaattaattttaaacggatatagaaaccagaattaaggcttcgcatataaatgggttgggattttcggtggcacgtaaaataagccattaacacataaataattatgtaattattataaacttaaaaattgattatttatttgtttatgaaatttctgttaaaaacacttttgcataaaactcactgtttagcaatttaggaagtatgctcaccaagaacaaggaagtagtcgtttcgaagtagttaagtagaactcacccttaagagcaagtttaatagctaactactagctacaaatctacattagagttaacatgtataataggttagctccattttttccctccttttttctctcaatcaaaaaaaagtttttagacatgctatggatagaacggaatgcgaaagagatggggacacagattacccgatgatggttgcaggggagacctcattttccacggccgacaaaaggagaagtggaggaagggagcaagggtggtctctcactcgacttggctgacaataaggtgaatggtgagattaggcagtgctatggagccatggagggagtggtgggaggacagaactcgacgaacacatgttcctaagcgtcaagcatgtccagctctcgatctctccctcactctcatgttccctggttggttgaggtggaggatggcttgcacacgactgtgacgaaataaacaagcctccctcaaagttagctgccggcaaccgcatcatgcgcgtaaccacctctcctccccattcccttgcttccatccttacggagagcaagtttaattgtaaagtcaactgctagctataaacttatattagagctaacatgtgtaatagattagcaataaaattgtttctatttttcttcttacatatttactttagagcatgtgtagagctagctcttacatgagagctagcaatcatcatttttcaatttatctctctttcacataagtttatagttagcttatagctcactattaattaaacctgtgaggaatgaggagcctcgccaacaccccgtggttctcaaatgtacatgcaaaggcagagatatcttatgcctaccttctgcagcccgtcctcctccattagtccatccctttctactaataatcaatatatagtatataatataataagtagagataaatgtaatagtttttttaggaagataaatatattggttcacatgatcgtatgatttggagttttggacacgattgtgtggttccggcttagggtgggtaattcacgagtatgcaagttgtggcgctacaatccagccgtatgtatggtagttgtgtcgtcgtctactcaggggctcagggcccatgggctgcaacccgccgcttctcgcactgtgtggctgttcgcggccaaaaatagcaaggaacatgtgccaaactggcaacaagagtctttttgtcatgtccacatagggcctgtttagatccatttagaatgacaaataacaaataataaaagttttggttagcgttgtaaaagtactagtcggtgtttaaatgcatcttaaagttttaccattttagcactaaagaaagagaaagagagagggtgtggtcccgaagcactttttggcaaaatttgctactatggactaccaaatgccaaatgccaaatgctaaattgccaacttttgctactagtgtttagatctaaaatagcaaaaagtgctttaaaatggcaaaacttttgttattttggagggccctgtgtgtacagtggcgggggcatgggacgaccagtggcctggccccctttaataatttttatacataattatctaattacaatcaattagataatcaacttaagaaatagtgcattagctctcttcaatactgttagccccctcccattttaaatcctggcttcgtcgctactacttgcttgcgtgtgtgccgcccatcggtccatgtactaaagcaacggactcttaaattcaaacatgtacttctaca

SEQ ID NO: 40278 - DNA, 1899 bp, Oryza sativa
ctctatatccggtctacgggtatcacccgttgacagtggcgcgccaggtagaggccttggtactcaaggttctactactatgtcatccagcttcgtcgacaacaacgtcagcaccagcctcagccaagtactccctgcttcaacaatgctggtatggactcaagtcggcgaaatcgtcttcccggtttacaccacgacgccgatctcaaccggtcctccaatgaccggagacgagaacgtagtggctacgaaccagggcgattccatgtcgaaaaatccccccgtcgagacggagaacggaatatcgacgacatccaagctcaagaaggattttgatacggccaaaccttgtccttccgacatgaaccacgagctgacaaagatgacttccgaagccacaaggtcttggtgtcttatccacaaaaccaagaaacacaccctgcaagattgctgggttttcctcaacgtccgtgctaaaattcgggcctgcaaagaacgtggaattcagcgtacttctccaactcgggatgtctattgtcctatttacaagacaaagaatcacgacctcttgagctgcaaagtctttctcggcgccatgaaagctcagtctcctaagtcatatatccccatcagggataacggcaaggaacaaggagcgactccaacttcagatcgattcattggggtaatcgatatcgaccctcacgaaccatcggtcttacatctccttgaggactatgggtcatcgacaacgagcgcgccgcgggaggtattggctatcgatgacgttggcacgtcagcgcacgccaacacagaagcggggaaccaatcgactactccagtccagcacatcagggccgttcaagcgatactgagggaaactccttacgatcccgttctgaaccttgaccttgagcgttggacagaacgactacgggaatcggtgactaacctcagcaacgcatttaaagaagctgctaccgcagcacaccaggagcagccaccaactggagaggccaatggtgtaacaccctgaaaattcgaccgacaaaaatctaaactctaaaaatatgggcattcaaaaactttttaaataaattgcatcatgccgattttctccgcttatttcattggaatttagtttcgaagtttatcaataacgaataaggaataattaactaggaataaaacctaaaattaaattggcaaaagaaataattaagatataatttaaaataaagatgaggtgaggatagaaatgaataaaatattatcgcgaccatatttgtatcaattaaatttaaatgcgattgaataggaatttactctaattaaattcaagtaaattatataaaaataaaatatcagtaaaataaatctagagtggatccattggttggaataacacaaatattgaataaaccatatttatgcaaaatttaggatttatagaatcaaatttaaataataaataggctaaaatcgggttaaataagaaaaaacactgttcctttcactctaggtgctcgacgtggtcccctaacccagccccctcctctttcccctctctctgtcgccaccgtcaccacgcgccgctgcccgtcgcgcctggccgcctcgcgccccgagccgccgcgcgccgtcgccatcgtcgcctgccgccgcgccgacgtcgccatcgccgtctgtcgccgtcgccatcccatcgccgctgccgcgccgcgcgccgttgccccgcgcctcgagccgtgccgctgccgcgccgcgcgccgtcccgtcgccttgcgccccacgccgctgccacgccgcgtcgccatcgcgtcacccgtcgccccgcgtcgcgccccgtgccgcgccgccttgcgccccgagccgcgccgcgtcgtcgccatcgccgcc

SEQ ID NO: 40279 - DNA, 44286 bp, Oryza sativa
  unsure (1)..(44286): unsure at all n locations
cgtcgtgcacgccgcgccgccgccttcgagccgccgcgccgccgccacgaagccgccgcgctgtgccacgccgtgcgccgtcgtcgccgccgctgtcggtgagccgctgcccccctgtttgtcaccgtgccgccgggtagagagagagccaagagagagagaggaagggagaagccgagggagagagaaagaaaagaaaagagaggaagaaagaaagaagccgggagagagagaaagagaaggaaaaagaaaagaaaagagagaaagagaaggaaaaagaaaagaaaagagagaaagagaaagaaaaagaaaagaaaagagagagagaaagaggggaaaatagaaaagaagaaaaggagaaaatagaagggaagttaggggagagattaggaggatataggaaataaaaatggtcggggttaatcatagattatttttggaaattcctagagtgtaatagtatttcgatcgaaattttgggttaattataggaatatgtttcttgatcggattagattaaaaattggtagtaatttagatgtaattaataactaaacaattagatgaattcttatagattattatagattatttttggtaatctctataagtcatcgattcacggtaggaattcggatttaatttttaggaattttagccgtgtattatatttaatcatttagtcatagactaaattaaatcgtacaatattataagataattttaggattttgtccgatatttagcttgcgatagaaatttctaacctattatatggatataatgcccgggtagattaaattaaaaacttatggtaacaaaatatttatacccgcaaaactagtttaggatgtataaatcgaaattgggtttgccctagttcgcgaatagtaaagttaatataaaagaatcaatttttgcattcgacttccatttggatttacttggatttttatttgaattctaaccgaatttaaatcaattttctcacgtaactataaagcccgagaagcccgagggagttgcggatccaagtgaaggccaagacccgcaagactttgagcaaggcaagtcatcactattccttgaacatgttgatcccatttacaaaattattttgtttacaaataaaattacatgcaatgatagacatcctacttgtgattatgccatgccttgattattgtttacccttaaatccttgtaaccgtgatttatgtataagtccctagtcaactatgacaaatgcttagaaatgctactctagatttatgcatactcatatttatcaaaagctatatgcttgggcaattacctttgggaagggaattgagatgcggcatgtggagacatgagcgccacattgccatgatgttgatgacatgatttgtgaaaggagaaataaaattaaataactgttttcgactggggcggacggaggatttgggtggtatccggaaaaggctagtaccgtccccggtcaattaaggaccgagccatgaagttaagcatgaaacgacgcccgtacaaccgcacttctcgtatgggtatagacctagcggaatatatagctgagcggaggcagtatccatgcatagtggtttcttgatgtgtgaggcaggggctctacggtggggcagccattggtagaaccgcgaggcgggtgtctacagtggtgtcgccatcggtaggactgccatgtgagaatttaaacataattataaattaattaatgcatgtgtgagtcttttcttcccgggtgcgccagaactcctctcactgctagaaaccgtgtacgcctagagtgcatgaggatgtgaagttcatggagcgggtactgccaatgcgaggttatcgaaaagctttgccatgacacgtctcatgtgttgggacgaggctcatgtgttgggcagtcgcggagtacgggtaaagtgtacatccactgcagtgtgagtaaatcaaaactattcgaatagccgtgctcgcggttattgagcaccgggacgtgtattacacttggctagactctaaattcttaatttgtgtgggatgggatattgcatgatgatttctttgctgatggagccacttcctgagagacgggaatgtggacgtcctcagaaaaccatgacgactcaatggcgggaagctatccttgggatcaccatggatggtggacagaaccgtcattgtttaatatgaacactggtactaaaatttgatcagtctgtgctaggtcttaggcttgtgaaaagaattacaaaacttgctttgcgcaaaagaaccatagccatcctttgaatacccttgtcatatgcattgttgctgtggtggcttgctgagtacggttggtactcacccttgcaatatacaaacttaatcaaaggtcggagatgaagcttcggaggatccctacgcttactaccaggagggtgatgaagacgatggcgctcagtaggtcttagttacagtcgttgcctatggcaatggcgtgccgctgccttgactccgctgccttacctacttctgtttttggaatgtattccggaccgcttggtccgatgatttaagactatgcctgcgggcttatgatgtaataattcgtattagacactcgtgtatgtgcacttggtatttcagctatgaattcatgtgtaccaaactacttgatccagggaaatggtacagtttacatgattgattcctgttataaaaacgggggtctacaaatggtgaggatctggaacggagggaatcacctcaacaagctacccctctacctcgcggcactggcgatcttcgagatcaaatcaacggccgccgggaagcacgacgcacacgagacaacgtgaatcgctctcggagtcatgtctcttcacggcgccatgataacggaaatcgaggagatcgctcaaacgaggaccgggaccacgacaaccaccacgatcacaacgatcgcgaacgacgggtgccagacaatactggtcatggtcgccgccgtatcgacgacgacgatggagatcggcgccgagacaacagcggaagacgacgacaggattcccgggatccaggccgtcatcctcgtaatcgtacaccggaaccaagcgacctatcgtcatcgtcatcatccgcgtcctcctcatcgtcagacagacatccacgaaggacacacgaccgccggcaacccactgcccccaacgctgggtgtagggctttcggtcgttccctacgtgatgtccgatggcctgagagattccgacccggagcaatagaaaaatatgatgggagcaccgacccaaaggagttccttcaagtctactccacagtactctatgctgccggagcagacgacaatgcgttagcaaactatttaccaaccgcgttgaagggttctacacgttcatggctgatgcatcttcctccctactcaatctcttcgtgggcagacctgtggcaacaattcatcgccaatttccaaggaacatacaagcgccacacgatcgaagacgacctacacgcgttgacacagaacttgggtgaatcattgagggaatacgttcgacgttttaacgagtgcagaaacacaattcctgaaatcaatgcttctgtaattcacgccttcaaatccggtgtcagagatcgctacactacccaggagttggcgacaagatgcatcacaaccactcggagattattcaagatcgttgagcgatgcgcccacgctgatgatgcgctaagacgcaagaacgataggccaaagaccgggggagagaagaaaccagccacggacacatctgagtcaagcaagaagaaaaatcgcaaaaacggaaaaggaaagctcaagcggaagtcctcgcagtagaatacgcgaaccctcccaaacgcccagacccacaaagcagcgacataaagaaatcatggtgctccatacacaagacggacagacattctctggaagattgccttgttttcaaaaagtcgctcgagaagcacatggcatttgaaaaaggcaagcgagtacgcgttgtcgagacgaacgaagagacggctcctcacgaaccggactcagcgtatccagactccgacctccacgtctcacacatcttcggcagttccacaacgtactcctccaagcgagaatacaagaaagtggaacgtgaaatctgtttgacgtggcagggggctgcacccaagatgaagtggtctgagcagaagatagagttctcggaagaagaccaccccaagaccgccgttatcccaggacgatatccgatcgtggtcgaacccgctattcggaacatcaaggtagcgcgagttctcattgacgatggcagcttaatcaatcttcttttcgccagcactttggacgcgaggggaattccgcaaaacgagttgacaccaactaatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcattgggagaactgcacttgcgaagttcatggctgcatctcactacgcatatcaagtgcttaagatgccgggaccgaagggaacaatcactattcaggggaacgcaaagctagcagtggaatgcgacaagcggagcctcgacatggtcgagcaaacgcccagcccacacgccacgactgagccacccaagaaagtgaccaagacaaacaagacgccgaaaccagatggcgtcatcaagattgttccactctctagtgccaaccccgataagaccgtcaagatcggggcgacactaaatgagaaataggaactcacgctcatcaccttcctccgcgacaatgccgatgtgttcgcttggcagccatccgacatgccgggggtccctagggaggtgattgagcacaaactcatggtgcgacctgatgccaagccaataaagcaaagactgcggagatttgcaccagaccgaaaacaagccatacgagaagagctcgacaaacttctcaaagctggcttcatcagagaagtacttcatccagagtggctagccaatccagtcatggtacggaaggccaacggaaaatggagaatgtgtgtcgacttcaccgacctcaacaaggcgtgccccaaggatcactttccacttcctcgaatagaccaattggtggattcaacagccggttgcgaattattgagcttcctcgacgcttactctggctaccaccaaatcagcatggcaaaagaggacgaagagaagacaacattcatcacgcctttcggggtattttgctatgttaaaatgccattcggactgataacagctgggaatactttccagcgcacggtccagggcgcacttagcaaccagtttggcaacaatgtcgaggcttacgtcgacgacatcgttgtcaaaaccaagacaggcgactcattgattgacgatctgcaggaaatgttcgacaacctccgacgatatcgcctcatgctcaatcctgagaagtgcacgttcggagtaccgtcgggcaagctgctcggattccttgtctctggcagagggatagaagcaaaccctgagaagatcaaggcaatcgacaatatgaagtcgcttacaagactcaaggaggtacaaaagctaaccggatgcatggcagcactaagcagattcgtcgctaggatgggagaacgaggacaacctttcttcgctctgttgaagaaacaagacaaatttgtatggacacgggaagccgaagaggcattcattgcactcaagcgctacctatcaaacccccctgtacttgttgctccccaaactaatgaagaattattcctctatattgccgccacgccacactccgttagcactgtcattgttgtcgagagagagaaagtacagcgaccagtttattacgtcagcgaagctctccacgacgcaaagacaagatacccacagatccaaaagctgctttacgcaatcatcatgacatcaaggaagctacgccactattttcaagcccacagagtcatagttgtctcctcttcccctctcggtgaagttgtgagaaacaaagacgttgtcggccgcattgcgagatgggtaatcgagctgagccagtttgatgtccactttgtgccacgaacagccatcaagtcccaggtactcgctgacttcgttgccaattggactatgccagataacaaatcagacaaccaaggcgacaatgaaacatggacaatggcgttcgatgaggcactcaacagccaaggaactagggcaggatttatcttgacgtctccctccgaagatcaattcaagcacgcaatccacctcaacttcagggcgaccaataacactgcagaatacgaaggactactcgccgggatacgagctgcaaccacacttggggccaagcgactaatcgtcaaaggggactctgaactagtcgcgaaccaggtacacaaagattataaatgctctaattccgagttatctaagtatctcacagaagtcaggaagctagagaaaaagttcgatgggatcgaggtccgacacgtctacagtaaggacaacatcgagccagacgacctagcacgacgtgcatccagacgaaaatcgctcgagcccggcacttttctcgatatcttgatgaagccatcggtgaaagaggttagcggcgaagtcagcccgaacacccccgacattagctcggaggtcaccgaggcagaacgcgccgttgccgacatcgaaaccacagacgactggcgcgtcccactaatcaaattcatcagcagcgaggagttgcccgaggacgatacagaagccgagaaaataacccgtaaagcaaagatctactctatggtcagcaacgatctatacaagaaagcgctaaacggggtacttctcaaatgcgtctcgaccgacgatgacagacacctcctcctcgacatacatgaaggcatatgtgggtcacacgccaccggtcgaacattggtcggcaaagcttttcgacaaggctttttctggccaaccgcccttaaagatgcatgtgacatggtccagcgatgtgaagcctgtcaattccacagtaaacacacaaagctacctgcgcaagcgctccagactatccctctgacttggccattctcgtgctaggggctagatatacttgggccattcccatgaggacagggcggctacagattcctattcgtggcgatcgataaattcaccaaatggatcgaagcagtacccacgggggaaatcaaggccgacaacgccatcaaattcatcaaagggatattttgcagatacggactaccacaccgcatcataactgataacggctcccagttcatcagcgctgatttccaggactactatatcgggctgggggtcaaagtatgcttcgcctcggtctctcaccctcaaagcaacggacaaatcgagagggcaaacggcatagtactacaagggatgaaaaccagcatctacgacatactcatgtcacacaacaaaaggtgggttgaagaactcccgtcagtactatgggccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgggaacgagttgccgtctgagcagccagctatcaacagaccctccgctgttatcacgagaagcgcatccgtgcacgcatactttcgatcggcgactatgtcctccgatgagttcaaagccaagcagggcgaaacaaactctcacctaaatgggaaggaacttacacgatcacacaagtcttgcggccaagcgcattcaaaatcgcagacggcgacggtcgtgaattagcaaattcttggaacattgaccaactacgtaaattctatgtatgagtcaatatcatccatacatgtaagcacccttacagtatcaataaaggctatttctaggcccatatcacaatcaacgtgtttcgcccgatgatcccccactctgatgacacctagcgttgaaacctgtccttatgtccctttacgccgtctcgacaaggcctccgaggaacctaagggatctttggctggggacgcccaaagccgataaggccttgtcagatcctgtagagacgaaagaccatgtaagatcttgtcgtgtaagagttctcgccgtgcgtattaaccaagccgtgaaatcggaaatcaactttccaacttcacggctgggggctaggatcagagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagaggcatttgtcaaagatagatttctttattcacaaaatactccttacagttttttcacaaatcttttgctacattacatctttttcctaagatatttgtcacaaggtacgagtactaccaagagggccaacgccagtccatagactggaagatcttttcggccaacggcgacattgaccttgccagatggtctatctccgccgaagtcctccgagaacgagcaaaacactcacgaaggtgttcgagctccaggtgcgggcgataatctcgtaggcaagccaacacgtgccccccggcataccggctcgatcgacgacactcctgcttcaaggcctcgtcgatacgcttgtcgattccatcgagttgggcacaggccccattaagccacgagatgtacccggccgctgactcctcgggatctccgcggactacttgaagctccttgcatactctggccatggatgtgcagcaaatcttcaagtacgagttaaaccatacctcacggcctcggagcgtttccacagcctgctctttcgtcacggccagcatggttctctcgagctccgccacttcaaacttcgtcttccagtattggatacgacgatcttggctagcaagggcaccctcgatatctgctaaatgtgataaccactaagtcaagctgtacatctcttttggcaacatggctgacctagtcaggtgggcattaaggggtgaagggactactaacctgaggaagtcgtcgccatccttccctctatatcaaggggttgatccacatggtcaggcgagacgtgtggttcgaactcgaataccggaattactgccagtgactcgggctgcccacgctgctggacatcctcgtcatcagtatctctacaagaggacaaaagttcccgaggtcagcatactaaagtaagccgggatagtaatcgcatgcacaaagacggtcagagttcgagttttacacattatctaggaaatacaagaagtcctactcttcaaaaagggggagaacagactctcccagatcaccgatttcttccatcacctccttacgcgtgtcgctggccgccccctggtccaagatctcgcgcagatcaagttcaggacgcgacagccttacacacgcgaggacatgacacgccccggtgtagattccgtttgacgtctcctccgcaatcctagctgcatgcttggaggggatttcccccattgccgtcgccagttccgcgagagaggaggtcagcgaaaactcatcgggattcgccgggatcgtggacgtgacgccgcataccccggcgagctggtgaaggccggtgtaggtgaccctcaacgagccccggatctcagataggttgttcccgagttctgacattcggtcctcgagccccttccgttgtcgctcgttgccggtcgccaactccctcatcttcgtgaggtcttcacgggctttagccaactcgcgcacaagtctgtcagcgcgttcgccgtcgccgcttccgacctcgcctccgcaatctcgcagccaatgccgcgagcaccggcttcgaggaggcgccccatctcgacttggagctcctcccaggtgaggactgcagctggcagatcacgacctgccgcggggtcgctgactgggccactaggcgtcgcctcccagctcccggctgcgggcatgacatccgtcgaggccacaaggggcgacgcactagaagctcttccggacttggctcgcgcagcctttgctcgcgcctccctacgggacgaccacgagtcagacaataagcgaataagaagcgcggggattcaagaattcatctacttacttctcgccaatcgtcacaatgcgttgtcgtcgtggaggtgggggagatgcatccgaggcctggaatacaatcaacgcaaagtaaggaaaaatccttcttgctgcatgatttaacgacaaaataaattaccgagggggtcgacaccatgcgacgttgtccgcttacagacgagaatttcctcggctttatcggaacattgccaccactagtggtggcagcatcagatacctccttgacggccttcactttcaaagatgacgccacctgatggtccgcgagcggtccgatgatatcagtcaaaggaagggcctacgctcaatcaagtcataaagtgatttcgaaaggagaatgcgggatgttcaccaaatatacttacgttgatggcttcatcacgttccgctgcccccttttcacaaaggggcacagggatgtcactcgccgtagtcgggccgctgatcatcacttggccgacgcggcgctccacgttttcgccgctcagacctgttaatcgagaaccaaccttcgataagtcaagaggaatgcggacacaagtatgtcaagatgaatgcgagaaagataccccgaggagaaacccgggtcgcgtcctctggcccggaatagttataagctggatgggcccgagcctgaagcggctagatccgcctaccaacgaagtctgcaacgacttcatatcccgacaaaccctgtactcagagatcgtcgatgatgtcgagaaacgactgaagagagggggtcaaggggggcttggcggtccaagacggaatcttgtccggttgatcttcgggaaccacgaagacagggttcgagtccttgatctcaagataaaaccacctattcctccacttgctgcgagaagaagggcactggaagggaatgtaacgcaacttcaggccatcccgaagtcggaacccaacgcaaccagataccctgttggattccatccaacgcagttcgtagtaaaagcaaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggaggagggagaaaaccgcagagaacataatcttcgatcgcaaccatgcgacccaagatgggctgaggattagtacctcctacttccctctccatggttccacagccaggaagagcgccatcctcctatagtttctttaacgttgcactggtggaagccgatttgccgaggtccattgctgatcgaaggtcgccggaaaacgagcctagattgatgaactagggtttcttgcggcggcggagaaggcaaagagtgcttgcagtggggtgtgtttaacaggtttggcggacttcaaaatggactcccaaaattcctttaaataggcgcactaccgacggtgcgaattccagggaatagagagagatgcccgccggaaatttctggtcccattacacgcggcggttttttggacttcagtttaaaattcgttcgtgaccgttgggcttcaaatggcgtgctcgactacggtctatctccgcggtcctcgcaccgggaatgacaacagtctcgacacccgaagtcgcaaatggttgcacgagttcattttaagcagaagttgggggctactgtcagggttacaggttaggcataccctttacccttcgatatacgtcacatatcggtatggtatacctacacgcatacggatgcttcccgcgtactctaaggaaatccttcacagagtctatagatgggaagaatcctactcggacaagattgggtcgttaatgtatcgtacagggtctgacatctccgagttctacttggagacctccagatctgcgatataaaagggaccccccggggagggcctaaggcatcgaatctcagagccagcacaacccacacagcctacgaagccagagcctgcagggagccaagtcatcgggatctagtcgaaccaactcgactatgatctcgccggatccgacaagttcccttgttctctttgtaacctgtgttttctaccatataatcccacatcaattggattagggctattacctatcaaggggcctgaaccagtataattcttgtcttttgtttgcttgatgacgtactacgtagatccttgtaccaatgtaccccaataccctctatatccggtctacgggtatcacccatcgacagacaatgcccccctgaatcatgcccgatagggttagcgggcaaatctttctgcccgtaccccgatggatacccggagagcacccgacgctgacgatctgagaagtgcctgtcattgcttgcatcatcgctcgccgccgccgagactctactgatgctgtcgataggagagttgactacctgccgtggttgcgttgccgactctgtcgcctgctaagccccccgccgtcattgactccgctggtaccgccgcttgctcccgccacttgctcgtgctaccactgccctgagagccgccattgttcccacttgctcgtgcattgccttcagccgccatcgtcgttgcttgcccccgcgctaccttgagccaccgccatcgtcgcttgccggcgctgcctccacatgttcctttgctaaatgtgctgtcgtcgccactgcgttgaagtgaggtgggatgaaattaggttatggtttgatgttgttggctaatgggccaagagagagatgagaatgaagatatgggccaaaatcaataatacatatatcgggtcgggtatgggttatccgcgagtaaaaaggtaagatccggctgctgcccactacattatcgggtctcgggcgtgcatgcctaagggtaaaatattgcacccatgcctgtgcccatctggtcgggtaaccgcggatacctgaacccgtgagcaaaattgacatccctaattttattctctagctgcttttcctagctttcgtattcatgtgaccatgcggggtctcagtcagccaaaaaaatccaccgtgaaaaacagtcctgggggtgtaaaataaattaggtacatcatgtacggaaactgctatttcgcggctagtcgcgcgcgccctccccagcgtgactggacacagcgcgcacggggaggagggtggcagacagccgctcttttccttttttttttccttttcccgtttctattgtttcttcccctcttttccgtttctttttcgctttttcggttgtttttttcctttctttcgtttctttttcttttttcggctgttatacaaactatgtatacacatatactaagtctgtatgtatgcgtgtacaaactttatatacacatatattttttcgttttttaaacatacatatataaaatatacaaagtttgtatagtttgtatacatatatatatatatatatatatatatatatatatatatatatatatatatatatatattgtacatcaaaagcatatgcgaatacatataaaaaatgatatagaaaatatatacaaaatttacacatatattttatcgtctatatacgtgtgtgtatatatatgtatatatatatatatatatgtatatgtatatatatgtatatgtatatatgtatatgtatgtatatgtatatgtatatatgtatatatatgtatatgtatatatatatatatgtatgtatgtatgtatatatatgtatgtatatatatatgtatgtatgtatgtatatgtatgtatgtatgtatatatatgtatatgtatatatatatatatgtatatatatatgtatatatatgtatatatatgtatatatatatgtatatatatatatatgtatgtatatacatatatacatacatatatgtatatacatacatacatacatacatatatgtatgtatgtatatgtatgtatgtgtatgtatgtatgtgtatgtatgtatgtatgtatgtatgtatgtatatgtatgtatgtgtatatatatatatatattatatatatatgtatatatatatatatatatatatgtatatatatatatgtatatatatatatatatatgtatatatatatatatgtatatatgtatatacacctcatattgtatgatacgaagtttatacgtacatatttaagacatatatacatacctatacatactgagactagagggctagcgctggtcgcacgggcgtgccggcgcgatcagccatcccccatcgtatacctgggcagtgctgttaatgtccgcgaattaaattcgactcatatacgaggaacctaatatgaactttattttcctgttgcgagtgtatcccagcccatgtaagacgcccgtagcccatatcctatctcaaagcagtcagcgcaggcccgcatgctatcgcaacgtgcgtcctcaatccccttcgccttcccgtctgatgccacaaatcaaagccctcatcctcttcagttcaccgtgaacaccatctatggtggaccgtgcacggcctggccgattcctctccaggagtgaaaccgtcgcaatcaaagtgcagccaacaagtgtccgtgtttaattcttttcacttaacgtatgcttttattcttcaatccctgtatatcatcgttgacccttatacttttatcaagtgtacggacttactccctccgttctataataattgacgttttggacaaagttacggtgaaatttttataactttagccatcaataactttaaaaatatttagtttagagaaactaaaacaacatatatagatttgtttttcaaagcaccataataataaaagtaaacatgcatttatttattgtatatattataatagaaaaataaggttaaaggtatattttgtagaccgtgttattattcaaaacatcaattaaaatgaaactggagggagtacctgggttagcagctatcagcctatcatgccctcaccaatttagcacgacctagctccctccgttcttaaaaaaaaatctagtactccagattcatagtattagaatatatcacatccagtactagattatttttttatgaaacagaaggagtatgcccccaagaacaggcacttgcacttctgatactcatgtaggatgtagcttatgacatatactttgttggtactttgtccccagtatacttacatgatcttttttaatgattaattgatcatttcctacaaccagctctcatgtatattactatcctatctaactgactatatacacaatgcagtgttgggcaccaaagcaatatctggccatgacaccggttcacagccgtctgtcactggccctgtttgatttagcttaggattattataatctggattattaggagtaagctgaaataaacaagtagattattacgatagattattataatctataagccagattactataatctaataatctcctatggatgagctttttccagattattaggtggctaaagacccactacccttagatgccttcaataatccagagaaacaaacaactcacagcttattttatgttagcttattataatccagcttagagtaatatgatttaataatctagattataataatcttaagctgaaacaaacaggccctaagtagcttctaactctatagtagattattaatctattagtttcttttcactttcatcatatacgcgacatcaaccatttcatcactaacttatgctccgagagccacctacaacttatagcccataacttttactcaaatactccattcatagcagttcaatctagaagagtagcccgactatcattcctagaggattgtgcgatagtgtaggggaatactgagaagagggtggaataatttaacccataagggcccctttgaatcgtaggaataaaaaaacggaggaatagaaaaaacatagaattctgacaggaatgtaagtgtaaaacagaggattgcaaaacacaggaaaacgcagcaatgaatgtttgattgggccacagaaaaaacgtagaaatcggatgagagagatatactcaaaggatttttactacaaggttgaacctcttgctaagtttcctccaaaaactatatacaataagccattccataggaattttgtaggaattagaaaacttcaatcttttgaatcaaagggctacatagaaaaatttcctatagaattttaatcctataaaatttcctttgattcaaaggggccctaaaagtgtggaactgctttagccaggttcaaactagaaagcatggaatacttcttctttttttcttttttgaaaatccaagtttaaaaccaaacaaacttctcagaggataaatggggtcctctcttatcgtgaattcatatattccttatggtgaatggggctatctcccgagcgtgggttgaggttcgtcatcactcatcaatgaaaaaatggaacacttaacagcattttttttactcgttttagttaacatatctttgtacttgtgcttattgtctgatttatgttaatgcatcttcttaatatgtctttgagcagctttgttttcgtgccgtttcgaaaggattttcataatagtagagagctttcagatagtgattgacgttgatataaatttatcaacaatacgcacaacaaaaagtacattctaagtgaaattttgattggttgttgggaattcaaatttaaaacaggccagttcaactaaaatttgattgaaattcagaaaaaagaaatcataccattgagactcgagattcgacacttaatcagaaaggtgaacctgagagtaaatatggttcactgacaagtgaaaacacgcccaatatataaactaaaaccattggacaggttgagagggttttacaaaagggatcattttgcccatcgaaaaccgccccaacctgctcagaaaaaaccacaccccatatgttttgtcaataaaattgacaaccgatcaccgatgaaaaccaccgaaactcaaataaaatttgtcaaaatttctagtttaacttcttcctaattctgaacaagaacaagatcgataagactgataaccactcaatcgttgcatgttgaaagtcgagtcaactatataaatccaagtatccaactctctccacggataataaacccagttgtccatcaacatgactggataatgacgagccaacatgtataggttttgtttggaagagctcgaaattccaagaagtagcttggatcgtcccgtgcatacctctgctctctgacgacctagactggtgaatgaaacatccatgtaaacacattttgatgtgccgatcagagttgcatagatcaacatcaacatggaaaatacgttcttatatcctgtggcatggtagggataaaccaaagtacgatctgggactgatctaatccaatcaaattcatgatgaccttgtgaacatctcttgattgatcaactctgtttctctgaagtttcgaagtttccatatgatcgacgcaattaaagatagaattgtatcgagaacgaagcacaaacaaatctacagttaaaaaagatcaaaagggacatgcatatgttttaagcctaatgactctctctctctcatcgctaatgacgaagatcaactcagagccacagggctcctgcctgcttcaagaccggcacgagctcgccggccatgtgcatggccatgagccgatcgagcccgcccaccagcctcccgccgatgaacaccgccgggaatgccaccgccgctccgccgcctccgtcgcccgccgcagccttgtcgccgccgtccttgcgccggcgggcctgcagcgcggcgtcgacgagcgccgccgggtcggcgtcgtcgccgacctcgagcaccgccgggttcgcgccctgccccagcagcaggcgccgcgcgacgtgcgccatgcagcacccgcgccgccccaccaccacaaccggcttctcctccaccgccctccgcacctccctctcctcgtcggccgccgccgccgccatcgccgccgccgaccttgctccttgcatttgggagcgaggaggggatcgatcgcgcgcgcgcggggcggcgagtgatcagggcggtggtctacttgtcgaggtgtgaacgcgtcgtggaccgaagcgaccgctcagatatggagccacggatggttaacttggttaggtcagcctccttgtcttggtatgcaccaatgcacataaaacatggaaatcatttgtttactccttaatttctgctcgatctgcttcattggaaattttttttggaatatatgctattatctggaaatccggccattaaacgttgaaaacacggaaagtcattaaagaaaaagatatcacgttgtgagaatgatttgctagattgatggacattatcacacaggttttgtatttgggttgaatatgtatgcattttctttcttttttttaaaaaaaaaagaatgtgagattcaattgtacaagtcgatactacgatggtcaggtgctacttggttcaaaaacaaatggaattgcctagttgtactacatatgcaaggtcagcaaaactgttgccaccgagcaccagggtgttagcaatcgtcactgccatcatcatcagttgaaaactcctcgtcgtctactcgtcttcgctcggcttgcctcggtgatatccatgtacagtatgtgtggtgtgtgtcacatgtgcgtaattatgtactactagtccattcgtttcgtcatcagtgatgcgttccgatccatctcgtacttaatgacgaacatgtcgtcttgactccactagacccaaagtacagatcagcaggaccacgtagatcaatacgtagactctacttccaaacctgagtacataattagtactttttttctctctcaaacccataccggccagttcaagctatggtacaataaacgcatgtaaaatgtttggcaagtcaatctttttttttccgagtttgggtcgtggcaactaatgagcaattacacatttccttgcatagctagaagttgatttttttttaatagagggagtagctagtttggtagcgaagtcgttcttaaatttcgttccctcccaacgtgcgcataacaacatcttcaatagcattttcaaatcagactctccaaacactcatatagctaactccccatctgatttagctagtcaaactagatactcactccaacagatcaatgctctccaaaataacaacggacccacatgtcagcctctactcttcttcctctctctcccattcttccttatgtttccttcttttcccctttccttccttcccgtcgatcacattgttgccgacgacggccgacgcatggcgcatggtggtgcagcgacgcgggaggtggaaggcagaaggcggcgcggggaagtgggaggcggcgctgggaggcggacggcggttcaccaacgccgacgctgccgaggtggtccccctctccccgccgaccactccccgcagctgagcgccgttgagctcccctcgggttgccagatctagaggccgccgccgcgaggtgttttggctggccaaatctagctagccagcgagcgagtttggccatccggttggtcagtctgttggatctcttttttgtgcttgaatggccaaaatttggctggagagactgttggagatgccctaaggtcgtctggtccttggcatgtgatgtgcactagggtttccgatctttcaaaaggttctgataaacaacgatttgggcggagtcgtaacaaaaatcgatccagcttcttgaatgcgcacgctcttgagcctcgcaatcgtagcaccacgtctcctctggttatcacccgtgtcgaaacgcggatgacctcgctgagaaggctaatccctgtttgccaatcgaagaacacaaacaagaacgagatagaaaacaaccaaaattgcagatgaatgattaagctcacgagttggggtcttacaaaccgatctagcgacgaaactgttctcgacagaataatctaagcaaaacccaaaaacctaaagatggcggcgggtactgatatatagagtttagggtcgtgcaatcccctctcgacgcaaccctaatgggttccaacacgatacacgggccaaaggcccaaatacggtgacgcagcaccaggacagattctggacgtcaacttgttcggtcaattcccattgacccggagagaatttggacgtgggaccaaaaccattggaaaggttatcttcttagctttccatccatataaagaacgccccaatccgagcatgtatgcgacctgagcgtccgttttagtgcagactagtcctggactccgaattgcactcgacgtcgacttggtttgggcctccaccttgacttagacgtccttgatgatcctccatggctctaagtccttctccaagtgtcttcttgtctcctccattatttctaagcacaatataatcattaggtaacaatctattctcgaattcatacaaagaagaacataggagcgagctcgtctctaaattcaattgtcgcgcacgagctcttgttatcggttcttgaatgaccgttggaggattgttgtgtgtattcgaggtaatgatgtccgcagcagcatgtgacagccaatgcaaaatacagtgctttattctcgattcatctcttcagtcaatctctaattatacgagactgaataaatgtgttggtcgtgcaaaagcggccaagagcagggtggtgtagttcgcctattgcgcgttccgcggggtgtacacgtctcaatagggatggagctatcgtccggctagcccagacaatcgccccggctcaccggtgaaaattccattaaatattactaatacttttgaataaactgatcaggaaatttctatagcaaatgtagctatagtgaaatttgccccgtttcaaaagtttttctaactccgccacaggtctcagtcaatgtgcgcgtctgtggcaaactggcaatgtggcatgcatgcagctggaggacgacgacgatgacgaggaagcgcgcgtgatgcgcggcgcgccgcacgtcgtcagggcccggatgatcgatgcagcgtgatgcagagtgcagggtgcgcgccgacgatggcgagcgctcacctacctagctaccgtgtgtttcgtacgcatatgtggctacctacgtacgtcgtcgtcggtcgctggcgtacggtgtgtgcgtgtgtgcatctcgcatgtggcgcgtaggctggcgtcgggtctttatctgtacacataggcgcggcgctggcgaagaatgaagcggccatcgatggggatcgatcgatcgagctgtaggctggagcctgcaggatgcatacatgcgtgcagtgcacacatggggagcgacttgcggacggtcggcatcgatggttaagaggcagcatgcaagcgaaggaccgaattaaggggccccgtatggaaattttgttgctttggttggatttgatcatctgctctgttttaatttgccggacagaatgtgctgttaattcttggatccccacctggactcctggagaaaaggagtccggtccaacaattcggccctgtcgtcgttgctggcgaattttcagtgaagctcatgagctgatgtacgttggggtgtgggtgatggtgttgtcattcagtatttcagtgtgcccgttggttttgcgtacgcctacatatacattggttttggcttgtttgcctccatcgtttttctctcaacttttgttattgctggtccaataaaaccagtatctctatacagagtgccatgttagaacgtagaaaagggttctccaaaaatttctcaggacagtacatataaattataagaaaaaataattcaaccagggtcnnnnnnnnnnnnnnnnnnnnnngttggtcttatgagccgaaggtcgcgggttcgagccccgccgggaccaatttttgctgaaaataaatgcaaatcataatattgttaaatacattttttttgctgaaaataaatgcaaatcataaacatctgtatgaagttttttttattatttaatgcaaattaaaataagtttttgctgaaaacgattgcaaatcacaaacatctgtataaagtaacttctaaaagtatttaatgcaaattgcgaccaaattttgctgaaaatgaaaacaaaccataaacatctcgggtgtagctgcttgcctcttcggcgaactatggcagcgaggtcgaggaaagaatattgttaaatgcaatttttgctgaaaataaatgcaaatcataatattgttaaatgcatttttttgctgaaaataaatgcaaatcataaacatctgtatgaagttttttttattatttaatgcaaattagaataagtttttgctgaaaacgattgcaaatcacaaacatctgtataaagtaacttctaaaagtatttaatgcaaattgcgaccaaattttgctgaaaatgaaaacaaaccataaacatctcgggtgcagccgcttgtcttatcggcgaactatggcagcgaggtcgaggaaaggcggcggcacatgtagggaggggagcaccgtcatcggacgcctctctgccctggttgctattgccaggatggaagccaccggcttcaagggctaaattgacacagcggtagtgcagtggaggaagggagaaagaggtcgcggtgaaaagggaggatagaggactactaacggtaaaatttggcatattctattgagtaaggagaaagcgcagagcggtattgatggcgtgattttgggatccaaagttagaagattgcatcagctaaagcgtatcggcggcagagttatgaaagttgccgataggacatggacgataaccaggaatcgaccccttgtcggactcggtatgggaagatttggtgacgttaccaaggggaggtcgagttctcgataaggatacaacatcttaacttatttattaaatagattgagttagttatttccttttatgttttaggaaagtttgttttatagttcgattgggcttgtaaattttttactttatccttaggaaaatttgagttatatccgataataactagtatttacttatggtataaatatatacatacagagtctttgtaaaaaacaacagttcaataatcacttttcggcgcattcctaccctagtttacaaggttttcatctcaacgagttcttatattcgagttgaactgtatcggcttagtccgatctccgacaagaggtgagttccgtcaatagtttgcttgtatcggcgaggctagggcttccatcgattaagttcgatactctaaatcagtcgatacaagcgctaatttatcatatacattgttcaatctaaattaaacaatgttatttacccatatcaggtagttcaactcagggccaccttctattgtctaaattactcttgtaaggtttttttagatcttacgatttctatcacagcttggtgctgcatcagttagttttgacctactaagttgtacttgaaattgtaagaactaatttgctctttgattgtcgatagggtcaccggggtttcattcggtcttacctgatataactattctgatttactgtctttgcttaatatattatatctatcatcttatctaagactatcaaacattcaaatctattaagcttgtaattggtcccgcaacatatcagttaagtccgatatgttgggattaagacttgtttagtatatttaactggaaacatgatatctgttgtatcagagttctagctgatatgttatctctaagaacctaagttacttcatcagctatgatataaattcatatattaatttatttcctcttgagtacaagcaactaatattgtctcggttaggtccgatctatctcgattgctcgtatttaaggcaaagatcgaattagtaattgcatgataattacctctaccgccgattgcaagtaatttaggtctaatccacaaacatatgttcatcgactagttatttcagttataaaattattctatgattgactttaactttattaattttatgctatataaattgtgtttgacatatattattgatttttctaagaaaaagttatttataattatatgtaatctagatctagcttatgaacaagtatccttcatatttatagccaattcatttgtacaatagtttacgcgatacaacatcggcctatcggctgattggctatcatttactaatttttgctattgtctatcttattaattgcaggatcacaccaaccggcacgcctttaaaccagtagttttagacctgcattaaagttaagcaattttttcagagcatcgtgttttgcatcaatgaggacacggaacgtgcaaggacacgtgagcttagagcggtgccagcgacaatgctccagttccattcatgtcttcttgggctatggcggcagaaacgagggagctcagcagcattgggcgccgccgatcccattctactggactgctgccactgccgggcatgaccatccctgtgctccttctgaacggttgaagctcgagcattgttgtcagctaaatatttcctaactaccctacctaagcattgttgccacgtcatcaaataccgtctacaatactgttatagaagtcaatctgtaccggttttaataatttgagtcttccatcccgattttatggttacattttaagggagttaaagtggacttttttctaaataaaaatacacaccaattgcctattgggcctgtccctagaatgggctcagtgggctcgctgcgagcagttacaaaacgggagaaaaattggcgagcacggcgcctccgcttcatccttttccacctctcggccggcgtcgccaaggtttgctgcgactgcgaggcaccccggagccacaaatcctccccgccttcgcgcgagctcgccggggggagagatgctgctggacgagcccctcgacttcgagaaggaggatccgctcctccctaaggcgcgccccgccaagaggtggcaatccgtccccattctactccgctttctttttttttgggtgccgattgatttgaggggttggagtggatgtcaggttttgagttccatttttgggcaattatatttctggcgcgtatggtcgggtctcgagtaatcggggtgggtgtgatttcgctggttgcgggggttcccttcttctgatttttctagggttttaggggataaagtgaaactgcaatgtcgttgctttggctggtttatgtttggtagtaggattgaagtagtagcagtagcactcagtcgatgaatccgtggtgtttgcagaagattcgtttgatgagtggtcactggttagctgacaagatgtgtagtgatgatatatattgttagttaccattggaatcgtttgccctcaaggtgtgtaaatgtgttaataacagtttggtgtaggtagtacgaccattttagagacatatttaatttaccactgcccattttcttttcaggaagaaggttattgggttggacgatcttttagaggatttctttgcaagtggtaaggatgaccttaaagcttatggtattgagtccaagcatggatccaaaggatataattcagatgatgaagacaagaaagtgaaggagaaggagattaagtttcgcaaatttgttgaggagtatgaggagcaggtagttttcaaacaaacatctgttcataaaacttttacattttctatgtatattcctgtctctaagatattattgaatttacagtcgaaagagttggatgctggtgatgatgtgccccaatggggtcagagagtttttggttgccaggttaaatggccctacatttattcagttaatgttgagtgcgacagctaagtgattttttctattttttaaaactaaatatccttatgtactgtgcctgcagaaatccccttctgttcttactgtcacaggagttgaaaattgtcaacttctgaaatcattctgtgcaaatgagcatttaggttttgatctaaacattgaacaaggttagttctgttacgagtgtctaagtatctgacttgcaaaaaaagatgatattatttgacttgtctttgtttctacttgagcttttcttcttctcgactgtaccactatggcataatattcttttatcagtcacttcaacatttctctattgctatttgtgtaggagaagggtttctagaaggcttgttggtggatggatggcttttgaagttggtcctcttgcatggctctgttgaagattctatagcatcttgggcactaaccaaatgtaagaattgatatatgtgtgtttttccagttattattgtttgattaaactgtactgtatgcttaacaccactagctaccagtgttgtactcgtgtaataagaagtttcgagttgctgcatctgacttttgggacagtgttctttccctaaatgaggtaacgtatttataagcaaatgtatggtttgtgttatactttgaagattctgcatgtaaatttttattcgttacaggctgacaaactctcagttgacattggacactttccaagctactctgttctaaagagtgccatactcaactatggatatatatttgataattgcactgaagtttccacctctgaaagtgtgattgcaggttggttccatccaaattgttcttcctttatttacagtttactcaatttttaattcactaattttcagcctcgtgattatgagcattcatgaaaaattcatgtttatttcgttatttctgaattagtacccagtagtttggacattctgaaaattaagcttttcctatttattatttgatacttcagatgatggcccacctcaaaacatcattgaatggttaaaaattacatctgcttgctgcaaaatcaggtaagtggaagcttctgaagctattatacagagattacattgccttaggtgtttctacttttctgtcattcacaaagtctaaaacaaaagacactattacacactaacaatttaacatcaactgatctctgtaacttcatatttgcttgttagtttcaacagagttattttgtgttgtaatctctcaagttttggctaaaacaaaataatcagtataaatttgtgtgttattgcttatatagatgatagctcatagttatattatattaggactggatgtttctagctctgtctgtaatactgatgttatcccagtatgatgcaaaattctgcccaaatctgcggtcactatattttgcgatgataacattctagaattgttctactgctacttaagggacattttagtttcatgattctgtcctgttctgatgttcaggcttccagtgtggctttgttgttccactatttgtgatagcgatgtctttttgtatggtgaatgtaaatctctgtattcatttaatccttctaaaacaataaatattatgatattaaccagtgtttcagtaattctgctattctttttgtaccaagttaattctatttgaatatttatttgatttacagaaatgtgcattccatattctcatcttccgaggcagaagaactccttgttattgttatttccttatttttggaccgacaacttgagggcctgctgcttattttgggagactgtctgagttcacttatcttgtacttcaattcaagtgaatgggaaagtagctgtctaatagtggctcagtccatttcccagaggtaaattttttcaaaacgtcttatttttaagacgagatctgtattggtgatttgtaaccatttaccatttcatggtatactgatgcccaattgaacaagtgctcgagtaatttatgggtgaatacattagttagatattgactaggatgcaataatgctttctcaacaagatatgtcggcgatgaaccttgttatgccgtttgctctacgttgaggactttagcttctgtacaattctattccatctcttgcaatgtttcgtgtacagtaactcatggtattttgttaaagaatagctcacatggcttttgcttacgatatttgcccatctgaaatcaacttcataacattgcagagtcacaatggacctgaattgtttaaggattgttgactgtatcactgggactgattaccgtagcaaattcttaaggagccagctggccctacaattcctcaaagttagctttggccttaaggtaagcatgattgatgagcatgtctcttcaatataccttttggtatggttgtgctagcccataaatttttgtgtgttctgcgtattcaggtggcaaatgttgagaagatcttgaagtcagtcatgtccataaatgtgaaggataaagattgcaactttttcagtctgtacgtatacctagttttgatggataacttactcttctcaagtgatgcctttagagataagcatgcgatcattaattcttggcgtaattatctgcggaattgttcaacccaaataggatgcacagactggagattatatgcctcaaaggtactaaaacattgcattctttcagttggtttttacccatttctccatcttggttataccggaccattttgtttcatccaggttcggaacaaggcttcttatcttctgcaaggtgcggtcttgagaagatctgctggcggtgctagcttacccgttcagtaatttgaacttactgaactggatcaaatggtgctgttgacagtatctatatttaaactactagcaccaaaaactgcatggcagggcaaactttcaggttcttatatttgctttaggaattgtaggccatcttttgtagacaggggcaaaatgctggcagcttgtttatggtatcatggctgacagcacatttggcccatgtatagcttgttccagtatgtggaacctttcaagattttgagacacttgtagctgattagtgattaccccttaccgtcggttttgggatttgccatccggtatggagtgcacgtgcagcttcatcagatagagtctcctcgactgatcgctggaattggtcagattttgcgtgaagcgtggaattcatcaaatgtttaccactcatatttatgaaatattgtcagcattcaatgaatctgtgttaaacaggtcatactaactaatctttaaacgagtctattacaacgtccttgtttggctgaaccgatcttaattgtcagtttctcccgttcaattaaatggctcgtatctcgatgagtccatgttacgttctgctgctgcagctggtgcttaacatggcacaaaaatacggcgagtcggccgcaatcggtgccgattcgagtttgcttgatcatattcatatctgacatctgatgatgcgtactgtatgctgtttgtcattggatctctcgtgttatcggcgccgaactgtccagattccaaacattgtttttggacttgcctgctggtagccagaaaccggcacatggggattggccggacaaccagaggtatgcgtcgccttgctctcctgctatgctagtatcagccaaaaactcctgaacaatggttaggaatagcaacattttcacttgaatcgttgcgtttcctgatccaaggccccagaattttgctatattggcagtaacatggatataaaattccctttttggtcaagattgccttgctctcctgctatgatatcagccaaaaactcctgaccagtggttagtaacagcaatattttcattatgttgcctgatccaaggcctcagaattttgctatattggcagtaacattgatataaaattatcttttttttgtcgagattatatactactcacgttggctcccttggaacctctgaattctgcaacaatttcgtaggaaatgaaacatccacccttactagttactaggatagttacaagcagtggtgttccaaacaaaatttgtgcgagaattcatgagttccaaatggagcctctcagcattatagattgtaaatcctttcatttgggtattaacaaaaagaatagggcggttgccgccatattattcatagatcaaccaaaggaggatatataaagaaaaacaaaaggtgggaagagcactgaacatctacctagatggagtatcaccctcttggattggaatggaatttgcaggcgaaagtaacaaaactcaactactgaaatggtagtagtatcatcgagttggtgcttctggtttccgcggtaaaaaaaaaaaaaactcgtgtgatcgtgtgtctggtccggtcgacgccatgtatcgatccgattttaacactcttgtcggacgttgcacgccacggcctgcgcccacatccgaagctggtccttcatctccgccgccgacctcgcgtccgcctgctgcagcctcatcgccgccgccgccggtgatcggggcgccggccgccgcacgtggtaccatgcctccgacaggtacggccgccgcacggcggcgacggcgtcgctgccggtggcggttgtggctgtgtttgcgtcgtcgttgtcgctggcggagccggagccggtgggggtgggcttgccgcggaggccagggaggacgtcggcgaggctctcgcggagctcctcctggtcgaacacgaagcccaggtccctgaacccctgcacctcgatcgactccaggtcgctcgagctcttccacttcttgtcgtggaacaggctctggtgccggacgagcggctgctggttcgcgctgaacgaccgcagctctcgccgcggtggctgcctccgatggccgccgtcgccgccgcccgacgttctcggcgtccggtcagcctgcaaggatcaatgggttaaactcgatcaatcatcatccatggcggtcaatggcgtttgggggtgggcggtgcgtaccttggtggtgggcgtgtgcgagcggcagtgtctctccagcgtgctgtgggcgtgcctgagcctggacatgcccggcgtcgtggacccggtggcggccgccgccgtatcctcgcggcgggcgtcgtcgtcgcgccccgtcgcggacgacgtgacgggcatcgacggcgcgcgccgcagcgccgacctgacaccttcctcggcgatcctggtgcggagcacgccctcgtatatcgagctccagttcaggtcgtcgtcctccgcgtcggcttcctgatcgccaccaccgcccgccgccgccggggcctcctcgacgacctcctcgtcctccttggcgatctccatcccgacgcgcggcgacgggagcgacggcgtccggaggagcctccgccccgcggacgcgaacagcctcgacgtccccaccgcctccacacctttccccggccgcccaccaccaccactcaccgtcgacggcgacctgggcagcatcggcggcctacccccgccgccgccgccgccgccatgcctcccgttcttccccagcgtgttgctaaagaaccagtactcatccagcagctccaacgccggcgccgtcccctcgccgccgccgccgccatgccccgtcaagctcatgcccgcctgctgcgtggctgcccggcgactccggattggcctcaaagccggggtgggtggtggggtggcgtggcgtggcgtggcgcggcgcgacgctgagctgatcgagagcgatgcgaggacgccgctttcttgtccgttttcactcgctcgagtggctccggttttgttgcgaggcgaggcgacggggtggggcccgcttgcggcggtgggccagccacatgcatatgccagatgacaatgcatcattcatcgcatcgctcattattgattggatcagtaattgataagcttgatatatgtacaaccactgctatctccctttcatattatacgtgattttgattttttttctagtaaaactcctttaaatttgattaatttgtaaatgatatagcaatattttttatacaaaacaaatatattatcgaaatatattcagcgttatatttaatgaaactaaattgatatagtagatgctactaaattttttttataaatttgatcaaacctaaaggattttgattagaaaaaaatcgaaacaacatactaatataaagtggagggagtggctaacaatagcctaatactaccaataatttcatttcgttttcttccggttagttccatctctcgtgcagtagtaccacagccagatgacgtgacacatatgatagttgctaattgatttgttgaaagttttgaatgctggttacttcggcgagaagaaccgaatccggtatagcaacggggaattcagtgaaacgtacagatgcagggaatatatgtttctcgagatgtgtcatttagggtgccatttgtttacggttcaggctgcgaccaaatacatcgcaatcgagaatcgaccacgctcgccatcacgtacgggttaatcaccacgtcattggttagcatctctagagaagtcgccgtctaccatgatcactcgtgataaacatgtacacacatgtgtcacgaaacctagcgatcgcaacacggtgcgagcgctatcgaataatcgatcgatcccatattcccaccacgtacaacgtcacctattacgaactccctcatcccaaaatataatactccctccgtcctaagatatactttctccgtttcacaatgtaagtcattctagcatttcatatattcatattgatattaatgaatgtagacagtcattaacatcactatgaatgtgagaaatgctaaaatgacttatattgtgaaacggagggagtaacaactttcaaccctcagaaaatataactacttctccatcagcattatttttccaaccaatcacaaccctccactagttacttttcccacctacctccactgatcatccaatcacaactcctaatataagggattttgatatttagtgcaagcaactcctaatataagggattttgatattttgcttgcactgtttgaccactcgtcttattaaaaaaattatgcaaatataaaaaacgaaaagttgtgcttaaagtactttgggtaataaataataaagtaagtcacaaataaaataaataataattttaaaattttttgaataaaacgaatgatcaaacagtgcaagcaaaatgtcaaaatctcttacattagagaacggatggagtacctactttcttaatatcgtgtctaactctaaaacttataatattctgggacggatggagtaataatttaaaatcagatgagacatatctggactcctgtgcagatacattgtacagaaaatatatctcgtttgattctatattattatgttttgggacgaaggtagtattacgtacgttggaagttgagaaaaaaaagatgggataaaagaaacacggccgtatcaagtcgatcatttgctagctatacaagctagctcatctcgcatcacccaagcagttgattaatccggtcgcaatcatgcttagcgtcggttgggtgtgctgattaggctcgcctggtttggttggctggctagccagccgatgctgtgttggtcaatttaattttattggcttcttttttttttcttttagtagctgatcaattggacgacgagatgtgtgtgtacatgagctgcaaaatgaaaaacttgagctgagctgagctcgtggaagttatgacttagcgcgagaaacggcatgtgggggagagctggctctccatgtgcggtgggccccatgggaaaactcggggcgtttccagtgatcgatcgattgattgattggtttgtgctgccgttgccgaagccgtttggatggatcggtggccgtcaaaagggggggccatatgcccacgggttggtgggatctgacggcggggatatccgcgggcgaaagctggtactgagatccagtcgtccagagatttgtggacagggtagatgacacaacaagctagtcgtaggtcatccacgcacgtaggtacagtagtaggggtagtagggttcatgctccacattgggtgatttggttaattacctttttagggcactaaaactttgcacccatactccaacaaaggagtttaggcctctttagattagaggattttcatggaaatttcggagaatagtactactaaggattactccctccttcccaaattaattatcatgtaatgaaatttaaaatttctcaaattgatcatcatataactatatggacacggatttcatcggaatacaatcaatgcagaatgggagaatatgtgtgcatgctaggggtataattgacacggtgttctaatcgatacatgtattatgggagaacgtgtacatggtgtcttgattgatgtgatttaaattatcattggtcttggtacataaacatatatgatgatcaatttgagatggagggagtataattctatatggttatttgggtttaaggaaaaggcttaaggaaaataagagagctcatgtttttgtttcctttgctaagtccaatgcagctctccctttctctctctacttcctctctcttctacaagtgattcctataaaattcatgtgatctatttcctgtgaaccatccaaaggcactagctcaaatattatgtgttttaagatccatcaatattcaaaagagcatgacaattcattactacgtttttcttattatatttttttagtatcttgcatttcaaaggaggccttaaagaggtatgataagaaaattatcgaagaattcattgtcactcgataaagagaaaacaattgatcaaaattttgactagaatgtgcgcaaaggttctactccaacatcaccagatgaggcgtgaaattcgagttgaaagcatgaagtcgccaagtgataaaaaagtttatgttccaaatctatcaaccgtagctatatttgattgaagttatacataattgtttcaagattttgaattggtgaaggaggttgtaggttctattgtacaatgaatattcttgatacgataaggattagaaacgggaggtccatactataaaaggaggtaggataatatagtgaaatggtaatggtgccagatagccgggggtagcaagaacaactgcaggtagccaatatttgtgcacggctagttcttatgggtgggtggagaaggtagagccaaaagcatagcaagcatagacagtcctagagtgtttgatgccacaagtataaacaagacagagtggatataccgatgggtatttatctagctgaaaaggactcgaagatgcgagaggtgtaaaggtttcaattgggtctatgggctatggaatcttataaaaaattgggtgtatagtaagtttccatctttatattaattgtatcggtctagtttatacttcatataactataaattttcttgttaacgtattctattgtagatatattggacaaaaacaaagctttaggtataacgcgtgaactgttcgcaaaacaacatcattaaatcatgctcaaaccgaactatgacaattcgaaccatagaataaaacatacatgtatctgaaataatataaaactaagaccaatatactaatgcgaaagagaggtaaagtgggggagaaaacatggatattatgttggttttaatatcaactcttagcccaagataaaaagaaatgttgctgcctgaggctggccggtgaactaattaacgagatgaagagcttttaataatctacagtctcacctgttgactgttgtaagggataatctatcgatgacgtgtactgctttagctgtaataacaagctcaattattatacttgtcctaaatacatactcccccgcttcataatataagtcattcgaatatttcccacatttatatggatgttagtgaataataactaaatatctcgtaaaaaatataatatgtagacgtttagctccgatgagcaaaagatcgaagacagtagccactggcgagtatggccctgcaccttggaccttggaacaaaagagttgcacgcgtacttgttgttccggatcatcctgggccgacgcgccaccaagcgctcagttttggagtggaatcaacggaaactaatcaatcctaaggttggcgccacacccacatgcatcggtcgcgctcctgccagtccggacccgtgtcccagccgcgtcggcccgggcgcgcggcacacacgtacgcgggcttcgtacgaggcatccagccctctagctcaatcggcgcagtcctccacccaaagtcctaaggaaacccatcggtcgccgtctcgccgagagcccaccaagacgtacggtctcggtgcggtctcagaaggcaggcacacggtgctatcgttgagtcgttgccacacgcgcgcttgcgctcggtccccgtgcggcgcgcgccagtagctgtgtagcacgcgatcgcaggcggggctccctccgcgcgggtgatgtgctcgcgtttgcatggccttgctggcttgctgcgcccagtatacgtgcactaatcggtcggccgagctggtttcttgggttctttacaaatgttggggagcgctatagctttccacgaaatctttagctccccaaataatttggattgtcacatatattctgggaatacagttgtagaattcaaaaagaatgaactagaaatcagaaactgaaaatcttaacttctccaaattctacgagctgacattttaccgtgatcgaccgatcaatagtttacacaacagtgcgtgtttgtctcgttgaaaaggacaaggaaggatggatgttcccttcttctgaaacacaatatatatgaacataaatatgtacactttaccgttacaagcacatttaaagactgtaccgacgtaaatagattaataaaatcatcgtatatgtcgatatgttaacggatatatcgcctacaaagaaaataattaactgtaaatatgaacacatatgtcatacctagaatttgatcttgaataatcagattccaccacaatgaatctaactagttaaattacgctattaggatccccgtacctatattgttttcatctaatttatgtcctctatatgtgtaaccgaactatatttatattttggtatagttgttttattgcatagatatttgttaacatgtgttggacaacataaattaactttaccaactgatattcttacttttatgaaaaaaatatatgtggcgttatttgtaaaaccgatcgaggtactagtactgattaaggtaccccagttcccctccaggcctggaaaaaaagggttgtgctaaaaaaaaactgttgacagttttttgttgggaaaactttcgattttctagccattagatgcgctctaggattcgtgcaacatataaagccagaataaaaaaaaatcgcatgggcaaggcagtcatcgaacatgttaagctaagccatgcaacttcttattagcaataactcttttttattttatatcacttacaccctagttatatatcacttacatcttaattatagagtagttacataacacttataccctaattacagagtaattacatgatagttatagggtagttacattgtataaaattatgatttgcaatttttttaggagcacatattacttttgaatttgaaaattttttcccttctacatgtaagccaatttcttgttgttcaatcagcttggacactaaaatttatggtttgtactagtgtggattgtccccctataaccattgatgacaaatcctgtagtcaaaaaagttttggacctcaaaaattgtcgacaactccctggctagtcccggaaaaaaaaaatccttcagcagttcagttcagctctaaatcatttactattcagaacgaacaacagcagcaaaatttgaacccgtagtcccgtacgtagcataaaaccgtaagtaacgtgcgtatgtttagcgtgcgctaagcgaaagaccaaagtacagtatagccctgtagccgaaactatagtcctgcgcctcggtacacgatacgatgcccacagagaattccgtatcaatctggggctggcacgcaacacgcgtccaattttcacccacgcgaggagtggtggtgtgggcgcgcgcgggcgcgcggtgcatcgatcggtcgcgcgctcctgcatgccggccgacccgtttcgcggcctccccgcgcgcgacgttaactcggcacaccgcgcacacgcacacgcacacgcagacgtatgggtttctaacaagttacgacgatcgtagtcgtactcgtacacccaacacccagtctcggcgcaccgacgcgatcgagctaccgcgcgcgcgcgcgcgcggagaggagcggagagggggcgcagagtgctcgctcgctctcgctgccgcgcagacgcgtttgctcccgtgcggcgcgagcccgtagcagcacgcaatgcgcggctcgaatgcacgacccgtgctcgcgcgccgttgctgctgctgctggccttgccgcgccaagtacgtgtgcactgctcgattacggacggtttcctggattttttttcgttttatacggtacggagatggatagcaaaaagactccacacatgcacacgtcggctgctgtctgctgatagtctgacacatctactgaatcagcagtcagtcactacgaccatctccaattacacacagctgagtacgggcgcagcgcaaacttgtacttgttggaataatcacaagctgtttctatctggatcaaatctgatgatcaaatccaatccaggcggtcctcgaatttcctcccttgtttgcaccgtcgacgcgttcccgctggtttccgtttgttgatcaagatgcaccaagtattattcagtacagcgacagtccaagattaaaacaatgcacagaccttgttttcctcacccgaccgtctgcaagtttgcttccaagaccagccaattatccgtgcaagtacacgcttatgagaaaatggacattttaccatcttcaaaactaggtttcgctattatgccatcttcaaaacgtgattcgataaaatgccaatctcaagcctacgctactcgttggattgtcattttctcattttcttttatttccggaatcttttgcctcttcctcatggtgatcggacgaaaatgcccctggggccattggtggaggtcaagttggagggaattttcgtcaagttagatggaaggccaccggggctgctcccggaggcgcagttcgcggcgttcgtgcgacggcactggcgggagtactctggaccagaggagtacgcgtggcggctgcgcgtgttcgccgccaacctcacccgcaccgcggcacaccaagtgctcgacccgactgcgcgccacagcatcaccccttctccgacctcatccgggaagagttcgaggcgcggttcacgggcctcgctgccaacggcgacgacgaggcggccgatgccggccacggaggaggtggccgtcctccctgctagcttcgatttggcgcgacaggggcgccgtgaccgacgtcaagatgcagggcacatgcgcctcctgctgggcctttagcaccaccggcgccgtcgagggcgacaacttcctcgccagcggcaacctccgcaacctcctcaacctcagcgagcagcagctcgtcaactgcgaccacacggtacatcacattcacatcacactcacgccactcctaatctcatctttgaactaatcgagctattgcttgccgtcctcatctttgaactaatcgagctattgcaatgcagagaagaagacggagtgcggctgcggcggcgggctgatgacaaacgcctacgcctacctaatgagctcgggaaggttgatggagcattttccaatggccataggggcatttttgtctgatcaccacgagaaagaggcaaaaagtttttgaaaataagaaaaaaatgagaaaatggcaatccagcgagtagcgtaggcttgaggttggcattttatcgaatcacgttttgaagatggcattgtagcgaaacctggttttgaagatggccaaatgtctattttctcagcttattatatatagatgatgtgtttgttcccggcaacgagacctgcaaggaggagaaaaaagaaggcgccgtagtcaaattattccatagaaacagaaacgatatactctccctctgttcagttttgacagagtttgctcatgctatttttttcatgcctaaatgtagcttacagtgctgtccatttcgctcttcattttttttaacccttttaattggtaagcagtcaagcatcagtaataatgaagcatatatacacaatgaagggagtagaatggtgaatgattaattgtttaacactcaccaacttatcatcttcgtcccatatttttattacttctaaaaaacaaaaaaaaaacagaatgttaaatacagtatctcttttcaccgccaaaataaaaaaagtcagaatattcttatcttttttttttcaaaagagcagaatctttttatcatccggctactcctgaggcatggacaatatgacagtttgcccaatattagttggatacttaaatgtcagatgccgcccctacaaataccacaataggatccttaatcccgtggcatcagtttgctcaaacgagtggtttaaccacaaaaggtgaacatatttagcatggaagaaaatcatgttgagagttgagacccatccgctctatctgcccacactggctagtctgaacttaaaaccatactaccaaatgaaaagatagagactggaactcataacatctttataccatggatttcaatgacatcgtcaagaagcctggattctaaggcttttcctcaacatatgatccttacctaatttaagagccagagaacatatgatccttacctaatctaagagccagagaagcctagctttctgaatgttgatcaagaactagaactctgcatattctgaattgctctgacttgttttcatactcgttgtctgtccattgtccactagctagtccctgatattggggactgtagagatacaagtcatttagtcaataagagagaactaaaacttcttgaacatatctgaatgaaatggatgtattcctaattcaggactgtgctattgaggtgatctgaagttctgaacaactagccatccgttccccaaagctgcttgaataagagaaagctctacttgtttaaggccaagatcttcaaaatttaaaatcctgggagaaaagagtagaaatctacgggtggatatagatttcttcaacagaaagatcaaaagctgcaattcatagtgacaccaattgaagtatctgaactgtgcctcctcaagcttatccaggccaacctttggatgcgtttcctacagcgagccagggaaatcctcttcaaaacgtatatcactgtcatggattgttcggtcctgcaattacgaacaaataagaagaaaatcacaaaaaatgcagatacggattcagatgtaacaagatggcaaaccgatcgctgaaaaattaaaatgcaattcagagtgggtttgctggtatcaaccgtcacaaggaacttcttcagattagggcgatgacaactcttgaggaacacaaagatgttgccgaggccaacggccttgaattcaagcatggttaattctagcattgtcagactctggaagttatcgaggatggccatatcaagattcgctccaggatgccgcaagaaagacacgacctaaacaatagtgttaaatgatcaaaatccatgaatcgatcgagctaaatgaaatgttggaaatccaatatatacctgaagggtattgctacagatggagagggaggtgatgttggagagaaaaggtagattgttcctgaaccattctctcaacacttgatgaccaagtatcgggggattgaagcagaagaggaggtcggtaagcaagcgggcgccgccggagaggttgaacggcgaaagggggctccccatgcaatggaagttgtggaggggagaatccggcatgacgaccacgccgcggacgttgttgcactccacgataatgaggctactcagcttccgtgatgatgcaatgatcatggcgagggggccattgcagtagaacaacgtgaggacgcggagactgggggagaggatgaccatgcggcgcaaggcctcgtcggtgattctgacgtcgttgaggtggatcttcgcaaggcaggacatgggatggacaacggcgaacatggggacgttgaggttgagccagcacagcgtgaggctggtgaggtagatacaaggcgaatcaaagaccattcaacaacagaccatgcgaatgaaaagcaattacatgaaacaacgcatatgattctctattctcctatcctgtaacatatgatccttacctaatcaaatagagtagctatagaagttaagctctgaatctgattaagaactcagactcagcatattctggatcactctgtttattgtccactagctagtccataatgctaaagactagaactctaaattttccattaggtagtccaccggaactcaaactcaactactctgaattgctctatttattgtccactagttgatctttaactaacgactaaaacatcttgtagatctttgaatgaattgaacggtacgcagaataatgatctttcaagataccgataacagtgacacgtagttggccactagttaaatcttcttggatacgagaaatgttttcttgctgaagatcaagcaccgacgacggcatcctgacggaatccttctaggagaaacaagcaacagtctatggttgcggctagccttcttcaacagaaagatcatgaacttcagctcgtgccgacaccaattgaagttcacaatctttaccacctcaagattagctaggccatcctctagcgggttttgcctctgctcgccacacctcaagattagccaagccatcctctagcgggttttgcctctgctcatcaattggatcatattcaaagagaccatgatcactggttgttgggagctgcaatgcaagcatgaaccatgatttgttcagaagtctagaacgatcaaggtgaaatcaagatgcagatacaaataatggaatcagacgcaacaaaacaggaaaacacattactacaaaatacaattcagaatggattggcacctacacaaagagctccgtcagattggggcgggtatgtcctgaggaactcatatatgttatcaaggtcgacggccttcaattcaaacatgagaaactgtagcactctcaggctctggaagttggcaaccttagcaccacgcaaggaagacaaaatctaaagagagaacaacgttaacgaaaaatccatcatcgatgagcaaacgaaatagcaacaaattaagcgaaatgaaatggtggaacggggcgaagagatcgatccagcatgcatactgacggagcgtggggctcctcaccgggagaccgcgcgggcccccctttgccggttcggccgggggcgctaagtgagcttctaaacccttgatctgtggaatggttcgcgagagagcaaacgcacaagacacgggcgatgtagacaggttcgggccgctgagaagcgtaataccctactcctgtgttctggcggatctgtctctgaaggagttacaaagagctggaaagcaagagccttctaactctagagacgctctccctactctttttccccgtcctttctacgagcttccctttctccttctttctttttttcccctttttcttggtaggcatggtcctccttttatatctcaaggggataccacatataccatttctacctacccttcttttgggtggggacccatcctactttgagcaagatttggctc

SEQ ID NO: 40280 - DNA, 18946 bp, Oryza sativa
gacatgacaggcgtgtgaccagtcacagaccggtcactctcgtccaccacgcgtgagtttggcaagctgcatgtctgcccttcttcatacaatgacttccttacaatggttgggatgaagcctggcatatatctgaccgggaccgacgtgccatcttcaggagctggcacgccgtctccggctagggacaagtgcctggaggctctcatcaatccgacgggacggggcgaggcgtgtaacaggccacctgccaccacctaacccgcgatctgaccggtctgtgaccggtcacacgctgcgcccggtcacggaccggataagcgagcgcgctgagctgcattacatgcggcgtgacgcgctcatccaacccgcaatatatgcggttaggtgagccccgctgtgctcacctaacccatatacgtggcgccaaacccacagggggtcggggcgccccggccctcggggtcgaaacgggagcagtccgacccctcggggagacaaagggaggggcggccacatcaccctcgggcccgacccccccgagggggtcaggccacgtgggtgatcgcggctgcccaagcctctagtcatgatactcccggtcccatgtcaccgacagtagcccccggcgttatgccagggcgatcgcccccccccccccccgaaggaagcgctcgggcgtgacgccactccttaggcctggtgacaggtggggccggtctctacaggcgggcagaaacccagcggtcgcaaatcgcgcacatcggcaacggaaaaccgactgtctataatgagcggtctcttcaagaccgctacattactcgagtagcacgcgaatcgggacgagccggttcgttttgcctggagatatgatgatggcgcttcggtcggcgagcgtagttaacgcgcgcacgatatgttccatctcaactgccacagccgcgcatccacctcgtgcgccgcaaacgggcgagcggaattagtggcgacgtgggcgcgagaaacgagggggcgagatagtgggcgcgggaagcgaggagccgggcatagcgttggcaagggtataaagacgccgaggaagagattcgcttccttcctctcgtcattattccccttgccttcgccgcttgcgccctaactccttgtttcctgtgccctaccctcgccgcactcactcgttttcaagctccttctccgccggcgtcatggcacggggctccgcaccgctcgacggtagcgtgctgccgccttcccgcatcgtgagcgagaggcaggccgggctgccgcgccgattcatgccggcatctgccgccggccgggaggtggtcgagctgggcgagggacgcccggcaccacactacccgaggcggtccgtcttcttcctccctttcgcaatggcagggctggtcccgccattctcttctttcttcatggatgttctggagttttatgacctccagatggcgcaccttacccccaacgcgataatgacgttggccatcttcgcgcacctgtgcgagatgtttatcgaggtgcacccatctcttcggctgtctcggtggttcttcaccgtacagccagtgtcgccgccgtcggtagttggtggctgctacttccagccgcgggggccggcgctgagccgctacattccctgcgtcctccgcaagaagtgggacgactggaagagtgactggttctacacccccctcgccgacgaagcgcgcctccaacttccgagccagcccccagcgcaggagaaacaaacgcgtcgcaatctggaaggtgccagcgccgagagggccgcactggatcagcgggccgctgagctcgaggcacgggcaagggagctggatgcgagggcgcgtagcggcggggcggccacgggcgacggcgatctagccgcccgcctcgcagctgccgaacacaccatcgccgagctgcagggcgcgctggactcgtccgccggggaggtcgaggccctccgcttggcaggcgaggtagggcccggcatgcttcgggacgccgtctcccgtctagaccgcgccgggcggcaggcgggcctctggggcgggcggatcgcgaaatatgccgccaaccaggggggcctcgcccagcgcctctcagagatggccgggactctccagcggctccccgaggagctcgaggagacgatcaagtcatcctcgagagacctcgcccggggggcagtggagcttgtactggcaagctaccaggccagggacccggacttctccccgtgggcggcgctggacgagttccctcccggaaccgaggacgacgcgcgcgcgcaggtccgggacgccgccgaccacatcgtccacagcttcgagggtacggcccctcggctcgcgttcgccctcgactccgacgtggagggcggcgacggtggtgtggacgacagcaacgacgaggccggcgacccgggagcctcgaagtgagcccccaggcccccgccaatcttaaatagtttttcctttcttcttccgaggccttcgggcccccttcttgtacaaactaatttaatctgcaatcaaataaagaggaaatttttgtgtcagctctgtttgttgtgtgtatgagacgaggatggtctgtgccgtggtccttctgtgtcttggtttgaacgagggctcatgcccaggtcccagcctcaaatggcgcgggtcggggctagtgcctggggagatccacgtgtcgagactggccaggccgggaacgtggtgaccgagggttatggatgacccgattgtgggcctttgccgattcccccccggagttcaccacgccccggggcacggctcggttctgggccccgtttggcgatttccgccggcccgggccaccgagggcagggtcgagcacgagcatgctaattcaagccaagactctttgaaaggaaacaatggcacagacacagtccttaggaaatcgaaaatgcttttattgaaatacggaagagaaaaaagataagtatatgcatgtggtagcccccggccaaccctgcacgcccagggggggtgcggggttggcccgagcacgagacctgacacccgacccctactaggggtagaaacgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacttggtggcccgaggggacctcagggtgagctcggatgggagaaccgcctccgcgccgtagacgaggaagaaaggcgtttccccggttgctcggcttggcgtggttcggttcgcccagagaaccgctggcaactcctcgatccacgagtcgccgtgcttcttgaggatgttgaaggtcttggttttgaggcccttgaggatttccgcgttggcgcgctccacttggccattgcttctggggtgggcgggggaggcgaagcagagtttgatgcccatgtcttcgcagtagtcaccgaagagttcactagtgaattgggtgccgttatccgtaataatacggttaggcaccccaaaccgggctgtgatgcccttgatgaatttaagtgcggagtgcttatcgatcttgatgaccggataagcctcgggccacttagtgaacttgtcgatagcgacatacagatactcgaacccgcccggggcccgtctaaacggacccaggatatcgagcccccagacggcgaacggccatgaaagaggtattgtctgcagggcctgggccggctgatgggtttgcttggcgtggaactggcacgccctgcaccgccggaccaggtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgcgccgatagagggtcccttccaccagtacgtagcgcttggagatgcactggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgatggctgggcaagcctttcttaaaaggcgcccggtggggtctgggctcacgaggaggcgagccttgagagttcgtcggcgaccgtgttatcccgtctgggcacgtgccgaagctctatcccgtcaaaatggcgctccatacgccgcacatggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatatttgttggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaggggcccgagctggcctcggggacggagatgggctcaggggccggggtccactctgccacaaagtcggcgagggcctggctcttgactgcgtggcgtggttcaaagcgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgagtcttagcgtcccggagggcctcgctaacgaagtagacgggccgctgcacctttcggcggggccgatcttcttcactaggggccgtatctccagggcgctcttcgtccgagaggcctcgcggggcgcactcggcttctgtgccgacgacctcggggtcggagggcgataggcgcggccttcccgcagtggccccggagccatcctaggggtcgggggcgcctggcaccgtcggacaagcgggcggagggccagctccggccgtcggggtccttgggccaccgttcggctcgggggcctctcctccctgctctctcccgggtcgagtcgacacaaggtggggatgcgcggagcgagggtcgtcctcgtcacgctccgagaggccgcgcggggcgcactcggcttctgtgccgacgacctcggggtcagaaggcgacatgcgcggccttcccgcagtggccccgtggccatcctgggggtcgggggcgcctggcaccttcggacaagcgggcggagggccagctccggccgtcgggggccttggtccaccgttcggctcgggggcctctcctccctgctctctcccgggtcgagttgacacagggtggggatgcgcggagcgagggtcgtcctcgtcgcgctccacgaccaacgccgcgctgaccacctgcggggttgccgccaggtaaagtagcaacggctcatctagctccggggcgatcaggactgggggagaactgaggtacgccttcaactgagtgagggcccgttcagcctcctccgtccagataaacggcccggagcgtttgagaagcttaaataggggtagcgccttctctcccagcctcgatatgaatcgactgagggcggccatacagccagtgacacattgcacatccctaagcttgctgggggggcacatccgctctatagctcgtaccttctcggggttggcctcaatgcctcgggcagagaccaagaacccgagaagcttgcccgcaggcacgccgaacacgcacttgtcggggttcagctttatgcgggcggtgcggagactttcgaaagtttccgctagatccgagagtaaggtctcttggttgcatgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccaaccactccggatggataacctctcggatgaatccggcctccagaagtcgcgccacctcctcgcggatgaaggcttgacgttccggggcctgccgccgcactttctgacggaccggccttgcgcccggccgtacggcgagacggtgctcaatcacctccctggggaccccgggcatgtccgccggtctccatgcaaagacgtcagcgtttgcccgcaggaaggagacgagcgcgtcttcctatttgccgtccagcagaccaccgattcgtgtggtcttggacgggccgtcgcccagggcaacctccttgaccgggacctcgtcgcacgtggccatccgctgcctcggggcggcggggacggaggtgccgagcctctcgtcgccaccctcgggcttggacgcggcggcgaggtggtccgcgcgctgctccatacaagcaagcgcgactttgaggtcgccatggacagagatggggccaacggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccggagcaccatccccggggccttgatggcgtcaaaggctgtgggggaaaggatgttgagggctgctcccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcatcgcctcatgggtaggggccgcggccagaagctctcgcttcatggccttgaggctccggcgagaaacgtgagcgcatgctcccccatcgacggtggcgatggtggccccaggctcctggaaccctaggtcatcgtcgccatcgtcaatgtcctcggcgggggccttctgcttggcctcacttcgccggttgccagagggagccgctggggccttgccctcacggcgctcctgcctcctctcctcctcccacttcctcgttcgctcagccaaacttttgaccgcgcggcagtccacgaggtcgtggagggaggtgttgtgcacggtgcaccacttgccggtcgggcgctccctgctgggagcgccggcctccttctttttgtcgctcgcaggcctcccctttcgggtggcccgcgaagcgccctcgatggcgaggacgtgaccctcgtcgtcggaatgggccgacctcttcttcctcctcccgtcccgccgccctgaccgagcggcggatccgggggcggctgaagctgccacaccggaaccggtggagttccaggtccatgcctcctccttgcgagccacacggtccgcgagctgaaaaagctccgcagtggtctggggctccttggaggcgatcttctcgagcatgcggttgtgccgcacgccccccctgaacgcgtagatcaccgcgtgtgcagggatacatggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctctcagggccatggggaagaaattcgccatgaccctgtcgtcacccctggcggcctcgatcccagtcatgtagatctggagaaactcggcggggttgacgcttccgtcgtatatttcggtgatggtgggccggaaccttgggggccaacggacgttccgaaggctcgccacaaaggctcgacagccggcaccgccaaccggggacacggggggctggcctccgtgcccggaccgaagtggcgctccggacgaggaagcgccctccgatgcgtgggcagcacggcgatcattgcgccggcgctcgatattgaggcgggcatccggcccctcacgcacatcttcttgggtcggaggcattgacgagggaatggcggacgaacggcgggcaacggccgccgctcgccgcgccctccgcctcgacgatacggagccggcagtagcagcaccagtggccttggtggcggaggaccgcccgccggcgcctaaacgctgctgcgccgtcatgaccaagttggccacgtcatctagccaacgtcgagttggagtctctggatcagggacgacgggcgggtgacgcaggagcgcgcccgcagcctggagcgcgccctggggcgtcgtgccatcaccgtagatgaggagacgacgctccccgtctcgccgtccttctccatcgctcgtggacggcgaagtcgcggatctttcgaccccctcgagcgcctcctcccgcctaagacttcggcgagagggggcggcggagtacgagctcgacgacgcgggttctgctcgctgtcgtcaccgctagcgctcggagagaggttgtgcgcttttgctcgttcggccattgggctgaacgggaaaagcttggcgcacacgaaagaggatgagagcttagaaaaacacacgcgccccctacctggcgcgccagatgacggagcgtggggctcctcaccgggagaccgcgcgggcccccctttgccggttcggccgggggcgctaagtgagcttctaaactcttgatctgtggaatggttcgcgagagagcaaacgctcaagacacgggcgatgtagacaggttcgggccgctgagaagcgtaataccctactcctgtgttctggcggatctgtctctgaaggagttacaaagagctggaaagcaagagccttctaactctagagaccctctccctactctttttccccgtcctttctacgagctcccctttctccttctttctttttttcccctttttcttggtaggcatggtcctccttttatatctcaaggggatactacatataccatttctacctacccttcttttgggtggggacccatcctactttgagcaagatttggctcgtacttttatctgacaccgggatagccctgtcctccctcattaatgggcggagatttgcaatggctgctgtttgaatgaccctccgatgggatgggtcataccaacctccactccgtcggaagcaggtgcaacgtggaagcacggttgtttgccgatgacatgacaggcgtgtgaccagtcacagaccggtcactctcgtccaccacgcgtcagtttggcaagctgcatatctgcccttcttcatacaatgacttccttacaatggttgggatgaagcctggcatatatctgaccgggaccgacgtgccatcttcaggagctggcacgccgtctccggctagggacaagtgcctggaggctctcatcaatccgacgggacggggcgaggcgtgtaacaggccacctgccaccacctaacccgcgatctgaccggtctgtgaccggtcacacgctgcgcccggtcacggaccggataagcgagcgcgctgcgctgcattacatgcggcgtgacgcgctcgtccaacccgcaataaatgcggttaggtgagccccgctgtgctcacctaacccatatacgtggcgccaaacccacagggggtcggggcgccctggccctcggggtcgaaacgggagcagtccgacccctcggggagacaaagggaggggcggccacatcaccctcgggcccgacccccccgagggggtcaggccacgtgggtgatcgcggctgcccaagcctctagtcatgatactcccggtcccatgtcaccgacacataccttcagggaatttccgcagatggtgagggcagtgatgttggagaggataggcagggcactacagatgtaaaggccggtgagcctaccggcgccggcaggaatgtagaacgagctagggctgccgccgtagtggtaggagcggaggcgattgcgttgtaggagaaccaatctcgagatcttcacactccactatggtgaagaaccgctgcgttggtgcccagatggagacatcgcgaagtctgtgcagtagagcaccttgaggacgcggagaacgggccgacaaaaggagaccatgccaacgagcaattcgtcggtgatgcggatggagttgaggtggatagtcgtgaggtgggcgaagggcggggggcggggagacccaatagaacaatcgagcggagaagttgatctcgcggagcgtgtggctctgaaggagcggattcagatagtggaaggagaaggtgatcctgtccctcgccgaactgctgcgtaggtggatgtagaggtgtttgacagtggactgctcggcgccgacgaggaagcgccagacgaactcgcctctcgtcaggcttatgtagtggtcgacgacaaggaagaagatcttgaggtgcctcgccgaccgctccaccaggcacttgagcttctccaactgggtgtcgggggctgaactcgacttgcacagagtgccccaccaaccgccgctgcacggcgtcacgccactacggggagagcaccgacgtgtggatgacatcgtcaagcggaggagatcaagtatctgctcgtgcattcccgccggaatcctctcgaagtggttcactggacatcagaaaccttgcacaccgtcgatgattctaatccattgccgtaccgcccctggttgccgaccacctcccgctccgccactctctcccttttccatcttctcaatgaaactacacgtaatgaaattgtgtgttgtccattttgctttcgaagcagaggccacaggggattaggccatttaaatggctggcgactggagaggatgtgccttgccagctacgcaaaatggacctggagctttgaccgggtgatgactgctgggcccacctgcaagtgaaagatagcaaatgagatacaaaggttgcgttcgaatattataagattcacattaaatacatgcacgtaaaataagaaatctatcagcgtataattaattgacttttaattactacaaggaaaatgctttacatacgaccacgagcgtccgactctcgtacaaccacggcgacggcatatgtgacatccgcgagctgacctattaggttgtgatccgaatctcaatctcattgggccttccaaaagcctagtcacaaccgtggctaattacgatgtctggccgggtccctggaatcagcaacaatactaccaacagattcctcgtgtgcgtggaaatcaccgtcttacatgagcttttaatggatcttcttcatgtgctaattttcaattcttttcttagtttcttctattcatcattacattgtacaagtctgtccagataatttgtttgtatgttacggctgtgagagtataagtgggttttcacatgctattggaatgcttatggccctcagttaattgtgcatagcttaattgtttgacataagcacaatcgataattggtaagctagttatatgaactgatcttggtggttatagtatataaaagagtaaaaaaagaacttgctttacctagttatatgaactgatattggtaacatctactacactgaaaataatactagaatgttgagatcaagttgacagttagtggattcagcatttcagattgacctaaagctccggcagaagcagcgtgtgaccatgttgacatgatatggtggtttggacttgtacatgggcctatgtatatgatatgagagtgttatgggcttgtggcgtaggtccaatctacagcatcactttacgccgtcgccgtttcagtcgtacgctagtcgtataacttcatcggattatataggtcacttattacaaacttgaaaatggatatatttgatattttaaaacaactttcatatagaaagtattcacataaaacacatcgtttaatagtttgataagcgtgctagtggaaaccaagataaaatctttatcttcatattgtcacaggtaaccaacacaaacaaaattttagcatagtttaatccttaagatattatttaagatatactttctcagtctcaaaataaaccaacctcgtaggtacgagattggttcatgacggagggagtattaacaagatactataatgacttggtaaagtggaaaaatatctcgatcatgtcaacgataacaatgacttatggcacccgcaatggttatctataggctctctacaagagatccatgtcagcatatttttctacttggaagagattaaatgaagagaaagagtaaagctatctactaacttagagatagtctatagagaaaaacgaggcaatggatgagatagctatagatacccatgtagacatactattgaggtggtttactattaatctagtctattgctgagatataaatgttttatagagagcaccttactttaccattgcgggtgctcttagttcatgtccaaaattttttgaaacaaatgcatgcgttgtgtaaaagattttaaaaaaaactcgatgttacaaacaaaatttcagagcttttcttggagtgtccatggcggagcgcataaattggctttttcccgtgatattcacgcaagcagaaatttgttagacacatacacaagttgccaattttgagcatgcagtaccacaaaccataatcaagaggagcataacatgagggcatagtaaaactgcagagttaaattaacataagggtcaaaacagtttgccttcaacagtaataccgttcacacaagtaaagcaattcatcgcccctcacaaaaaacttaaattaagacatcacggacaggaataagcaaacactgcagccattctcaagagggaggcgaagaacattccaaatgccaacgggctatcagtcacaaggacccactctaggctcctttgggatcagacggcagcgaagtcggcgatgcagatggcactccatcattcacaccattggcagcaccttcctgggacagaccttcaatcaatggaaacataagtttttgaacataatggaaatggaaacataagttagtcaaaattctgaacaatatgtaatcgatttggtaaaaactagctagcctgttgttatgcattggagaaaatgaagtagaacttaactaaggggtaaaactgtcatagatcacctgctggcgattttcatttcacaaagattctatggtaaaacaaaacttatcaagtatttgtgagaacttaccaaactagaaatgtatagtaaaacaaaacttatcaagtactagtactttctcaaactttcctggggaatatatggacataaaacagcaaaacaggtaaacaaaaatggcaaatgcaaaagtcaaaacaggtaaacatccaaaaaaaattttgtagctctgcttgcgcaagagatgtgcacataagtgtcaaaaatgccaaatccaaaagtcaagatatatagaagatggtcactatacattctagaccaaaatttgtccaaatctatcgaactctaggaaccaaacagccaagcaagcaactcaaatgaacgccgttccgctgagaattcacaactgcatagttatcatgaaaaacataggcattacacacatgccacatacacacgacacaccaatcaacatgacacatcaaacacacgaattaaccgatcaagccatgacattgaacgcaaaagcagatataattgatgatataatctgtagctgctcaacactgacacgagcaattggatccgtactgcaaaccagaacattgacaggaaaatgtgaagcttgcggaatcgcattacctgcggagagcgcgggtgggagtttccatggaagaacgctttcagaagagtcgcgggcctcgtactccacgaccttcctcgcgcgcacgtcgacgcccaagatatgcttcttcaggaagaagtacagcacgtccgggttcatggggtggacgaacgcgttcctgagttgaggggccttctccggcagctcggtcgccttgtagctctcgctggcccagatgtcggcgaagctcaccgtgtactcaggcgcccactccgcggtctctggattaaccagcgtgcgcatggagacctcgggagcggcgccgtggcttggagagctcacctccacacacctgaacttgccgtcgatcagctgcacgatgcggccggtggcgagcactctctcggcgcagtagccgcagccatcgtcatcgtcttcgtcttcagattggaggtcgtcctccttgtcctccagtggaacgtacttcatgtccggctcatcggcgaacggatcgcacaagaggaggcccgccgcggtgtccacccaccagagcttgccgtcgtgacagatgatgtcatagaaggtccagatccagctcggcagtgggttgccgacgtccttctcctcccactcgccggtcacggacgagaagcagagcagggtggcctcgtcatcgccgacgatggtctggagctcgacgaccatgtagttcccccggcctcctcctggcgcggcgatgacaccgaggtcgttgttgaagatgaggcgctccgggtcggggacgtgggaggcggtggcggcggcgacgtcgcagacgaagtagagcgggcgcgggatgaggctgacgcggaacgtgcgctcgttgccgtcgcggtcggtccaggaccgcaggtcgccggagtcgtcgggggacggtggcggcggcgcgacgaggaggacgagccccgcggaggggtcgagcgcgaggacgaagggggacttgcacctggcgcaggggtccacctcggccggcgagacgcgccgggacaccgagagcaccgcgacgcgcggcggcgcggcgagggagagggcgacgtcggctccctgcggcaggacggggtcgtcgccgccgccgcacacccgcggctcgcagctcaggatcacccacgacggaggcgccattcgggcttggtgcgagttggagagcggcgagccggcgatcgatgaggaggagtactagtagaagctagggtttgaggaggggatgagatgagcaaatcgaatcaatgggaaagattggtgggacgagtttgaatcaatccttggtttttgtggcgtggcggagaccagaaatgcagagctggagcctggaggatgcatgggtgatcttccttttttcttttggcacttgccgtttcggtgtgtgcggggaggggcagctcggggaaaaggcagacgagccgcatcgacgtgaacggaaatattcgccgcaagctccggaccactgcccgtgtctactacgcatatcatcacaggtcgtaacctcatgacacgaacatggtgtcgtcgtcctccccgtcgtcgcctaatactggcttgaactcgaccaccatgtagttccccccgcctcctgggccctggcgcggcgatgacgccgaggtcatcgttcaaggtgggctcccccggtaggggacgcgggtggcggtgccggcggcgacgtccaagacgaactgacgaagtagtactagtacgggacccagggcatgcagcggctcgtcggagtccggaggggatgggggcttggacgaggacaagccccgcggaggggtcgagcgcgcgaggacggagcgagacacgcggggacacggtgagcaccgactcgcgcggcgagctcgagggagacgtcggcggcgcgctgcattcgtgcgtgcgtgagccgagcgagacgtgactcgtgtagcaacgtgagctttgctgctgccggcgtgccgagctagtcggcgtacgtgagtcggacgtcgcgcgcggcagcaccaccgccacgccagcggccgcgctgcttcgaccagctgaacacaaatgagcagcgcacgaaaccttccgctaggttttaggtccacgagccagtgagagagattagggtaagaaaagaaacaaaatgccaaaagagatgcacgtcgtcgcatgcaacatgacgcgaacaaaatactttctactaggcatagcatagcttaacccttgagatttcttaacaacatactagaacgataattacttcacaatgtgaaaaaaattgattcaccggatacaataagcactccagaaaaattcaaacaaatgcatgccttggtgaacaatctaatgatttcgtaatctgtgtttaggagcgtttagtatttttttaaaaaaaaacagaacaatttaatcccttttcgtcaagatgtagattgaatttatggcttgcaattttttttctaaactactacacgggaacccgccttgatggggatcaaaaagaagagcagcaaatggagaccaggtgtgcaggcagggcaacttgacaagtactgtgtgattttcactcaaagttgattccaggttccaactttgaggatgcagcagcagaaacaataatcaagaggagcataaaaaaaggcaaattaaacctgcaaagttaatttaattatccaggcatgcgatcaacatactactcgagtactagcgcaataagtgcaacagtactatccgacataagcacaacaaatcatgaaaaggaatagcagcattctacagtcattctcaagaggcaggcgaagagaactccaaaatgccaacatttgaaagatccaatgcaaaatgcctacatccaactggttatcacacgcacaggtagcttcttcacttgagctttgtggttccctggacgaaacaagaacaacccactctaggatccattgggatcagatggcggggaagccagtgacgcagatctcacaccactcgaattattggcagcaccctccttagacaaaccttcaatcaaagaaaacacaagtttgtcaaatactaacgaacatgcatgtttgagtgacaggaagtggtactaataatcttgccctaaaagtgcatttgcatggtttgataaaaactagacaaatttctgttattataggataaaatgaagaggaagcgataactgatagaacaacttgatttgagtgacaggaattgaagtggtaataatcttgccctaaaaagtgctatatggttgtcaatattcacatatatgaataagagaatatgaagagcaagaggaaataataatctgagactgcagcaagaagttggtgcaaatgttaggaataacaacatacagcaaaataaactactagcagtaacgtttaagtgatgaatgaaaaagaaaacatgaattgatgtttgtagatgtatccatcttcaatacaatgtgtacaattgtgtatattgttctcaatgataggtctttgtgtcttaacaccttattagtacattcagaaaaattcagggcaacataaatgttctttacatgaacaaaaatgaatgtattgcaatttcagcgtatggatgcaagatgtgtaattatacatgacacatatcacacggttcatgcagtcactttcagtagatagtgggtatgaattaagcagcagaactgaactttttatcatactgagtaatgcatatttatgtgcaaattaatgtttgtgaaaacgaacaccataaataaagttctagacattgtcaaaatttaatgaatttcaggaaccatcaagatcaacatatgaatggccaaatagatatgcaagaaactcaaatgaacaccaatcaacatggaacactgaacacaaaaactaactaatcaaaccatgagattataaacgcgcgcaaaacggacaaaatagctagaacatactgctagtagtataaaattcatcaatactgtcactacacgaccaataggagcaatactttgaaaccgcagtaccatgtcccgttctaattagcagattcgagaacattgacaagacgagcactagtaatatcaaggaagtgtcgagcgcacagaacaattacctgcggagagcgcgggcgggagctccattggaagaaggccgtaagaaaacacacgggcgttctccggcacggtcatcttgtgtgtctcgtactccaggacctccttcgcgcgcaggtcgacgccgacgagctggtccttcacgaagaagtacaccatgtcggggttcttggggtggacgagcgcgagcaccggggccttctccggcagcccagccgccttgtagctctcgctggcccagatgtcggcgaagctcacggcgtactcaagcgtccacaccttggt

SEQ ID NO: 40281 - DNA, 18841 bp, Oryza sativa
  unsure (1)..(18841): unsure at all n locations
cggaacgtgcgctcgttgccgtcgcggtctgtccaggaccgcaggtcgccggagtcgtcgggggacggtggcggcggcgcgacgaggaggacgagccccgcggaggggtcgagcgcgaggacgaagggggacttgcacctggcgcaggggtccacctcggccggcgagacgcgccgggacaccgagagcaccgcgacacgcggcggcgcggcgagggagagggcgacgtcggcgccctgcggcaggacggtgtcgtcgccgcacacccgcggctcgcagctcaggatcacccacgacggaggcgccattcgggcccggtgcgagttcgagagcggcgatcgatgaggagtactagtagaagctagggtttgagacaagcaaatcgaatcaatgggaaagattggtgggacgagtttgaatcaatccttgggttttgtcgcgtggtggagaccagaaacgcagagctggaggatgggtgatcttaaatttaccctttttcttttgacagttgccgtttcggtgtgtgcggggaggggcaggtcggggaaaaggcagacgagccgcatcgacgtgaacggaaatattcgccgcagcgccggacctgcccgtgtctagtctactacgcagtctacgttgccgcgacgcgatgcaaccgatcgatgtctggtgcgtggtagcgttggggagcgtggaccggtgagctcgtgaggatcgaggagcgagacgccccccgcgccgagaattgcacgaaacccatccgccggggcggggagctaacgcgggggaaagtgtggtgcatgcgttgctcatattgcgagttcgttctatcgtgtgcacgcgcgacgtgccacgtactcacttgctttggttctgccttgccccttgctcacttttttttgagaattttgccttgttcacttgagcttggttctgcattgccttgctcacggggcgcgcgacgtgtcacgtgagctgcttcctgcgaccaagtcggccgtcgcagcagccatccttcaccctcgcgagtcgcacccgccccgaagcccagcagaacacaagggctgccatttttagcattttaggcctgtttagatccttgtcaaaattttacaccatgtcacatcgaatatttgtacatatatgtggagtcttagatatagaaaaaaataattacacagattgcgcgtaaattgcgagatgaatctttcaagcctaattacaccatgattagacaatgtagtgctatagtaaacatttgataatgatgggttaggctctgttcgtttgtttgggttggaaacccatccctccggcacggaaaacgaagcagttcattagtgcgtgattaattaattgtttgctaattttttttcaaaaaggatcaatatgatttttttaagcaactttcgtatataaactttttccaaaatatgcaccgtttagcagtttgaaaagcgtgcgcgtgaaaaacgaggagggggagttgggaaccttgaaataagaattaggcttaataaattcatctcgcgatttacagacggatttgtattattgaactacgtttaatattttaaatgtgtaatccgtatatccgatgtgacacgccaaaactttacacccctcatctaaacacagccttagcatcataggtcataactgcatgacacgaacaaaattgttgctgctggaataggtgtttagatccaggaatgtaaagtttgatgtgtcgcatgggatgtttgggcactaatagaaaaactaattacagaatccgtcagtaaaccgcgagacgaatttattaagcttaattaatccgtcactagtaaatgtttactgtagcaccacattgttaaatcatagagcaattagtagggatgacaatgggtcgggtcaggcacgggtagagcaaaaccatgcctgacctgatgcccaacattgcccgcccaaaccctacccacaagagttagtgggcaaaacttcgtgcacgtacccatgcccagcgggcgcgggtatatccggcgggtacccaatggatctcatatgaataataacttgaaagatataatttaacaaagataaataaaatcaataattaccaaattatcggttatcaacaataatttaaattacatcacaacttagtatttgttagcatcacaaatgaaccgagataaatggtataatatttaagaaatgagtcaaaattagctaatacatatgtatcgcgtcgggcatgggttacccatgggtaaaaaatgaaacccgcctattgcccataacgtcttcgggtctcgagcgggagtgcccatgggtaaaaagtcacacccacacccgtgcccatcgggtcgggtatccacggatacccggacccatgggtaaaattgccatccctagcaattaggcttaaaaggttcgtctcgcaaattagtcgtaatctgtgtaattaattatttttttaggttatatttaatactttatataggtgtatcataaaaattttgggtgggatctaaacaccccctagcatagtttaagcttttaagacttctagcaaaagatactataaggactttgtaatgtgaaaaaaaaaagtgtcagaaccgctccaataaaagaaacaaacagatacctgccttgtgttaaataaaacaaacagcatgtaggggacaaactcttgttttcatattctatgttttgcagggttctacttctcagaagaactagatgaaactccgtacggtgctgcaggagtttattatgatattagaagaaataatagttacacttgtataacttttaactctaatcaactatttaaaaaaagctataaataattaagatggtgaggtttaaagcaatttaaatcatatagtattggtcgttgaaaagtaaaacaaaggtggtttgatattgctcgggacatgagatactttcagtacgtagtattctaagattaatctttacatatagataaatgatggaagtgtctagtaaattgaaattgcatttgctcaaaaggaatcggtgggtctactgcatatatatgcatttagattaaaccaatataaaaccaatcatttgccatattgaacaaataacctcttaaatggcgttggctctgttcagttacatgcatgtgattattgaataatctggaagaattaagagagatttaggaggagaataaatggcattaaccatggtccattgcctctaatcataaacgcactgctcaatatctcacccgtacatgcatgcgttacatgcattacaaattaacacatgcataaacgaattgctcaacatctcgctcgaggaccttcacatccaacgattcatatgcgatctcatccaccaatcaaacggctgagaattaacgatgacgtggaacactgagatttcagttttaggtcttaactttataggaagaaaggatttatctttttttaatgtagagttaattgaatggctcacgcggattacgcggctattttttctcacataatagcatatgtattttcacatattattatgaaatatattaaaataccaaaatagttttaaattatgtactaactggaccaaactaaccaatatgtaatatttatattgtattgtgtataggtgatagttattaattattttttaattccaaatttcagttatttataaattctattcctatataaacgttagactcactttctcaacttctcatctctcgtttttcacgcgtatgcttcacgaaatactaaacgatgtgtttttttaaaaaaatagaaaaatattttgaaaaatcatattaatctgcattaagtagaatttatacttaagtttgtgtgcacgtgtgttcccttatagtaccatcacgacagcgatgtgtctatggtgacttcataaatctaaagtatttgttggtccagtcttcgagaatgctcatagggatagaatttgcgagcgtgccttcatcgaggtgagtgtaagtgtattgtgagtatctgcattgtactatggccctgtttgggagattagcccagggctaattttgagagctaatgtttagtcatgaattggtaggctaaacattagcctagggtgatatgtttgaatctatgggctaattcaaggctaaaaggtggagagagtagaaagagaggagagagaatgagagagagctgtttttttatggtccccacacaaaattagccccattagcaccccttggaggggctaatgttttgaggggggctaattcacattagcttaaaattagcccacctgtttggatccgtaagggctaatttgaggctaaaatgtgagggctaaacattagcccatcgaatcaaacaaggcctatgtattttaaaataacaaattctaactcatcaacccattatttcccttttttttcggacaaaccatcattaattcgttacaaagcaatacgtagtagtagtactaaaataacaaaagattgaggtgctttgcttattctacaggtaggtgagcgaaatcattcgacttgcagcttggcgatcccgcgggctgcgttcctggcctcccgccgccgcctccgctccgcgacctccccttggtggctgttgtagcaggccatggagcagtgtgaggagtgctggattccgatatggcggcggcagtgcgcgcagccgcccggcggcctcgtcagtatcggcagtagctcgtagtactccccgcgctcgtcctcgccctcgtgcaccgggtcgccgaggacgctctccaggtaagggagccaccaatcggagcccgtcgaccgcacgcagcgccgcccgccgccctcctcgattcggaggacggagtcggggaccgggtcgtcgtcgccgttccggtggtggtcgtagtggtggtggcaggaggcggcgcagaaggcgacctggcagctcgcgcagtaggcgtccctggggagccgcgtggcgtagtcgtgcgagacgatggcgtcggcgatgacgcgcgggaacatcctgtgcccctccgcgtcgcggttttggaaggttggccggccggtggcggcgtcgacggtgaccggcacgacaatgtggtggtgccccggccacaggtgatgcgaggagcagcagtgggagcagaaggcgcgggcgcagctgacgcagtaccggtccctccggcaagtctgcgtcaggtcctccaacggcagccgctgcttggcgaagtacatcttgctgtcctgcacccacgacagcggcatcggcggcgacatctccagtaatacaaggcttttttttttttttggagtcctgcgagtctgcagcgattgagaaagagagcggaggggactgaatttatccatgctccacacgacacagcttccgactctgaattctgaaacgtatgcctcgctccgattcggcttctaaggtcatgccctcgtttagttaaaattttttcttcaaacttctaacttttctatcacatcaaaacttttctacacacacaaacttctaactttttcgtcacatcattccaatttcaactaaacttctaattttgacgtgaacttccaatgtttagttcacaaaattttacacatgtcacatcgaatgttttgatacatgcatagaataataaatattgaaaaaaataactaattacacagattacgtgtaaattgcgagacaaatcttttaagtctaagtgcgcatgatttggcaatatagtgctacagtaaatatttactaatgatggattaattaggtttaataataaataaaaaatatacgggactctcgcgtcgcccctccccttgggcgacacgggaggcaacgcccccgccggcgcacgtttccccaccccccctcctccacctcgccgccgtccgagcagccgccggcaaagccgcgcggcgcaaggacggcggcggcggggcttcgtcttcgcgccacgctcgggtagagggggattgcccggggcggcaaaaatcgtccagatccgtgcctcccggccggatctggcgtggagacaattggcggcggtggggccgagcggtcgtcctggcggcggcggttgaaggtgtggcgacggtggtcggaggtggggcggcgacggaggtgacctccagatccgcctggatctggtggggtggtggccggcgacggcgtccactggtgggggcgtccgcggcggcgcctggtggtggcggcggcggtgtgcggccggaccatggccgacctggctggcgatggcgattgtcaacggcggcggcggtggctcgatggcgactgccgacggcggcggtggcaacagcttgcggcggcagttgctgaagatggcgacagccgacagcggcggcgcagctgctgtcggcgatggtggctggcgacggcggcagcggctggatggcgactgccgatgacggcggcgacagcagcagctggcggctgcgctggctggcaatggtgacttgtgatggcggtgggtggaggcacggtagtgaccgtggctgcggagggaggaggcacggtgttggcgaccgtgcctgaggtgggaggaggcaaggcggccttgggcggctagccaagggcgtggtagacggctgcatttgaccggcgtggcggcgtttggaggagaggtcggagtccggcttggtgtacagaggcacagccgatggcagcggaggccggctcaatgtgagaggcgcgggcggcggagatggaggccggcttggcgcgagaggcgcggccgatgaagggaggccgactggcgcgagaggcgcgtccggtggagaaggccggcttggcgcgagaggcgcgaccggcggtggaagaggcgacctcggtgcgtggtggacttgttggttggtgtggtgcggtcttcggcgcacaaaggctggccgacggggggcgtcggtgcaagggccccacatgtcggcagagtttgagtggtgggcgagcatcggtgcgtcaaccgtcgattcgcaggtggtgagcggcgggtgaaaacccagctcggccttggccggaccgacaacgatggttaattcccccttctgagggcgttgccgtgctgtctcacccctcaagtgtggttgccgggcgaaagcccagtcttggctctcagcctgacggacggcggcgactgtttttccgtcgcttctcttcttgaagacgtcgttttggcacccccttgctgtagggcgatctcgtctgtgttccgttgttggtctagcgacagctggtcatgcttagcggcagccggtccggtgctaaccttctccggtcgtgtgtattggcgctgtcggtgtgtgggttggtggtttttattttccttttttttagttacgaccctctaaggttgtaatcttgtaattttttcctgctctatcaatagaatttcgcaccgtcttgtgcgagtcgttcaaaaaaaataggtttaataaattcgtctcgcggtttacaggcggattctgtaatttgttttgttattagattacgtttaatactttaaatgtgtgtccatatatcggatgtgacacgctaaaactttacacccttcgatctaaacacaccctaaacttcgaaattaatctgcctgaaaagactagtgcatattaatagcccgagagtttaaaagaaaaaagaatgggaacctatacaggcttgtcatgcagctgatattatgagtcaaaattttattactctaataactcaacaggaaactccttttggcatgcattccaatcaagacgacaatagcaatatcttaaatgaacctattgctcatatccctctacctgcaggtattagatgttacagtgatgcttcatggaaagacaataaagtgaatgaatttagtagaaaagtactgtatcggatttgaaccactgactcacgtcttaccgcggcattactctaccactaagtaaaaaaagccctttatcggatttgaaccgatgacttatgccttaccatggcattactctaccactgagttaaaagggcttcttattcaattccaaaattagccactttcatttcccattataggtctactccataatgtacattatatctgtatatatcgagatatataagtctattcatggtcaggttcaaaaaaatcttaagaaaatcaagaaaaataggaaaatctttcatattctctcttatcacttgcacaaagtatagggttttttatctttaggctattgacttttcacatgctcagaacggtctgaaaaattagggacttttttcttctattggctgatcttatcatgaaaactttctccatttatgttttatttcctctaattgggtggggtataaacgaattcgcgcccttcatatacccatatggctgggtattaattttcagtgatatacttcttgtctgttttggtgagaggttgaaacaatttttaacaggcatcccttggaaaaaccttcgagttcaaaactttgcaatttttcttaagcggatttgttgaagcgattttcagcaggtacctcttctcttagaaatatcttagaaatagggtacttgaatattctcaagggattctgattggtgcattttgaacaaactgtagtggagttttatcaccaattttcttgtaaaaggcgggcagtagaatttatactgctcctggttcagggttttccgtttccgaaaactagcaaaaaaggagggttctggaacccttaaggttcgatggtatatggatatggaaaatccaacatgccccatcctaataggaaaaggaagggaacagatacccaatatgattattgggaagaacttttggtaatggtctcgggcctatatgctcttttttgtgtgttcttagttctattcatcttctttgattcttttaaacaagaatctaataaactagaattgagtggaaaagaagagaagaaaaagttaaacggagagaatcgactaagcagagacattcagaatcttctttacatcaagtaaatccttcggctcctatgtgcctttttctttaagttatttattgtttctctcaagccatagggaaagtgtctatgataaataaaaaaaacatctcactctttctctatggcccagatttcatgataagtgggggaagatgttttcttccccaaattctttgttcaattctgaacaaaaaagaaagtaaaggaaaggcccgcgatcgaagtaccaaccgctaactgtgaggaaccttctctgtttcattaactaagagggaattagcatctttctcgaatggctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaattttttaaatatgagtaaaggatctatggatgaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccaattcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccctnnnnnnnnnnnnnnnnnnnnnnnnnnnnnnnnnnnnnnnnnnnnnnnttctgtataaaataactattctatttgtctagacatggtagaggcctgtattcaacctttttcgtccaccggtttccagcgctccagagcggagtagagcagtttggtagctcacgaggctcataaccttgaggtcacgggttcgattcccgtctccgcacttagcagtctgtataaaataactattctatttgtctagacatggtagagggctgggtggttgggcggtatccaaccctttttattcattagttcccgaccctataaggccaaattgagcaggttgcgaagtaacttgctaccacaagaggaactctcaaggccccctccctaccttgcagaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtctcagggtttgggattttcattcataatcatcaaaatcatatgggcgtgtttgttcaaggtttctctcacaaatttacttctccctttcaagctgaacttgccggtatcatattttgggcttccatgttcgtgcaagacttcagatgcaggaccctatcctaatttcagacaatcaaagtctaatcaaggctatacaagattaatctttcatgcaaaagccacctcactggtcctttttcaactaaagtttctattgcagggtcaaacaaataaatttcggtgggtcccaagaaaagaaaacaaaatggcagattatttatgaaaacaagcaagtgcatttgttgccaatgtacaggttcacaaaatatgccaaaatatcactcatacctgtcatccttcaacgtcttgtcctacaatggagatgttattctccaatccctttggagatgcttctagtttaataaagttgttaagttctaaaaaaaaacacgctctccacacgctcgctgattttgagtcacgtcgactgctacaatcaatcacccaggagtgagtgtataatataagacattttgagttttcgtttgtattgtttgaccactcgtcttattcagaaaatttatgcaaatataaaaaacgaaaagttatgcttaaagtaccttagataataaagtaagtaaaataaataaataataattctaaaattttttgaataagacgagtggtcaaacagtgcaagcaaaaactcaaaatctcttatattattagacggagggagtagtaatcaagagtattagcggtcaccgaacagggcaaatcaatcaatatactccgcatagtactcctggagaactagagactgggcatctccaatgtttatgatcataagtagcattaaggtgggtcccactattcttatggttattaccacaatgtttgaagcaagagtaaactttaagatgggtcccacaatgtactattctagtacttcttttatcagccatgcaaatttttcatcctcacattcattttaccctattattttattgcttgtggtcaagccataaggttaaagctttcttttgcatttaatgccttatggctttgtttcacaatgtatatggtcactataaaaccttatggcctcttcttatggccatattgtggctgccctgcaaaaaggaaattaatacgaggaagagcacagatgagcaatagaagtatcaggggtgtcaatagtcacacagcactaacactagactgccaactagcagttcaggtgatcactgatcagagatagcaccaaataaaaggtctatcgaaggagtacatcatactagttcaggtgatcttctccatagaagcaaaagccctcatgtctggtggtaaagtgccagcttacaggagagggaacaatccaaaaccatgtcagctgacaccctgtactgacactgacggcacctggctgtgctggggcaacgtatcgtgatgatacggtgacctggtgctactgctggatcggtgcaatactgaaaagtgaaaagaatcaagacatgcacagagtgagacgataaaccaaaaaaagacaccagtactagattagtatagctaactccagttacctgaacggcattcaggcccgtaagtatccacgacgaggccaccatggtggccaccatgtaagcacacacggagccaagtgtgcccatgatgatggccacacaccgctgaggagaaacccctggcacaatcaaaacaaaatgcgtctctgtagtgtcgctcctcggagaccgcgactgcctcgtcatccatcaactgtgttttgtcacaagttaggtttggtttagttccctaacttttttttagaaaaaacattacatcgaatctttgggcacatgcatagagcattaaatatagataaaagtaaaaactaattgcacaatttgcatggaaatcgcgagacaaatcttctgagtctaattaatctataattagccataagtgctacaataacccacatgtgctaataacagcttaattaggctcaaaggattcgtctcgcggtttccaggcgagttattccccccgtcccaaaatataagcatttttagcatagtgacaagtcaaatatttttaactttaactattaatagcaaaagaaattaaaaagatcaaacatctaaaattaatgttactagatttatcattaaacaaagtatcataatatgcaattttttttatttaaaacatcttacttttatagatattgttggtcaaagttgcatatcggaaaccgtgttagactctaaaaatgcttatattttgggacggagggagtatgaaattagtttttttcattcatgtccgaaaacccgttccgacatctggtcaaacatctgatgtgacactcgaaaattttcttttcgcgaactaaacacaccctcattagtgatctaaggcctggtttagctcccaattttctttttcccaaaaacatcgcatcgaatctttggacacatgcatggagtattaaatatagacaaaaacaaaaaataattgtttaaatttacatggaaatcgcgagacgaatcttttgagcctaattagtccatgattagccataaatgctacagtaacccacatatgctaatgacggtttaattaggctcaaaagattcatctagcggtttccaagcgagttatgaaattagttttttttcatatccgaaaacccctttcaacatctagtcaaacatctgatgtgacatctaaaaattatttctcgcgaactaaaatgtgcctaagcaagcagcacacgaattgaatggtaagtagtaatgaacaaacctgtaggctacgaaggcacgcgtgatccgccgaggcgacgtcacccttgcagatcgtacagactcccctacagcgcccgccgtctgggtcactgacgtggcgaatcactgtgcggccgtcgctgtcgatcacgcggccggtggtgaacctcgagttcttgctgccgaatgtcccaggcgcgcaggaatggtggctaccacagcaaagaccacagcaaaacccagcaaacacggtcgaacctctcgcatggcacagcaaaatcgtccagtaggaggtcctgcgcccaacggtgtccggcgacctcgccagagcgcgccttgcactggaacgtgcaaaacagcgcgctctcggcggctaccagcacgtccgcacacgtcttgcagcgccgcccgctcggtggacgcagggggaccagcttccccttgcccttctctactggaatggactgaaaagaacacatcgaaatggtcaagattaactgaacttcgaagatcaaacaatcaacaattcagacaggaacaagcaatgaacaacttgcatccggcgtacctcgatcccgccaacaaaccagctccaaggctcatccccaatcacacgaagataacctccacctcctccgcctaagaacctaatgagcaacgtgtcgtgtccagccgcgtgggtctggtggtcttcctcgacgccagatcggcactccggtgccacgcagtagaataagctctcggcctcctcctcctcctcctcctcctcctcatcgaagaggccgtacacgttggccttcctctcaacgagggaaacgtcagaaaagatcgtcgtgcaccatggcagcaatctgcattgaaccaaaccaatcagagattcagcaagaaacgcaatctaatgattcccaacaaaattcgatcccgaatcccaaatttttgtaccgcaattgaaccaagaacccgatcttttctcacaattccatccagaaaccctcacccaatcaagaaccacacaaaaagatgaacccaatctcacaactccatccagaaaccctcacccaatcaagaaccacacaaaaagatgaacccaatgtctccaagggtccaagaacagggggaaaactcacctcttcccgagacttggggccctcgagcaggtgctcgactcgccgaccttgctgctctcggagtaatcggctgcacgtgagcgccgccgtgcgccgtctgccgccgggatgcaggtcgatgagggcgcattgccgtgcgtgtgcgccgcgcgccgctctgcgtcttcgtcggccttccctataggtggggcggagatggaagtggaggcgcgtgcagcggcgcgcgctttgcggcgcgcgtccgtcggaggagagcacatgatccggcaagaactgctcgccggaaaccagaagcgaggaggaagaagaggaggaagacgaaggagaaggagagggagaaggagggagggtgttttttcttttcttgcgacggattcaggagggacagaataaataggacgcccgccgagttgcttcgcttcgaacaatcacttctttacgtcttccttcgtggcttcgcgtattcttgttttacgtttttaccctttttttttctttttttttcttttttccttgtgacacattctccccgttttagggggcgggcccactgtgtgtacataggtattttagatgaatacgtaagttttagtttgacaaaaaaaacatatatgtaatgtataatacatatatacataggaaaagacaaaaagtaataagggtatattgaaccaaagaggctaaaatgccagatttcagacttcctgggcatagctctcctccttgcatgcgtaatgggccgagccaattgagcaaatccaatccccatacccctttgcgtctgatgaactaaattttaaaatataccgttcattttttttttaaatattcgggatgcaaaattttttgaagaaatatatcgtcgatcttgcataatcttgcacgaaaataacgtaaacgtgacgtggtggatggacgcacgataaaagtgcgagacagcgcagtctcgccaaatcaatcggcgacaccatccaacggtaatagtactgtaaatacggctccatttgattagagattaaattatctaattaactattaactaataataattagtgaataacttaattaatcactaatcaagataattaaccattaattaaatcgacatggctccgtatcactgtttggttcggcaagaccattctgtctcgcacgagaccatgcggtctcgcgctgctggtgtgcgagaccgcgtgatactgcccgtgacatcgcgctcacatcgttttcgcgtaatggttgtgcgagaccgacgatatatttctaaaaaaattttgtatcccgtgtattcctgaaaaaattgattgaacattgtatttttcaaatttaattctgctccccacaacggcatgaccacacctccggcaggctgcagcctgcagccgattcgttgcccttgtcgcaaccgcacccatccgtggcaatgtgggtcttcctctcctcagaatcatgcatccacctcctccgccgctcctccacctcctgtttgaccccaatgcacttccaatacctagtctccaagtgcgacctctcgccggttgcgcctgccaagggcgtcccgcgattcgtacactagactccacatccaggcccaacgatgcgccgcaagcgccggaccagcccgtgtttagtctactacgctgccgcgacgcgatgcaaccgatcgatgtttggtgcgtggtagcgttggggagcgtggaccggtgagctcgtgaggatcgaggagcgagacgcccgcgccgagaattgcacgaaacccatccgccggggcggggagcgcggggggaaagcattgctcactgccgagttctagcaatcgtgcgcgacgtgtcatgcgagcttggtggctctgcttcctgcggaccgagtgtgccgtcgcagtaaccaccccggccttcttcaacccagccgaacacaagggctgctgccattttagcattggggtaattgcaaatttaccactactttaaatagttattgcaaaactgtcactagaaaattacaaaaataccactggaactatcattcgagtggcatccttgcaaaattaaaaaaaccagtggcaaatttgcaaatgcccctttagcattcgatagcctctgggcccacatgcaagcgagagaggttagggtaaatgaaaaacgagacgcatatcatcacaggtcgtaaccgcatgagacgaacatggtgtcgtcgtcctccccgtcgttgcctagtactggcttgaactcgacgaccatgtagttcccccgtctcccccgggtaggggacgcgggagttggtgccggcggcgatgtcgcagacaaagtagtacggggcccaaggtagcggctcgtcggagtccggaggggatgggggcttagacgaggacgagcccagcggaggggtcgagcgcgaggacggagacgtcaccgagcaagacgcgcggggacacggtgagcaccgactcgcgtggcggcgcggcgagctcaagggagacgtcgtcggcgccctgcagcaggacgggctcgctatcgccgccttcgccgccgcacacgcacgccttgcggttcaggaacacccacgtcggcgacgacggaggaggcgtcatacgagctcgatcggtcgtcgacgacgacgtgcgcactgttagagtagatggtagataaagatatattagaatatgattaatttgtgtggattccttccttacatgtaatccttccttatctctacccatgtatcttctatatatatcggcccccgaggctcgatacaacatgtccaatattcgcagtattcctctctccctacactatccaacatgcaagtacgggagtaaagggaggagtagaagtacctccgtcccataaaaaatccattcctaacatcccaaagagagattagtgaagagtaaaaatgactaaaatattcctcattattagaaaaagtagtaatatcgataggtagataaggggtgtttaatagagaaaacttcttaatttatgtaccgatgttagataggatggtagttagttttttgtgggacaaaattcaaactctagaaattactcttaagttttttttggacggagggagtagaagctagttttgaggagagaaggggatgaggatgtcagctctgctggagtacctgatctgctacagggtgctgctctgaaggagggtgtcaagcagacttccaaggataggccagcaagaatgattaaacgtaacccaagggtgtttgggccagagtgggcttaaggcccaggccagctgtaagggtgtgagttgcgtgtggagtgtgaattggtgagagagcgatataactaactctgtaatattctgtttcattcggcaagaaagaaggtggcgatggcggcggcggtgccaatcctgtcggattggtagacgatatcgagttcttgagaaagtttgtgtgttcttagttagagtagctaacaaatctggtatcaaagccgagctgaaaattttttctctcaattcgttctaattttgcgataattcctgggcgaggtggggattgttgccttgtgcgacgaatcccacaaaagcttcggctccctcaactaggtccgcaagatttgagcgttttgccaccacggctctttacgagaagccccgctacgtcaccaagcaggccgcgaagctcatggatcacgacggcaagcttgatcttcttcttcgcaagatggaggagacggagaagaaacgggaagaaagcgacaagcgtctggagaaattggaggagcaaagcagggcagagttcttagccctcaagctggcggttgagtcgcggatcccagcggtggagaagcatgtggatctcctacacggctcggtggtggatctgcaagagaagatggagaaattgcagtccgtggttcaggatccttcccgtgaatgttctcctgctccggatgcttctggtcaaaccttcagtactccctctcctacctctcccaatcatgattctgatgttttggatcctactttggggaattgggctagtgctggcaatacatctggaattgggggatcagtaccacctatgtcctgtccacagtttgacggtgataatcctcaaatgtggaagtgcaattgcgaagaatattttgaggtctatgggattaatccaaagcactgggttagagtggctggcttgaatttcactggtaatgcagctttctggctccagtctatgcgctctaagcttgtggaggtttcatggggagaatttactgaacatgtttgccttcgattcactaaggacaggcaggaagtgttgattcgtcagtggtttcatatgattcaggattcttccgtttctgcatatgtggaga

SEQ ID NO: 40282 - DNA, 12064 bp, Oryza sativa
  unsure (1)..(12064): unsure at all n locations
tccttctgtttctttaaaacgagtggattctgcttcttttgttaaacagtttcctagacagttctctctaggcccttctactcccaagcctgtttcagttatgtctcctgaatctcagtctgcttttaaagtcagagctgataagttggctgcattgaaatcgtatcgcagatctaagggtctttgtttcacctgtggagagagatggagcagggagcacaaatgcagtccatcagttcaattacacattgttcaggagttattggaggctctacaacaggatgattcacatcaggaacttgctgactctgattctgttgagacagttgtgatggctttgtcacagcaagctttctctggcactgaatctgtcacttctttcagattaagaggttgggttcagggtattgaggttctgatgttagtagactctgggagttctcattcctttttggatgtttctctgacctccaaactaaaagggattagacctttactcaaatcggtatctgtcaaagttgctgatggtggcattttgtcctgttcttcttttatcccagcttgtacttggtgtactcaaggccaatattatcaaactgaattcaagatacttccattgggggcttatgatgtgattttaggcatggactggttagcttccttggggcaaatgcatgttgactggtttgctaaatggatggaatttgttaaagatggccatccagttaaattatagggtattcaggctcttactgatcaatgccattctatccagggagatcagttacaggggatgcttaagttgggctctattatgcatgttcttcaaattcatcaagtaattccttctcctgcagtctcttctgttcctggtttgcagtctgtgttgcaggaatttcagtctgtctttgaagaacccactaccttaccccccaggcgagcttgtgatcatcacattcctcttctccctcattttaagcctgtttttattcgaccttatcggcataaccctgctcaaaaagatgagattgagaaacaggttaaagatatgttgctttctggtgttattcaacctagtaacagtgcttactcatctcctgctctgttagtgaaaaagaaagatggaacttggaggctttgtattgattataggaagttgaatgctattactgttaaagggaaatttccattgcctgtgattgatgaactcttagatgaattgtctgggtcaaagttcttttctaagttggatctcagggcaggttatcaccagattagattggttgccggagatgaacataaaactgcttttcagactcattctggtcattatgaatatagagtgatgtcttttggtctcactggggctcctgccacttttcagggagctatgaatgatactttagctcctgtattgaggaaatttgccttggtcttcttcgatgatatattggtttacagccctgatctttcctctcatttgagccatctcaggcaagtgctgcaattactttgtcagcatcaatggaaagttaaactctctaagtgctcttttgctcagcctcagctttcttacttaggtcacatcatcagtgacaagggagttactactgatcagtctaagattgaagaggttgtcaattggaaagtgcccacaactgttaagaaattaaggggtttcttgggtttagctgggtattacagaaaatttgttaaaaattttggcatcattagtaagcccttaactcaactgctgagaaaggatgttccctttgtttggtcccctgcagctgaccaggcttttctgtccttgaagcaagctttagtttcagcacctgtcctagccttgccagatttctctttgcctttcattgtggagacagatgctagtgatgggggcattggggtagttttatctcagcagggtcatccaattgcttttgttagcaaggctttgggtgttaagactaaaggattatctgcctatgagaaagagtatttggctattttactggctgttgatcattggagatcttatctgcagcaaggtgaatttgttatattaactgatcaccatagccttatgcatctcaatgaacaaagattaaatactccttggtaacacaaagcttttactaaactgttagggttgcagtttaagatttgttataggaaagggtccagcaattcagcagctgatgccctttctaggaaatataatgatgactccagtgaattgcaattggtttctagctgtgctcctgtgtggcttaaggaagtcactgatggttatcttgaggataacttctctgcccaacttttgactgatctttctctgaaggccaatgctcgaccacctttttctttatgcaatggtgtgttgaaatataaaggcagggtatggctgggtaacaatcttgagatgcaaaataaagttattgctgctcttcatcacagtcctatgggtggtcattctggctttcctattacttatcagcggatcaaagctttgtttgcttggcctcgcatgaaacaacagattcagcgttcgattaaaggctgtcaaatctgtttgcaagctaaacctgacagatccaagtatccaggtttattacaacctcttccagtccctgatggtgcatggcaaattatttctatggattttatagaaggtttacctaaatctggtcgatttgactgtattttggtggtggttgataagttctccaagtactctcactttgttcctctatctcatccattttctgctgtggatgtgtcccaagcttttatgtgtaatgtgtataagttgcatggtttgccttctgtgataatttctgatagagataagatcttcaccagtcagttttgggattagttatttactcgttctggtactcagttgcatctcagtacggcttatcacccacaaacagatggtcaaatggaacgtgtgaatcaatgtctggaaatttatttacgctgttttgttcatgttgtgcctaccaaatggagctcttggttatatcttgctgagttctggtttaatacttcttatcattcagctttgtcaaagaccccttttgaagtgttgtatggctatcctcctggtcattttggtattcgtgaagatgcttgtagtatccctgatttgactgaatggctcacagagcgaaggttgatgactcaattgttgaagcagcacttgggcagagctcaacaacaaatgaaacagtatgccgacaagaagagaagcttttgggaattttcagtgggtgattgggtttttctcaagcttcagccttatgtgcaatcttcagtcgctaggagagctaatcacaagttgtgctttcgttattttgggcctttccagatcctgagtaaagttgggttagtggcatacaagttacagttacctcctgatagcaccattcatcctgtttttcatgtttctcaacttaaatctgctgttggattctctccttctgttcaacctcagcttcctgccttatctcatctgaaggtgccggtggctgtgcttgacagtcgtcagtctcatcgaggtaactctgtggttccacaagttttagttcgatggtctggtgatgttgctggacaggaaaccttggaagatcatgtggagctgcaacagcgttttcctggtgctccggcttgggggcaagccttgtctcaaggggaggggattgtcagctctgctggagtacctgatctgctacaaggtgctgctctgaaggagggtgtcaagcagacttccaaggacaggccagcaagaatgattaaacgtaatccaagggtgtttggaccaaagtgggcttaaggcccaggccagctgtaagggtgtgagttgcatgtggagtgtgaattggtgagagagcgatataactaactctgtaatattctgtttcactcggtaagaaagaaggcggtgatggcggcggcggtgccaatcctgtcggattagtagacgatatcagttcttgagaaagtttgtgtgttcttagttagagtagctaacagaggaaatcgattcgacgaagagagatggcgaggaggattggtaatacgagtttgaatcaatccgcgtgggtttttctcgcgtggtgctgtggagagggtagagaggccggcgtgcagcgctggagaggaggattggtgatcgttctctttttctttttggcagttgccgttttggtgtctgcagagaaagcaagtcgtcgaaaggcagcggcgaaacgcccgaccagctcgtgtctacgctacgctcctgcgcgcgatgcaacctagtccgaccggtgtgtggcagcgtggggaatcaggcgcgtcggggcggtgcgaaaagagttcgttcgttcgttcgatcgtgcattcgtgcgtgcgtgagccgagcgagacgtgactcgtgtagccacatgagctttgccggtgccggcgtgccgagctgcttcctgcgcaccgagctagtcggctacgtgagtgggacgtcgcggcaggcagcaacactgccacgccagcggccgctctgcttcgaccagctgaacacaaatgagcagcgcacgaaagcttccgctagctaggtccacgaacaaaaaccaaatgagatgcatgtggtcgcaggcaacgtgacacgaacaaaatactttctactaggcagtaggcatagcatagcttaacccttaagatttcttaataacatactgcaatgagaattacttcgtactccctccgtcccacaatataagggattttgagtttttacttgttacgtttgatcactcgtcttattcaaaatttttttaaatataaaaaatgaaaagttgtgcttaaaatactgtggataataaagtaagtcataaataaaataaataataatttcaaaaaattttgaataagatgagtggtcaaacgttgcaaacaaaaacttaaaaatctcttatattatgggacggagggagtatgatatgaaaaatacttcttcaccggatacaataaccactccagaaaaattcaaacaaatgcatgccttagtgaacaatctaatgttttcgtaatctgttttttaggagcgtttagtattttttttaaaaaaaaatcagaacagtttatctcttattgtcaagatgtagattgatgaatttgtggcttgcaattttttttctgaactacacgggaacctgccttgttggggatcaaaaagaagagctggaaatggagaccatgtgtgcaggcagggcaacttgacaagtactgagtgattttcactcaaagttgattccaggttccaactttgaggatgcaacagcagaaacaataatcaagaggagcataacaaaaagacaaattaaacctgcaaagttaatttaattatccaggcatgctattaacatactactcgagtactaccgcaataagtgcaacattatccgacataagcataacaaatcatgaaaaggaatagcagcattctacagtcattctcaagaggcaggcgaagagaactccaaaatgcgaacatttgaaagatccaaaatgcctacatccaactggttatcacacgcagaggtagcaccctccttagacaaacctttaatcaaagaaaacacaagttagtcaaaatactaacgaacatgcatgtttgagtgacaggaagtggtactaataatcttgccctaaaagtgcatttgcatggtttgataaaaactacacaaatttctgttattataggataaaaagaagaggaagcgataactgatagaacaacttgatttgagtgataggaattgaagtggtaataatcttgccctaaaaagtgccatatggttatcaggaaataatattcacatatatgaataagagaatatgaagagcaagaggaaataataatctgagactgctgcaagaagttggtgcaaatgtcaggaataacaggatacagcaaaagaaactactagcaggaaggtttaagtgatgaatgtaaaagaaaacatgaattgatgtttttatatgtatccatcttcaataccatgtgtacaattgtgcatattgctctcagtgataggtcttagtgtcttaccaccttgttagtacattcagaaaaattcagggcaacataaatgttctttacatgaacaaaatgaatgtattgcaatttcagcgtatggatgcaagatgcgtaattatacatgacacatattacacggttcatgcggacagtgggtatgaattaagcagcagaactgaactttttatcataccgagtaatgcatatatatatgtgcaaatgtttatgcaaacaaacaccataaataaaagttctagaccaaatttgtcaaaatttaatgaatttcaggaaccatcaagatcaacatatgaatggccaaataggtaggcaagaaactcaaatgaactccaattatttgggattaaacgcaaactgaacacaccaattcatcaaaatttactgaacgcgcatactgctcagaattcacaacaggtcggtaccatgaaaagcagtcttatatacacacggcacagacacatcaatcaacatggaacactgaacacaaaaactagccaatcaaaccatgagatcaaatgcgcgcaaagcggacataatagctaggacatactggtataaagttgctcaatactgtcactacacgaccaataggagcagtacttgaaagttgaaaccacactaccctagtactatgtcccgttctaattagcagatttaagaacattgacaagatgagcactagtagtatcaaggaagtgttgagcgcacgaaacaattacctgcggagagcgcgggcgggagcaccattggaagaaggccgtaaggaaacacacgggcgttctccggcacggtcatcttgtgggtctcatactccaggacctccttcgcgcgcaggtcgacgccgacgagcggaagaaaatttggtgagactgaagtcttacgctcccgcgaaaaacttaatctcttgtgcgacacgtgttctgttacaatctcaaagcagataactccctcaaaccctcttaacgatacaacctaacgccgttagcacgcgagaagacagacgcagcgcgcgcggctacggggagatggacgagcgcggcgcgggagatgaaccggtgctcctccatggagtgctggcggcccggcgccgatgagttagaaccattttgagttttcactttgtcagacacaagcatcagcttctctgcaagttctgttgtcttgttattttgtgtttttgcatatggatattataagacatcttctaatctaatctgatgaaattctgaactgagtgctcaagtttgttcttcttgttctacttcactgttggagcttgttatcttaattcccaatttatataatcaccaatagtcaagtttattatcggagcttcaatagtagagctctgtacttaatttatctaatcaccatatgagctcactgtatgtatggtgcagatgcaactgttaggaatcattgccgtatcgttcaatgtcttaggccgctgccgcagccgcggcatatgccaccatgcactgtccctcaggcatcgccggcgtgggagcttcagcctcatgtcgctaccctagctaccgcagggccaccggcgtcggggctttcaccgccaccactattgttcctcaggcatcaccggcgtcgggccgtcagcactccatcgaggagtcatatctctcatcgtgctcgtccatctccccgcagctgcgccatgcccgtcgtcttctcgtgtgctaagtgctaacgacgacgtgccgtatcgttaaggaggtttgagggagttatctgctttgagattgtgacaggacacgtgtcgcacaagagattaagtctttcgcaggagcgtaagacttcagtcttaccaaattttcttccccgacgagctggtcctccacgaagaagtacaccacgtcggggttcttggggtggacgagcgcgagcaccggggccttctccggcagcccagccgccttgtagctctcgctggcccagaggtcggcgaagctcacggcgtactcaagcgtccacaccttggtccctgcctccctggatcaaccagcgtgtgcatggagaccttggtagtagcaccggcaccgtcgcttgcagagcctatgtccacgcacctgaacttgccgtcgctcagccgcacgcagcggcgggagacgaacgctctctcggcgcagtagtcgcagccgtggcagtcctcgtcgtgttctggcgggagctcgaccctggggagcgggacgtactccatgtgcggctcgtcgacgaacgggtcgcagaagaggaggcccgccgcggtgtccacccagtagagcttgccggcgtaggaaccgacgtcgaagcatctccagatccagcggggcagggggttgttgacgggcttcttctcccacaggccggtctcggacgagaagcagaggagggtggccttgtcgccgccaacgatgaacttgaactcgacgaccaggtactttcccccacctcctggcgcggcgatgatgctcagatcgttgttgaagacgcatccctcagggtcggggaggtagtaggcggtgcgggcggcgatgtcgcagacgaagtagcgctgggtcggcatggtggtgacgtggtacgtgtgcaccttgccgtcggcgtcggtgaaggaccgcagctcaccgggaccaggtcctgggggcggcggcgcgaggaggaggacgagccccgcagaggggtcgatcgcgatgacgaaggacttccacttggcaaaggggctcaccttggccggcgtgatgcgccgggacacggcgagcttcgagacgcgcggcggcgcggcgagctcgagggcgaggtcggcgccctccggtagggggatcccgccgccgccgccgtcgccgtcgccgcacgcgtacacctcccggctcaggatcacccacgacgtcgacggcagaagaggaggccccattcgagctcgctcagatgacgccgcacagctgcttggtgcgagctccgggagatggggggagagagagagagagagagagagaggagaggagaggactaggactagtagaagaggcggaggagctagggtttttgaggagagaaggccaggaggaggagcggtgaccggcgagctttcgcgattgccgtttcgtggctgcgtgcggagaggggcggagagccgaagaggagaaagggaggcgacgtgaacggaaagattcgcggcgaaaggtgtggcaggctcgccgcagcctttgtcagttggtgattgaacgcgcccaaccaatccgcgtcgtctaccacactactactcctgcgatgcgatgcgagcaaggcccggcgctgcgtgcgcccggtgcatcagtgcatggcagcgagaggaccgtggaccggtgaagagcgagcgagacgctcgcgactcgcgagtgcacgaattcgcaggggaaaggcgcgcgatgcggggagttcgtgcgcgcgcgcgggcgggagaggctgtcgcggtctcagctagctccgcggcatgcgtgatcgcctgctcggcccagtagaaatcttcccccagttctggacctcgtgtcaggacaccggtggccattgtggtggcccatacaacatggcccgcatggcgttctggatcaatctcagcccaacgccgaacagacacggcccatgttcaacgagcagcccacaccacaacgccttctcggttccgcagcggcgccaagcacaacagattcgccgagagacagcacggcgtgccacggagacttcagggtcactccagcacgggctcctacaccgaaccaaacccatcccaagcatctggaacaccagagaccccagatggcatcgtagaaacaacagctcaaaacacggtcgcaacacaacactgctctggtttccatctccacatgacctcttcgatgcgaacaactcgaaatccaacctccaaagcgcctgaaccgaaaggcgacgcgctggccgagacaaaccccccatacacttgctgctgtccaatctaatcactccagtaaacaaaaccctcgtgccactgtcgtatccatcgcgcaaccgacagcagcgagccccattgatgagcgcccgcgcattgaaaacgcatagaagctcttgacacggcgccaaacccggctcctgtgagattcgaacagcttgccaaatgccaatccaaactgcgacgtgtactgtaatggtacagcaacgggcagcatggagtagtcgaatgattgatccgtataaaaatggcgcatcatttttgttgaggataaaaggttcagaagcaaacagcaaacatggattagtactagtagtactcgtaataaagaggtcagattcattcattcactcgtttgcattagtatttccatctctcctgctgagttgaagagcaggaaatacttgatccaaccaccccatgggccatcaccatgagccttgaacaatactcctagcttatctcaggagaaaaggcaaagtagcagtactaattacagtacacacctacatttgattccgtcacagacttttcttctctcgatggacagcagacgagcgatctgccctaccggcatcaatggcacggtccacatacagcaaggacaaccaagaacaccgggcacccaccagcttactgtcctccattgccggactggagtgcacagctccagagttaaccgtgctgtcggaggccggcgtcggcggcgagcaaattcagcgctcaaaatcagcaactatagaattttggacacgactgggttatgattgcagctttcctacctagctacagctctacaagccatgggagaagattcatggaagcagctattggcctattgtcatcttcttctcttttgggggtttttacctttacacgctgctcccttgatcggaggtgtcctcgtagtagtatggcgacagcttgccgtccttctccagccttggccttgtggcctcggcgcgcacttcttgcagcatcttgaccaccctgcgcatcgccgggcggttgatcggtagggagctcgagcagaggagggcgatgttcagcaccctgttgatctcatccttgaaggtcatgtcgagtttgctgtcgaggacatgttctacccccttctgatcaattgtgctgcacacccacttcaccaggtccttctcgccgaactctggatcgactggcggtttccctgtcacgagctcaagaagaaccactccgaagctgtatatgtcgctcttctcattgacgcggagtgtgtatgcatactctgcacaaaacaagtacatcagattcacaattctaaaggactaactgaaacttacatctaaaataattagtgagacttaccaggtgcaatgtaaccacatgaacccgcgatcactgacatcgacttggggccccggacagtggcttctaccactttggcaaccccaaagtctgcaacacgggcaccgaattcagcatccaagaggatgttgttcgacttgacatccctatggacgatcgcagggacgtagtcatggtgaagataggataacccctccgctgcatccagagcaatcttgtaccgcgtcgaccaatccagcaaaccagccttgctgctgtgtagcacatctcctaggctaccattgggcatgtactcgtacaccagcaacttggtgtcattgtgcgtgcagctacaccagagcttgacaatgttcttgtggcgaatcttgccaagagtcttcacctccgcctcaaagctgttgtcagctgtggatccttcacccccgttctcaacatccgtccccttctttaacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40283 - DNA, 986 bp, Oryza sativa
tcacaaagaaaaatataactgtgaagttctctcttttctcagagcacaagtatgagattgtaaaacgtctgcaagcacggaagcacatctgtggaatgactggtgatggtgtaaacgatgctccagccctaaagaaagctgatattggtatagcagttgctgatgcgactgatgcagcaaggagtgcatctgatattgtactcacagaacctggcttgagtgtgatcattagtgctgttcttaccagtcgggcgattttccagcgaatgaagaactacactgtaagtcagatggaaacaaacatagtgtcttttaatattctgcctttttccttgggttattttgctaattcatttccatgtttgcagatatatgctgtctcgattacaatacgtattgtggtatgttttctttactggagaactagaaattatggatttcctctcatttggtaaataaatagttgattgttctcgtaggtattttagtttaactacaggtcaatcagaactaaccattcagataaatttaacagaactaagcactaaatgattccagtgtataaccttttgtacacattaactttgatgatccccaatatgatgttttcatcttactatgccaaacaatgtgtatcaactttatgttttagctagcacttaatgtatattgactgctcttttgacagtttgggtttatgctgcttgcccttatatgggagtttgatttcccgccatttatggttctgatcattgcaattctgaatgatggtatgtcacattcttgttccctccatccctgctatctctcctaaaacttcagtagtaagtagaaactattttcatgatgttcacttcaaccattttctggcacaaacaggtaccataatgactatatctaaggatctagtaaagccttctccactacctgacagctggaagttggctgaaattttcacaactggagttgtgctgggtggatacttg

SEQ ID NO: 40284 - DNA, 19694 bp, Oryza sativa
ctgcatagttgtcttggctccttacctatttcgactgaatttccatgcatttgtgactaatggcccatcgatttcgacagattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcggaagaggcgaaacggagggccgagattgcaaggtaggacctaaatctgcagtagacacttgtataattcttttccatgatctgtccccttaagaatcatatagaagcaccatgtcctttatattgcatcaattctcagttgcttttgccatgttccttccaagatcaagaagcatctccctttctagctgcacaatgccaatttgcatccccctggaacacgtggcgtgaaaacgatgtaaagctaactaactatgtgcttgttcttgctgttgatgctacacttgcaggctcagggagcttcatacgctgaaggggcatgtggagtcagttgtgaagctgaagggcctggacattgataccattcaccagtcctacacagtgtgatagactcttatctaacaagagtaatatggttgctgcagaggaactgtttcgtttcatctaattagtagtttttatctcctctcagctaacataaatgtaatcaaccaacagttcatacaatctataaatcaaatcatcaaaggggattgttgagattatccgtttttgtcggtgttttcctatatgtattgtcccttaaattggaggcctcccatgtgtgataccattgtgttatggtttatattttcgtacgtctgaccgcgaattcatggaatgggttgtttccattccacttttcccctgaacgaatataaaatagcttgttcagtaggaagcttcaaaatgtcacaccttaaaaagtgaaagttgtctcatctcctttcttgaaaggaaatggatgcatgaataaacttttcttttaatttttatcctgggggttaggtatgtgcaaattgttcactgaacgatcttttttttaaaaaaaagcaaaattgcagttgcgcatgcattttccattggaagctctctgttttctgcatgtaaagcatttcagatggagctggtgaaattcgataagctgactgctgaagcttcagaatcagcctgattgcagtaaacagaacgtgcaaatcagaaatgagaataacaaagtagaggaaacagatagtaatacaacattctttttcaagacaaatgacaaatacatctagcagaagttcaggctttggagatgtttgtttcgacgtgatatggctctttggtataaaggaagtaacattcagacgtttcgctctgtggtttgaacccgaaaaccttcaattgttgcacatgccggacgctcctccactcttcagagctggcatcctgcaaggatatcaggttgagcaagctcaagttgcagtttatgtgtaacctctttacctttgcctcctgtaagtaccccgggagcgtgtcagcatccaagtcctcccaaacgatgctccggactgcaggcaacctgtcaaacgccttcagctctgggcatctgaggatctcaatcttcgtcaagctcgagcagtttacaaccatctctagctttgggttgtcagccaggtaaagttcaaccagcgaatgcaagttctctacggattcaaggctcacggcgttcgtcagcaccaaagctttcagtgctctggtgtggtacacaagccccggagggagacgattcagtttgctgttctccactgtgagcgactccagagcaggcattgcttggacatgctcgtcccagtcccacgatgcccatctcaacatcccctggaaacccagccgcttcagcttgggaaacgcaatgcctgcaccttcagtcttagttgttgttgtcgtcgtcgatggtgcgttgccatcgacagcaatgcctaccggagggaggatgaaatcatgactgacatgctcaatggatggtgcatgctcaatccagaggtagtcaaggtaagggagttggcccaagccaccgggcagccggtcgcagcacgcgtagtcttctagcaccagccgcctcaagctccgaaaggcggtcgccgtggccatccactcggtagccgatgtccaaagtaacctgcaatcgtaagacggtcaattgaaggtggagggcggagatgctcaaaaacgttctcgattctctcgcaatcctcctcgctgataccaccttgcacggtgccgtttgcgctgatcctgctagtgcatctcagctccagttgtgtgagattctgcttgctgctgagctttgatcttgctgccatttggccaagtgttgccttttccagaacctccaaatgtagtgcactgagatttggcaaagatcctagctcttccaagctacaccaatcatgtgtactgtcatccaaatcggttgggaaccccaacatctcaaccaaattttctagctttccgaaacccctaggaactgaagataccattgtgtgtctgatgtccagtgatcttagcttccgcagtcgaacaatgctttcaggaagttcagacacatttatgcaaccacagagatcaatgtgctgtagaaacctcaaattccctatgaggttagggagtgcagatatgtatgtgcctttgagacctaggtatctcaaatgcttaaggtgacagatggagtctggtagtactatcagatttgcatcctcaagatgtagcacccgaaggcaagaaagattattcaagaaattcttgtgcttagtaacgatgctcctgaatagtatcaacgtccttagtgatacttgcctctgtaaagcatcccactcgacttgcttgtttgaaatacagagccgacgaaacttcagagtaccaagtgcatcacctatggtctgtttctgcatctcgttaatggacaatccctcgtccttcgctacatgttgggcaaaagaccggacaacatcatgcatggtgcatcctagttgatcatagtacccatcacttgggtccaaaaggttccttaagactaactctttgtagtactgagctgctacagcctctggcaatcctgaacccgtgctatcttgcacgaacccttcagcgatccacattcggacaatggttcttgattcgatcacctcacctcgtgggaaaagtgagcagtacacaaagcattgcttcaaatgagaaggcaactctccatagctcaagcagaccactttgttaatttcatcattcacttcatgtttacaccatgcagaatgtctagaaacctccatccaggcacctcttgttctgctcttactaagtaagaggcccccaatcatcttaatcgcgagcggtaaaccatcacacctgtccacaatttgcatcccaatatcctccaactcatccaattcagcttcatcactcttgttcaaaactatctgttggaatagtaaaaagctatcttacttaaaaatgaagtgtatacctaataacatccattgaatataagctattctcaaatacagtaaacaacaacaaaaaaaaaaacctgcaacattcatttttacctaataacaaccatgcttttttatcatgtgatttacttaaaaaaaactctcataattgcagttagaaagtagatagttgtaaaccatttatttaaggattcttcaagatctacaatagcttaaacatcgaagctcatcgtgtgaaatccgaatttcagtcccaaacttgcaattggcacaattgatcagatttgtttgtgatactgacctgcttcttgagcaaggaccaagcatcctgtcgccgcagcttgtcaacacggtggaggtacctcaccttcatcctgtgagcaacgccatcgtttctcgtggtcaccaggatccggctccccggggcgccatggctaagcgggaccctgagcagctcgttccacgccgcgtcgctccacacgtcatccatcaccagcaggaccttcctgtgcgtcaccgcgcgctgcagggcgcgctccagcaggtccttgtccccggcgacggcgaggccctcgcagctggccgccccggcggcatgggcgatggcgctgcgcagcatcgtgacctcgtcggcgtcccggccgacgaacagccagatcctggcgtcgaagctctcttggaccgtggcgtcgccgaagaccatcctggcgagggtggtcttgcctatgccgccggcgccggtgacggcaatggtggggatgagattgcagccgccgccggcgtcgtccaggtccgtcgtcttactgacaaggatgtcggcgagcatcctcgtgtcttccgcgatcttctccccgacgacgtcggatcggatgaggcccagcgcggtgcggcggccgtcgcctgaatctgcgcgccgagagcagcaaggggagggagacgaggagatgatcctagtctgggagacgaagccgaagcgggagctcctcctctcgatgccgtccagcctccggttgagcgccctgaccctcttcccgatctcgcgtgcccggacggggtcgcggaagcaggagagggcagggacgcggacgccgcggaagcagcagcagcagcccgccatggcaacgggcgtcgcggcctcgccccccgcggcggcctggcactcgtcgaggatgtcgtcggcgtcgtacatggcgtccctgagctcccgcacccaccggtccacggccgcgtcgcggtcgcgcgccctctccgcgtcggagaggacggcgcgcaggtcgccgagcgtcgcctcgagcctggagatctcgccgggcacgcccagcagcgcctcgacctcctccttcgccgtctccgccagaatgcgtgcgaggctcgacgcgaaggcgtccagcatcgccgccatgatcgccgccgacacactgtgctgggaaaaaaaaaggaagagacggagagttgaagttgcttgcgccgacagatactcacatagtcaaaactccaaacctctgcgactgctccacgtccatgatcacgagtccacccaaaccaatttccatcgtgtttagttccaaattattcttcaatctttcaacttttctatcaaatccaaacttttctgaatacacagacttgtcacactttttccagtgttggcgtcgatttgtgggacccatactgctgcatttgccgatctatcagccaaccgttcctttctccattctattctccccgtgataaacacttgtttaatcagctgagttcgactcattttggggcgtcgattttcggtctgacacatagcagccgactccggagggtataagagcaagtttaatagcatatctcactactaactccaaatcatctatagctaatgtaatagccaactcatacaatagtgcttactataatattaatacatggtcctatctgtcatatatacattacgtcttggagtccgtgctgcagctggctacagatctgtagtccgctgctattctttctcttcctttttctctttaaaatatgtttacagctggcttatagcatgctattgtacctgctctaatgggcgatcgattgccgtcgcccagtgatcggtttgcccctcctccccctgtactcctctctcttctcccccttcctcctccccttcttttctttttactacagtacaccacacaatttttttttgaaaaacaaaagttagaaaaatttatgactatatataaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcagatataattcaaattcaaatttgaatcaggtatgtaaacttttgacttataaactttggatctataaactttaggtgtataaactttaaaaatatttgaattcaaattcaaatttgaatcagatataattcaaattcaaatttgaaacgcgtatataaacttttgagttataaactttaggtctataaactttaggtgtataaactttagatgtataaactttagatgtatagaaatattatatataaaaaaatttgaattcaaattcaaatttgaatcggatatataaacttttgacttataaacttttggtctctaaactttagatgtgtaaacttgaggcgtattaactttaggtatataaatttactgaaataggaaagtaatgcgatgccaaaaaaggaaatcaggtggaggggtggagggagggaggagggaggggatcgatcgctgccccatccccagggcgatcgatcacccaacagcatttccggccgactcctatagtgtactactccctccgtcccataatataagggattttgactttttactttaactgtttgactattcatcttattcaaaaaaaattgaaattattatttattttatttgtgacttactttattatccaaattactttaagcataacttttcgttttttatatttgcacaaatttttgaataagacgagtggtcaaatagtgcaagcaaaaagtcaaaatttatattatgagacggaaggagtatttggttcggtttctctgcccgtgcgttgatttttgtctcacactggagctgctcttagggtgtgtttagttcgtgaaaagaaatttttttaataatacataaatctccgttggatttgttttggatggtccaaatctacccaatgtaacgttgtgacttgcctacccaatgtccgccaagctgaatcagtcaaaattcatagtaatagaatatcccaaatccagtgctaggttggtttttataggacgaaatgagcaagttgcatattgcactaggcaatagaaaatattttcactttagaccatgttttgttaccaaagtttgcatctttgcactttaaactagcgagctcacatgcaagtgacaaaactattttcttcatcgttggtcttcccgagtctaatttgttggatgccatttgcaaagcatttttccaccccacgcgtcaaagatcccctcttctcacaacaccggtgaacaagtcctctccccgctccgccacacgatgagcttggcggggtgggccgtgggggtgggtatacctctttttccgattattcgcttcacttttttaacagactacatttgaatttaagatacttatttttaccgatgtttcgctatcgattacccttcaagtaatgtttttactttggtccatgtagttttatgtatcattttggacaacttaatttttttattcatttgcatctaatttgtcatatatcaaagaagaattaaattttaaaatatactgttcattcatttttttctcagaaatattcgggatgcaaaattttttacagaaatataccatcggtctcgcacaaccgttgcgcgaagatgacgtgggaatgacatcgcgaatggtatcgcgcgagactgcgcggtctcgcgccacgagaccgcacggtctcgcggaatggaagagcgagaccgaacggtctcgctgttagggttacggattaggtatacctcttacccttcgatatgcgccacatatcgacatggcatacccgcgcatacacggacattatctgcatacactaaggaaattctccatagtatttgagtcctactcggacaagacagggtcgtcaatgtatcgtgtagggtccgatgtctccgagttctacttggagaccacctgatctgcgatataaaagggactccctgggaggacctaaggcatcgaatctcacagccaacaccacccccacagcctacgaagtcggagcctgcaggagccaagtcgccgggagatctagtcgaactaactcgattacgatctcgccggtttcttcgagttccatcgttccctttgtaacctgtggttttccatcatataatcccatatcaactggattagggctattacctatcaaggggcctgaaccagtataatcctcatcttttgtttgctcgatgtcgtattacgtagatccttgtaccaacgtaccccaataccctctatatccggtctacgggtatcacccgtcgacagtggcgcgccaggtagggggacttggtgctcaaggttctactactatgtcatccagcttcgttgacaacagcgtcaacaccaacctcaaccacgggtttcctgcttcaacaatgttggtgtggactcaagtcggtgaaatcgtcttcccggtttacaccacgataccgatctcagccggtccgtcaatgaccggaaacgagaacgcagtggttgcaacccaagacgactccgtgtcgaaggatcctcccgccgaagcggagaacagaacgtcgacaacatctaagctcgagaaggattctaatgcggccgaaccttgttgttccgacaagaaccacgagccgacgagaacaacttctgaagcgacaaggtcctggtgtcctatccacaaaaccaggaaacacactttgcaagcctgctgggtttttctcaacgtccgcgccgaaattcgcgcttgcaacgagcgtggaattcagcgtatttctccaacgcgtgatgtttactgtcctattcacaagacaaagaatcacgacctctcaagctgcaaggtctttctcagcgccacgaagacgtcacctcctaaggaccaacagtcaggcatatcccttagagatgaagacaaggaacaacgaacgctggtctcagatcgattcgtcggcgtaatcgacatcgattcccacgaaccatcagtcctgcatctactcgaggactacagctcatctccaacgagtacgccacgcgaggtattagctatcgacgggaccagcacgtcagcacacgctaatgcggaggcagaaaatcaagtgactacaccggcccagcacatcaggacccttaacacaatactgagagagagaccttacgatcccgttctgaacaatgatctcgcgtggtggcaggaacggctacgggaatcagtaaccaacctcagccacgcgttcaaagaagccgctgctgctacgcaccgggaacaaccaccaaccggcggtgtcgatggcgaaaatcccgaacagcgggagtcaccccatcaagctacccctccacctcgtggcaccggcgatctccgtgaccatctcaacggccgccgagaggcacggcgcatgcgagacgacgggaatcgctcccaacatcgcgtctcttcccgacatcgcgaagaacgagagggccgctcgagcgaagaccgagaccgcgctaatcgccacaatcgccacgatcatgatgatcgcgagaggcgtacgcagggcgatactggtcgaggacgccgccataacgacgaggacgacggagatcggcgccgggacaacaacggagggcgacgacaggattctcgagaacccagccgacgaccccgtaatcccacaccggaaccaagcgattcatcgtcatcgtcatcttcttattcatcctcatcgtcagacagacatccacgaaggacacacgatcgccgacaacccaccgcccccagcgctggatgtagagctttcggtcgttccctgtgtgatgtccgatggcctgagatattccgacccggagcaatagagaagtacgatgggagtactgacccagaagaattccttcaagtctactccacagtactctatgctgccggagcggacgacaacgcgttggcaaattatttgccatctgcattaaaaggctctacacgctcatggctgatgcacttcccgccctactcgatttctttgtgggcagacctgtggcagcagttcatcgccaatttccaaggaacttacaagcgccacgcgattgaagatgacctacatgcgttgacacataactcgggtgaatccctacgggaatttgttcggcgctttaacgagtgcaggaatacaatccctgagatcaccgacgcttctgtaattcgcgcctttaagtctggagtccgagatcgctataccacccaggagttggcgacaagacgcatcacgactagagttaaagtcgcaagagtgggaaaagaaaagctcaagcagaagttctcgcagcagaatacgcgaacccatccaaatgcctagacccacagggtagcgacgcaaagaaagcatggtgcccaatacacaagacggatagacactctttggaagactgcctcgttttgaagaagtcgctcaagaaacatatggcgttggaaaaatgcaagcgagtacgcgtggtcgaaaaggatgtggaggcggctgctcaggaatcagactcagcatatccagactccgacctccacgtctcacacattttcggaggctccacagcgtactcctccaagcgagaatacaagaaagtggaacgtgaagtctgctcgacatggcagggggctgcacccaagatgaagtggtctgaacagaagatagaattctcggaagaagaccatcccaagactgccgtcatcccaggacgcaatccgatcgtggtcgagcccaccattcgaaacatcaaggtcgcgcgagttctcatcgacggtggcagctcaatcaaccttcttttcgccagcaccttggacgcgatgggaatcccacgaagcgagttgacacctaccgatcaaccctttcatggaattactccccagtcctcgtccaaaccattgggcaaaatcacgttgcctgtgactttcggtcaagcaaacaacttccgaacagagcagatcacctttgatgtcgctgaatttgatacagcgtataacgccatcatcgggagaactgcacttgcgaagttcatggccgcatctcactatgcatatcaagtgctcaagatgccgggaccgaaaggaacaatcactattcaagggaacgctaagctagcggtacaatgcgacaagtcgagcctcgacatggtcgagcaaacgcccagcccacccgccacaactgagcctcccaagaaagtgagcaagacaaacaagatgccgaaaccagacagcgcgatcaagatcgttccactcactagtggcaaccccaacaagaccgttaagatcggggcatcactaagcgagaaataggaactcgcgctcatcaccttcctccgcgacaatgctgacgtgttcgcttggcagccgtccgacatgccaggggtccctagggaggtgattgagcacaaactcatggtgcgacccgatgcgaagccagtaaagcaaagactgcggcgatttgcaccagaccgaaaacaagccatatgagaagagctcgacaaacttctcaaagctggctttatcagagaggtgctccatctagagtggctagccaatccagtcatggtgcgggaggccaacggaaaatggaggatgtgcgtcgatttcaccgacctcaacaaggcgtgtcccaaggatcacttccctcttcatcgaatagatcaaccggtggactcaacagccggctgtgagctattgagcttcctcgacgcttactctggctaccaccaaatcagcatggcgaaagaggacgaagagaagacagcattcatcacgccgttcggggtattttgttatgttaagatgcctttcggactgataaccgtagggaatactttccagcgcacggtccagggcgcgcttagcaaccagctcggcaacaacgtcgaggaatacgtcgacgacatcgttgtcaagaccaagacaagcgactcattgattgacgatctacgggaaacgttcgacaacctctaatgataccgcctcatgctcaatctagtgaagtgcacgttcggagtaccgtcgggcaagttgctcggtttcctcgtctctggcagaggaataaaagcaaatcccgagaagatcaaggcaatcgagaacatgaagtcgcccacaagactcaagaaagtacaaaagctaaccggatgcatggcagcactaagcaggttcgtcgctaggatgggagaacgaggacaacccttcttcgctctgctggagaagcaagacaaatttgtatggacactggaagccgaagaggcatttattgcactcaagtgctacctatcaaacccccctgtacttgttgctccccaacctaatgaagaattattcctctacattgccgccacgccatattccgttagcaccgtcattgtcgtcgagagagagaaagtacgatgaccagtctactacgtcagcgaagctctccacgacgcaagctctccacgacgcaaagtcaagatatcctcagatccaaaagctgctttatacagtaatcatgacgtcaagaaagctacgccactactttcaggcccacagagtcacagttgtctcctccttccctctcggcgaagtcgtgagaaacaaagacgttgtcggccgcattgcgaaatgggtagtcgagctaagccagtttgatgtccactttgtgccacgaacagccatcaagtcccaggtgctcgccgacttcgtagctgactggactatgcctgataacaaatcagacaaccaaatcgacaatgaaacgtggataatggcgttcgatggtgcactcaacagccaaggagcaggggcaggattcatcttgacatctccttccggagatcaattcaagcacgcaatccacctcaacttcagggcaaccaacaacacagccaagtacgaaggactactcgccgggataagagctgcagccgcacttggagtcaaacgactgatcgtgaaaggggactccgaactagtcgcaaaccaggtgcacaaagattataaatgctctaaccctgagttatccaagtatctcgcagaagtcaggaagctggagaaaaggttcgatgggatcgaagtccgacacgtataccgcaaggacaacatcgagccaaacgatctagcacggcgcgcgtccagacgagaaccgctcgaacccggcacttttctggacgtcctgacaaaaccatcagtaaaagaggtcagcggcgacgttaacctagacgcccccgacatcagctcggaggccacagaggcagaacgcgtcgttgccgatattgaaaccacagacgattggcgcaccccactgatcaaattcatcaacagcgatgagttgcccgaggatgacgcagaggctgagaaaataacccgtaaaacaaaaatctattgcataatcggcaacgatctatacaagaaagcgccaaacggggtacttctcaaatgcgtttcgtccgacgacggtagacacctcctcctcgatatacatgaaggcatctgtgggtcacatgccgccggtcggacgttggtcgggaatgcttttcaacaagggtttttctagccaaccgccctcaaagatgcatgcgacatagtccagcggtgtgaagcctattaatttcacagtaaacacacaaagctacccacacaagcgctccagactatccttcttacttggctgttctcgtgttgggggctagatatactcgggccattcccacgaggacagggcggctacaggttcctattcgtggcgatcgacaaattcacaaaatggatcgaggcgatacccacgggggaaatcaaggccgacaacgccatcaaatttatcaaagggatattttgcagatacggactaccacatcgcatcatcaccgacaacggctcccagttcatcagcgccgatttccaagattactgcatcgggctgggagtcaagatatgcttcgcttcggtctctcatcctcaaagcaacggacaagtcgagagggcaaacggcatagtgctacaagggatcaagacccgtgtctacgacaggctcatgtcacacgacaagaaatgggtcgaagaactcccattagtactatgggccgtacgcaccacaccgaccacgtctaacaaggaaacacccttcttcctcgtgtacggctctgaggccatgctccccagcgagctacgatatcaaagtacacgagtacagaagtattccgacgaggatcaggaggaacagggaaacgacgatgtgaatctactcgaggaatatcgcgaacgagttgcagtccgagcagccagttaccaacaggccctccgccattatcacgagaagcacatccgagcacgcatactttcgatcggcgactacgtcctccgatgggttcaaagccaagcagggcgaaacaagctctcacccaaatgggaaggaccttacacgatcacacaagtcttgtgaccaggtgcattcaagatagcagacggcgatggccgcgagttggcaaactcttagaacattgaccaactacgtaaattctatgtatgagtcaatataatccatacctgtaagacaccttacagtatcaataaagcctatttttaggcacatattacaatcacagtgttcctgcctgatgatcccttacctagatgacacctagcgttgaaacctatcctcatgtccctttacgccgtcctgacaaggcctccgaggaacctaagggatcttcggctggggacgcccagagccgataaggccttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtccaagagccttgtcccccgagaagaatcctccgacgacaaggctgggggctagggagagtgtacgactcaaacgactgaccaaagtcgtgaactgaggaaacactcttacacactatatccagaggtacgaatactaccaagaaggccaacgccagtccatagacttgaaaaccttctccgctaacggtgccatcgacttcgccaggtggtctatctccgcaggagtcctccgagaacgagtgaacccttcatgaagaaactcgaggtgcatttgcggacaatgatctcgtatgcaagccaacacatgccctccggcatatcggctcgaccgacggcactcctgtttcagagcttcgtcaatccgcttgccgacgccttcacccgttcagccacgagatgtatccagccgccgactcctcaggttctccgcagaccactcgaagttctctgcaaactctggccatggatgtgcagcagctcttcaaatacgagttaaaccacacctcacgacctcggagcgtttccacggcctgctccttttttacttccaacatggctctctcgagttccgccacttcaaatttcgtcttccaatattggatacgacgatcttggccagcaagtgcgtcctcgaggtctgtccaacacggaaacgactacgtcagactgcttctctctctcgagaacacgactgattaaatcggaggagcgaaaagtgatgaagagaccacaaacctaaggaagtcgtcgttgtccctgtcctcgcgggcaaaatttcacccacgttgtccagcaacgcgtgtcccacagacgcaagatccggagggatcgctgacaatttaggctgcccacgctgctggacatcctcgacatcgacatctctacaaaggacaaaagttcccgaggtcaacatacaagagtaaactagaatgataattgctcgcacgaaggcggtcagaattcaagttttacacagcgtgtcttggaagtacaagaagtcctactcttcaaatagggggagaacagactcccccagatcaccgacttcttccatcaccttcttacgcgtgttgctagccgccccctgatccaagatctcacgcagatcgagttcaggacgcgacagctttacacacgcgaggacatgacacgccccggtgtagatcccgttcgacgtctcctccgcgatcctggccgcatgcttggaggggatctcccccatcgccgtcgccagttccgcaagggaggatgtcagcgagaattcgtcaggattcaccgggatggtagacttgatgccacactccccggcaagctggtgcaggccagtgtaggtgacccgcaacgagcctcggatttccgacaggttgttcccgagttccgacatacagtcctcgagcccctgtcgttgtcgctcgttgccgccaccaattccctcatcttcgtgaggtcttcacgagcttccgccaactcgcgcaccagccggtcagcacgcgcattcgccaacactacttccgacctcgcctctgcaatctcgcggccaatgccgcgagcaccagcttcgaggaggcgccccatttcgacttggagctcctcccaggtgaggacggcagcgggtggaccacgacctgccgcgggatcgctgactgggccgctaggcgttgcctcccgactctcggctacgagtacgacatccgttgagggcgcggcaggcgacgcgctggaagtccctccagacttgttttgcgcagcctttgcccgcgcctccctatggaacgaccacggatcagacaaagcttgaatggaatcacagaaacctaaaaatccatctacttacttctcgccaaccgtcacaagacattgtcgtcgtggaggcgggggagacgcgtccgaggcctgaaagacaaccaatgcgaagtaaggcaaaatccttctggcggcacgatctggcgacaggataacttaccgagggggtcgatgtcttgcgacgatgtccgcttacagaggagaacttcctcccctttgtcggaacattgtcaccactagtagtggccgcaacagcatcagacgcctccttggcgaccttctcttttagagacgctgccacctgatggtccgcgagcggcccgatgatgtcagtcagaggaagagcctacgcttaatcaagtcataaggtgatctcgaaaggaaaatgcgggatgcctatcgagtatacttacgttgatagcgtcatcacgttcagccgcccccttttcacaaaggggcacgaggatgttactcgccgttgtcggaccactgatcatcacctggccgacgcggcgctccacggtttcgctgttcagacctatgaaacgagaaccaagtttcgataaatcaaggggaacgcgaacataagcatgtcaggataaatgcgagaaagataccccgaggagaaacccgggtcgcgtcctctggtccggaatatttaaaggctggatgggcccgagcctggagcggctggatccgcctaccaacgaagtctgcaacgacttcataccccgacaagccccgtaatcggagatcgtcgatgatgtcgataaacgactgaagatagggggtcaaagggggctttgcagtccaagacgaaatcttgtccggttgttcatcgggaacaacgaagacaaggtctgaatctttgatctcaagatagaaccacatattccaccatttgctgcgagaagaagggcactggaaggggatataacgcgacttcaggccatcccgaagtcggaacccaacgcaaccagataccctgttggactccatccaacgcaactcgtagtagaagcgaaaaagatcaagaaaaggctctaccccaatgtaggcctcacaaagatgagcaaagatgttaagaaaggcgatagaattgagattcaaatgaagaagagaaagaccatagaagttcaaaaccaggagaagaaattcggaaggcggggggagaaaaccgcagagaatatagacttcgatcgcaaccatgcgacctaagacgggctggggattaatacctcttgcttccctctccatgcttccacgaccaggaagggcgccgtcttcctgaagcttcttcagcgacgcactggtggaagatgatttgccgaggtccatcgctgatcgaagatcgccggagaaagagcatatgttgctaaaactagggtttcttgtggcagcgaggaaggcgaagagcgcttacaggcggaatgttttctgcatggtgggcggacttcaagatggatccccaaaattcctttaaatagacgcactaccgacggtgcgaattccaaggaaaggagagagatggccgccggaaatttctgggtccgttacgtgcggcagtttttcagacttcagtttaaattcactcgtgaccgttgggcttcacacggtgttctcgatcatgtcctgtctctacggttcccacaccgagaacgacatcagtctcgacatcagaagtcgctattggtcgcacgagttcatttaagcagaaatcaggggctactgtcagggttacggattaggtataccccttacccttcgatatgcgccacatatcgacatggcatacccgcgcatacacggacattatctgcatgcactaaggaaattctccacagtgtttgagtcctactcggacaagacagggtcgttaatgtatcgtgtagggtccgatgtctccgagttctactggagaccacctgatctgcgatataaaagggaccccctgggaagacctaaggcatcgaatctcacagccaacaccacccccacagcctacgaagtcggagcctgcaggagccaagtcgccgggagatctagtcgaaccaactcgattacgatctcgccggtttcatcgagttccatcgttccctttgtaacctgtggttttccatcatataatcccatatcaactgaattagggctattacctattaaggggcctgaaccagtataatcctcgtcttttgtttgctcgatgtcgtattacgtagatccttgtaccaacgtaccccaataccctctatatccgttctacgggtatcacccgtcgacactcgctgaagcaacgagcgacactgtctgacagcttcttttaattagtgattaattactcaattaactaataataattagtgattaattatcataattaacgaattaataattaataattaattaaacgctaataaggataattaatcgctaatgaaatcggcatggcatggtatcgcgcattgcttcagtgagaccgaacggtctcgctctttcattccgcgagaccgcgcagtctcgcgcttttcctgcgtgataccgtctgccacgtcattcccacgtcatcttcacgtaatgtttgtgcgagaccgacggtatatttctgtaaaattttttacataccgaatatttttgagaaaaaattgaatgaacagtatattttaaaatttaaacggtctacaccatacaactgaggaagtttattgataaataggagccgatgtactcaacatcgttcatatgcttaaaaaaaaggataatccaaaataaaacaaagtcaagattacctcgtccaaagtaaatacattggttaaagtatgttaaagcgaaacatgggtaataaaagatgacccataatgaaaatctacttaagaaattatatatttacttatactgcattagattagattagcgggatcgaatgttattatccattctcggatggctcaaccggcttatttttaatgatgggcatattgcccgcgcattgcacttaattaatgaaaactatcattaatccattgttaatattattatttttatacatcatctcttgatatttgtttatataaatttattactaacttgtgaaccatttttcctcacattatcatttttctcttaaaaaaagttgtgattttaat

SEQ ID NO: 40285 - DNA, 1900 bp, Oryza sativa
catcgcacataaaatggcggtttggaaacatatggtctcatgtattttgtgaaaaacagaaatcttacccagaataaaaatagcatttgtaacaaggcaagttttcttgtgagccatatgaaaaagatccatacctcagtattttcaaacattctaagcacaatattactcatgtagtcaagctccctggttctatgcagtcggtctaaagcgctttggcagacaaggctatcctccccttgtagacattcatccaagttgcaatagcgaaggacattcattaaggagtgtatgtgagattcctgttaaagagaatgttagaataacaattaaatccaaaaatgatgataagaacaaaagcaagctgaacatgaagtctcatgcatactgatgtgaaataaagccttgtccggacatgtctgtcaggtgtctttacattagcatacctggaataaagtgaattagagaaattaaatacacatgtgattaggattgattaggattgataaaaccaagggcatacttaggatctaagcggtatttagtttctctatcatcttcatcttcctgatccaatgatttctcacttgtggaactagatcttcttccatcctcatttctagtttgaagtttttgttggtactctgattctttcgttggtaagaatgtagcttcatcttctgtaaattttggatctgaaacacttattgcttcttcacgagtgttccgtagatcaattaaaatttttccaagtaaccgacgtgctatctaggaaaaccaatcaaagcattcaaaatgattaatcagtttgtggcatgcaaagagcatataatcatctgtggatggaacaaacagtaacgtctttcttaaaacaaacctttgagccaatttttagtttttgctttgggttgatcccatactcgtttggaattacgccatcagcaagaagctacaacaatcaatgttagataagctatgatgaaaatattaaaaacgtcaaagagaactaatctacacaaataaactaacaaaaaaaatccaaaactataacatcatatgtggctctaatagataaaagctataatttttcagaaggtcaaactttgtaaatttttgacaaacaattagtcaaattataagtatattttagtgcataaaattataccaatacattcatttttcaaagagcgttcataaacattgcttttatagatattatgaatatatttatgcgcaatcaatggtcaaagtcttgtcttaaaaacttctttccaaataaaatatgccctacaattttctacagagggagtaattgatttatacgaaatgataaaagtatgaagaaaagaacatatctcactaatatctagcttaatgaaattctcactaatatctcacataacattatacaaaaagaatgtggaattggaccttctacgttgaatcatccaaacagatgcactaaacaaacaatgtctgttccaggtcacttcactccacaagatctagcataatgaacttaagactcacatctctcataaggctatacaaaaagaatataagattgaaccttctatgaggaatcatcataacataagcactgaccatacagtttgtctcacatagtcacatcacctgagcattggaactgtataatttaaccacttgcgatcttttcaaggcctatgtgaccacaatgcaatagtctgcactccaagacttgtggaggcaaagaaaactaggaatgtcattctttatgtggcacaggtgacttgtgtcaaatgatatcctcagaagtcagaacttcaatgccctatctacccagttgttcatacaaaaataatatggccatattttgcaattgcatatcagtatatatttacaattgcaattgactgat

SEQ ID NO: 40286 - DNA, 881 bp, Oryza sativa
gtttaaaatgtttatatttttgtcaaacttaaaaaaaaatcgaccatttcagttaaagcatatgaaacggagggagtagctgccatccattcctttgtcatatccaatgctgtcagacgacagcagtgcagggaacgctgggcacaatttcctcgtagcatcagatagaacaagagtgaaaaaacaacatatttgctcattggtccggtcgtactccctctgtcctaaaaaatgataaacctgaatttccgtgtctaacgtttaactgttcatcttatatgaaatttttttataattagtattttcattattgttagatgataaaacatgataatactttatgtgacttgtctttctaatttttttcataatttttttaaataagacggacggttaaacgttggacacggaaacccaatatttgtctttttttgagacggagggagtaactcgtaagggtcccatcaaatcatatataaattggttcgcggccacttattatgtcaaacagcgaatgtgcactctatagggcatgtaagcatattggtatactgtatttcataactcgaaattaacgagaataagcagcctgtagagcatttgccttttcggatgcgactgaagcatctgcagctctgccatgcaatgagtatgccttctcctggtagagagaaaacaactaaatcctattagaaatacaatggaaatatgtgtacctcactagtgtcttctgtatgattacggattaccaagcaacaactgaattggcttgacctttttaaagccacaaaccctgagggtagttgtattcagaatagggcctgggatgaatatcagaatggtactaattggtctggccgataaaataagtttgcaagaag

SEQ ID NO: 40287 - DNA, 2972 bp, Oryza sativa
gcaagcgccacaagaagggtgcaccctctcgtttcctaatttgtttctcgagcacctcaattgctgtgtacaatccaaattgcattagctccttaaggagcgacaaaacagtaatttagttttctaatgatgaagaacaaataggcaaatacctctggaactctctccggtatttattagcacagtgtaccaaacttcattgaagacatccacttgctcatctgatgccccaatcatctacttgtacgtatgttgatgttcagtaaaagaaaacaaatacgataactacttgtcttgaacgaaaacaggtttgttaatcatactttacaactgagtgcatcgaaatctggacccaagatgtcaaagactttcttgtgctctccttttccatattcatacacagcctctgctagctgtgccaaggaaagaattaaataacagcaaaaatatagtatcttttatagaataaatatgcaattttatctttcaaaatactcctcaacagtacagtaggcatgcatgtaaaaagttaaataaattacaaactaatagctacaggaaagcaaacatatcttaaaattagttagcaggtaatagtaatgccacaaaaacatacaatgtaatgatattgaggcatcagaagtgaatggtgttcatttttcagaaacactagacaaatgatagtccacacttttcattgtgcatgagttatatattgcttgtgtcttggtacttaatcttgcaaacagaattcagcatacctggattgccttttgcatcacttgctgtttttttgtgtccatcgaactaactctgcaaggttaatgggttattctagcattattgactagtattaatagcagagtcttgtgttccctgaagaaaagtttaatgtatctgaccttgacctaagtgattccaacaagttgtctgctcttgtaatctcacccatacttgacagtgcccataatacaagtagatcaaggagccattccacatgccatattttctgaacaaagtacaaagttcaaatcgaaatagtcagaaaaatgagtcctgcacagctttagttcagacctgtaaaatgctcttggcagtcagcagtatacagcttacttaaatctgaacagtttttatgaatatatttgaaattattgaagcttaaatctgaacagtttttacgaatatatttgaaattattgaagctgagacagtacctcattcgtaagtgcatctagcaatgctgccaatctatctttggccagatcaacctgaccacgaatatgcaaacggagtagcagccctagtgcattaaggtacacctgatgcatgagaaattactcagtgtctctaaaacattgatgtacaggaaaaatggccagcattaatacctctgctgcctcacaatcacttttctcaagctctgtcatgaagttatgatcgtatatctccagaactttacttgtagggaattcaccttccaagtaacaaacagcaacatgccaccagttgtgggttagcctacagaaagaagaaaatgattttgtaagaactatttctgtggttattagttattactagcatcaaacgagagagcatcatgtggaaaattgtatacataaacgatgagcatgctgcccatgatggagaacacgatttcatgaactcagtagcttctttgaaatggcattcctgctggaaaacatggcacagctgcaagatggaatggcagatgaagcttgtattaaagaagtttgtcggtagaatatgaacgattaggtataaatgcataacacaatctgttatgccgataaacttcttaaaataacaaaattatgtcaaaaccacccgcatacattatgctgtgaccagcagtcgttcttgtttatggccaagcctttccgagcagctttttcagcgtcatccatccttccaagttctagtaatgggaaagcaagcatgccgtaaatgtagttctggtcttgattctctggcaaaacctgatcaagaatgagtacaacaaagctaatgaaaagaatagtacctagaactatggtacattgataagaggaagtgttttgaagcacatccagaaaatcctgcattcttctattccacacacacgcgcatgcacacaaaatcccagcactaaaagtgatgcttttttgatcaactgttgtaaaatattttatttttatccaaagttttgaagtgatgattcaataaagttgctaccatgggtgttcctttaaataataacaaacagtgttagattcaacttcggtttcattagttatatacgatatttccactttgtaagcatataaacatacacgagcctttgtagtgaacttacctgttcaacaaatttgagcgatgtatcagggcgtcccatgtagaagcagatgagctgagctctctttagagacatgagatccctggggaattccttcagcaactgccacatgtaaagcacacaccaccaatcaattcttgccattaatcaatttatccagcagcacatactctcaatttacaaaaaatggagacaagctacccccaaacctcgaagtgccgctcgatcgccacctgctcgtccctctcctccccgatcagcgccgacagcgcgcggaacaccgccctctcgtactccgtcgctgcaccctggtggaagtttagagcaacacgaaagcgcaagctcaccgagtaaatggaggattcgaggaggggggaaaaaattaaggcggcgagcgacaacgtgaggggcgacgacgcttacgaggttgtcggcggcggcggcgaggaaggcggcggcccgggcggggtcccgcggggcgacgtggtgcgcggcgagggaggaggcgagcgcgcaccgcgggtcggcggcggcggcgcggagcacggcgtggccacggccccggccgaagctcatggtgtgcgcgtagtgctcgtccagcgccgccgcgcagccc

SEQ ID NO: 40288 - DNA, 3499 bp, Oryza sativa
atctccccccgcgctctcgccgtcgccgtcgccgtcgccgtcgccgtcgcgtcggctgggcggtgggtgggagtgggagagcgggacacgcacgggtgcgagttgtgtttagctgccacggcgacgacgtgggccccacgctggcctcccgggtttctagggtgaggtcactgacatgtggggacaggtaatgctggagcccacgtgtcagtgactgttaggcaggcgggggtagtccgcgtgagaagcgtagatgccgcaagcgtggggagaagaagacgacgaggacgaggtgaggtggattagtttggagcgacctgattgggttggaattggattagtgtgtgtgctaatcttatcttaaaacaacctgcagctggctttactttcgaatatgctaaacaaaaccgatttaaaaaatttattggatacataccactacgatgtgaatattagagaatgagctaatatcaaatgattatacgagtgaggcttcgaattcaagtcggctagctcatcatcatgtggagctagctgaaacacctctagacgttttctcgatacataccattactatttaaaaaaatataattacaattcatatattcgtatccatgctatacgaatacgtacaaaataacaaccatgctatcgacgttacgttttctatcatatagaccaaaatacgctagacgtgagaccgcatgtcagttccatcttctttctctatccatcactcttctttcttcatatctctctccacctcgctgaaccaaaagtgtcaggaggcgagtaggacacgatgagggaggcgaatggagaagtggtgtccaacgcaccggtgaagcgttggtactattcaccttggttcgagaaggaaggaggaaactcgatgtgcccccactcgagctcgccgctaagctgccacccgtcccaagctcctcccaatggccccgcttgctcccggtgccgaagaagacggttctcgccagatctaggttgacaccctcctcgtcttcacaagttccactcgtcctcatcgtgtcgtcgtcttcacgactgccggtgggaggatgagagacccaagcccggcgccggagatttggcgactcaagaccgtttccttggggctaccatcaaaattggcggacagagctatgtgcatgaggcacctagtatcgcctgagttggcaagcactatcgtcatctgctccacaggagagagagagaggttggagatgtgggggtggcgatggaggttggcaccgttgccgtggcagaccaacatgaggggaagggagagaggggagaagaagaaaaaagaattgggaagaagatggaaaatgtgaccataattggctttatgtatttagatggtatggatcatggtaacaaagtttttgggtcgatgagaggttggagatgtggggtggcgatgaaggttggcatcgctgtcgtggctgagcaacatgaggggaagggagagaggggagaagaaggaaaaaaaaggggaagaagatggaaaatgtgaccataattggttttatgtatttggatggtatggattatagtaacaaagtttctaggtcgatgggatcgaggaactggactgaggaacgtggtacgctatttgtgagagggttttataaggtgggacgaaaataaccccgtgtttccgtgacggcctgacgggtataacgttcttgggtcgaggaacgctaccactgattccgttttacgtgactatggtgtggactcgaatagaatattttctaaaattacattattaaattcaaaaaattgaaaccaaatcaaccaaaatatgcactggcgagatgtgaaaacgtctcagtgtgatgcagcgaccaggaaatctagcgcggcaggttacgtccatctcacccgttcatcttccgatcggacggcccacgctccacggacgcgacggttggagccacttcaactgctctttcatctctccccgattttgtttcttcctcgacctgctctgcttctcctccgcacccaaaaatatcaaagaactcaaaagcggagagaggcgaagaacaggggggacgccatgaacgtggaggaggaggtggggaagctcaaggaggagatccagaggctcggccagaagcagcccgatggatcctacaaggtaaatcacttttttctcatctcctctcctctcctccgaaacgagcaccagatctggcgcctgcagcaagggccccgcattttcggtgatccctcgagttagaattgctttcctcttcgcgattcatacgccattgtgcagcttgggtgtcatcgtgtgcgcttttccaatctcaccgacatgagattcctccagaaatcatggcctggtctatttgtgtccattgcccaaaaaaaatggatttctaggtgaccattattggtaatgctggtatgtgtctctatggaaaattggcgatgcattgttcagaggaagagagcttttatctgctggtgtgtacattgaagatccctagttagtgcgtagctggtcatgaaacaaaatagagggatcagtgatgctattgatgatcttgaattcgtgattgaaaattttgagcttgatttggtattttgtaatgttcatatgcccccaagcctgtgaaattgcattttatatgttagatatcgtttgttgtatatgtccaacgtcctagtgacgagaaagatgcccactgtgactgtcaggcagttgaaagaaatgggaaacaataaaggaccaacaagtaagaactagaattgtgtatatattttttttcccagaattcttgatgtatatgcttcttgaaaaaaagaacactacatgtgcattctattttattttctgccatcattgttccattacgacatatactcatgtaaatgtataatcatatcatacaacaagtatgtggtgatgccattatccgtcttttcttctgatgcagcctacaatttccaatcatcatctcatattgtaattttgaatcacaaattttgtttcttagttgtgtgttctataaacagtgtgatgaccaactggtccttatcattttgatcagactttcattttcctctttggtggttacagcttttaccttgttaattgtctcattccttctctttttcctctttatttttatgttaggtacaaccaacgaaagctttgcaagtgatagttttgaccatttttaggcactttactcccttgagtacttcctaattattctcccattttctccaagctctttttccattgaatcgacaactccagctatccctggcattcgtctacctatatacgcaagatgtgttgctttgtcaatttatcctatgagttaaatatatcctactcctccctgttaattgttctgttcttcatcaaaacaattcctgtcaatttcacttgaaaaaaacattttttttctatatcttcatggaaggacttattccttgatccagactcatgtatgatggtttt

SEQ ID NO: 40289 - DNA, 1388 bp, Oryza sativa
gatgaccgttgtgcaaacatatttgaagcactagtcggcaccttgcgggctgccaagaagagaaaaattgttaagtatgatggtgagctgcttctacagggggctcatgacaatgttgagataaccctgttgcctcctccagcggtcgctgctgcctgaagagggaagcatctgcgagcctctggtgttaaggcgttgatatgcatataatctattgtgtctagattctcatgaaccatttgatattcgaagcggatgcctatcgcgtgatgtatgaactatgggtatgcagtttcttggacatgcttgtattggaactgaaatgataagttcactgctgatatattgtgcagtgtagaatgagccataaaatggccatgaattttttacagtactgcattcatgaaggcctctaaaaaaactgatcattccaccatggttctttactcagcttgctgtgcatccacattggacgttaactatttacatcggcaagcaattacagcacctacttctactctgctattatcatcctgtgagactatgacatctataagggcctcgtcatgattctcacattattacttccttttttttttttacatattagggtaaattgcatgaaaaaagtaaaagtggagtaagcaggaagaaagtagctggcgaacatgaacatctatgaggatctttgtagcacctacctcttgtcactactcttcttcctatgcatgttgtcatataaacctccaaatgcagaacagatgaaacaataatattggccagaggacacacatcacatataaggaaaaaaaaagagtactgcatatataataagtctacataggtatgagaggtatcaggaacagtgttatcaggcgaaccttctgcacaagttagccgtgctatgatattagttctagtcatgaaaaatcttctctctttatataacaaataactaaacctgaattttagttgtgtccgaatccgtcttttgtgcatatgatgctttttcaggtatgcgagaggaactaggccctgtttggaagattgcccatggctaattttgagaactaatgtttagtcatgaattggtaggctaaatattagcctaagatgatatgtttggatccatgagctaatttaaggctaaaaggtggagaaagagtagaaagagaggagagagagggagagatagggctgctttttgatggtctccacagaaaattagccccattagcaccccttagaggggctaatgttctgagaggggctaattcactctacccccaaattaaaccacctgtttggatccttgagggctaattcagagctaaaaggtgggggctaataattagctcatggaaccaaacaggacggggtgcaggaat

SEQ ID NO: 40290 - DNA, 3670 bp, Oryza sativa
aggatcttacgataatagacgactcgctcttgttgagtcctcaggggagaaaaaaactgtcactcttgtcttaattattgttcctctttgatgttgcatggccgaatagattgagctggacagatcatttcagaatacagtcaactcgtaccgttattgcttggaatgtaagaatggtggtaaaacatatgaatagcaaataagcagagttttaatataaatacatttgcataacaaaggatccgtataataaaagaagtacaagaattggatcagagagacgggggttgttttaaccttactccaaaatattaatgcattgagcagtccaaaggaatttcatgagatttttagatctccaatcctttcctcaaataaatggaaagatttgaattctacaaaactccttgacaagtcctttgttataaacagaggctctccattttgcacattcatgttcaagcaaaaaaaaaagacattttgcacattgacatgatctttcaaacataatattgaccatcactttgcatcataatatatacagtgataaaattccagtgtattttgcttatccatcttgaacgtttaaaatggatttttatttataccttaagtctaaatgcatatctaaagcatcaaaatatggggttaagtatacatttgtggataaatttgtactaccacagtacaatatttgtgacgagatagagcctagtgagagtgtgactctgagatgggccggcctacatgcaatctgtgcagataggcccagtagatttcatacggcccatgtttcaaatccagccttttcttcaacctcaccaaaaaactagttatacatttgttgtcaaagatgtaattatagcacaattgtgttgtaactatattataatttagtatcatgtaacttgtaagtaactttcaaaaatcaataggcgacatgttatttccatgaaatggaggtaatggaaccgaattcccttacatgcgtgtgcaatgtgattttttcttatctaccttgcatgaattttaaagcaaaatcgaacggtttaaaagtatgtgaaagttacgtacaaattacattatagttacatgtgtgattacacatatttacatttgttaaatttttatgagaaaatttgccgataaatatacagaaaaaaaagagaaaaaaaactgacttggcaagtgaaaggaaacaggggagaggttcagggagatcgtggggagcccgtactacatggcgccggaggtgctccggcgagactacggcccggaggtggacatctggtccgccggcgtcatcctctacatcctcctgtgcggcgtcccgccgttctgggccgagacggagcagggcgtggcgcgcgccatcctccgcggcgccgccgacttcgaccgggagccatggccgcgcatctcccgcgccgccaagtccctcgtccgccagatgctcgacgtggacccgcgccgccgccccacggcgcagcaggtgctcgaccacccctggctccaccacgccgcccgcgcccccaacgtccccctcggcgacgtcgtccgcgcccgcctcaagcagttctccctcatgaaccgcctcaagaagaaggccatgcgggtacgtggcgtgcgtgctctgctcttgatgtcgtctccggcgacggcgagcccgtttctgtgtctgaccgcccagcgatgcacgcaggtgatcgcggaacacctgtcggtagaggaggtggaggtgatcaaggacatgttcgcgctcatggacaccgacaacaacggcagggtcacgctccaggagctcaaggacggcctcaccaaggtcggctccaagctcgccgagcccgagatggagcttctcatggaggccgtaagcttctttacccttcttcaagatagcaatggcggcaatggcgagttcttgattttgcattggcaggcggatgtggatggcaatgggtacctggactacggcgagttcgtggcggtgaccatccacctgcagcgcctctccaacgacaaccacctccgcacggccttcctcttcttcgacaaggacggcagcggctacatcgaccgcgccgagctcgccgacgccctcgccgacgactccggccacgccgacgacgccgtgctcgaccacatccttagagaagtcgacaccgacaaggtaaacacacacgcttcccttccactactccatttgcaacaaaaatgttcttcaattcagctctatctcttttgaagcctagccagatagtttgaactccactcagaattagagtgaaattagttgaagcgctcttacaaaatgaactggagaaatgtaactgggtttagcctcctccacaactccacttcaaactcggctctcggagttaaatttaggcgttagagctctcccaaataaactctgaaactgatcaatctctgaatttgcatgcaggatgggcggatcagctacgaggagttcgtggcgatgatgaaatccgggacggattggaggaaggcgtcgcggcaatactcgagggagcggttcaagacgctcagcaacagcctcatcaaggacggctcgatcaccatggcgcgctagctagctcgacgaattcagtcgattcaggcttgagaattcattgagaatatgaggtcgatgcaatgctcgaattttttttttttgatgcatacttcattcgaatttgaatttggtttttccatttcgtccaatttttcttttgtacaatctactgtagatcgatcggtcgtctatctgaaccttctttgtgtaggatgtgttagtgaacgctgggattgtttcagcattcgttgtacgtgtttgaaattgcgtcgggtgtaattatgtggtaacggtggtaatcaagcaaatttacagcaaattcattgtgatgatctgtactaatatgcatatgaaacatcaggttattcacacaaaatctcttgtcagcttttctcgtcggcggtagggaggacacgctcttttttcatggcgccgccgaaataatctcctcgttggacagtttcactataatatcacgctgcacatagctttttttttttaacgaccacacacaagacagtgcgaagtttcatattcatcgtaggcggatatagagggtggtccggggaaaaacggcgatggacccgtatatattaagaaaaatgaaaatagcgatttttgaaaaggaaaaaaagcgatctaatcctcttcctcccgtcgttcccgagtcccgactcgcggcgcccacaggcccacacgcgatcacgcgacgcgagtcctcctcgcccttcgccgcgatctcatctgatcactccacgtcagacgtgacgcgacgcgatcagcagccagacaaccaatcacagggcagggccacggcgccagcggccagcccacgccggcacgcgcgacccagcggccagcgcccgcgcccggcgcccccacggccacgccgccacgcgcgagtcccgcactctgccgccttggccgctgctgtgctgcgtctggctggcactacattggtgctgacctgctgtgcgtgtgccgccgcgaggagccgtcgtcgagctgatcagccgcccgcgccaacaaggcaacaattttaggttttctatgtgtatacgtttttcaatttttagttttaaaatcttattaaac

SEQ ID NO: 40291 - DNA, 710 bp, Oryza sativa
cggtatacaaaagcaagtgtcattgaggacattgttgctctttgggagatgtataactgagttgacgtatttcaggaacaatatctcttgcctaagagtactacatttacaaggtgtagatcttgttgacctgccggactatatatgccatctcaagcatctaagatacttggggcttgcaaatacaggcatatctgcaatccctcgaggcataggaaatctaaaatttctacagttcattgaccttatggggtgtcggaattttcatcagcttcctgacagcatcttgaagctacagaatatgaggtttctcgacttcaggggcacgaggttaacctcaattcctccaggtatgggaaagctagaaaacttggtgaacatgttggggttcccaacttatttggatgacaggggacatgcctggagcagcttggaagaactacggtctttgtcgaacctaaaatggcttgatttaagaggtctagagcttgcatcttcaggctctatggctgctacagcaatgctcaacagtaaaaagcacttgaaaatcttagacttgacatttgccagtaggctcaccgacaacgggatgatcgaaggaaccagcaatgtaatcgaggagcaggaacgagccgaggttgtgttgagtaatctctgtcctccgccttgcgtagaatgtcttacggtcaatggttactttggatatcgac

SEQ ID NO: 40292 - DNA, 934 bp, Oryza sativa
gttcttggttccgtggaaattggaatcataggtctcatacttgaatgttgaaaacatattttattattggtagtcaaatctttattttgtttttcttgggttaccatcatgacaattgcgtgcaggttctggtaactttctttgtgccgatttttttaagaataaaaaaaaactaaaatttcaattatttacaggagaacatcccgatcgaagaagtattccagaatttgaaatgctgccgacaggggctcacttccgaagaggcgcagctgcgcctgcaactttttggtccgaacaagctcgaggagaaggaggttgagttccttcatctcatcttgccattgctatcaaagatttacctttttcttgttggaaagtaatactataattcagttcatttgcgttacgtttccgcttatgctgggtcattgatggttgcaggagagcaaattcctcaagttcttggggttcatgtggaatccgctgtcatgggtcatggaggctgcagctatcatggccattgcattagccaatggtggggtaagtacttaggagtcttagacataatgacaaaatctgttactcctatttagtacttggcttctgtccttttctctgttgatgaatgcagggcaactgtgtaagtggtcccgttccttttaacaatatatgtggtgttatcatcaggggaagccaccagattggcagggctttgttggtatcatcacactgctacttatcaggtcaaatatcagtttcattgaggaaaacaatgctggcaatgctgctgctgcgctcatggcgcgtcttgcgccaaaagccaaggtctttcttcaatctccacttttattatgagatatccactctattgtccatattgaggtggagcacttttgaatattgaaactcatgttgtgttggttgttaggtgctc

SEQ ID NO: 40293 - DNA, 3199 bp, Oryza sativa
tatctttattcacagtttttttacaaaaaataaaagattttctttattcacaattctataatcgatcttttacaaaaaataaaagattttctttattgtgaatgaaaattgtaagtagatagtcatgtaagaaaaatgttgtataatatcatgtagtaaaacttagttagatccaaagtttattcaagcagtgaatgttctataaataaatttaacataaaccaaaaccttattcaagttcttaagcggaaatataaagtcgcgcaaagcgtgactatatggctagtaccattgcaccataaagtacttaaagaggtttacttaattaaccgcaagaatgagatcttaccggatccaccagagaactacagcctgctgtaataacagtcaaaactgtcatgacgtacattagcgcacccaagggttgttccttactgacgtgaaaatgtagatctatcagatagataagaatgggggagcacacaaagaacaggaacatcgagataaccatctgcatgttaatggcagaaagaattgtatcagacaacagatttccctcgaaaaaaaaaagacaacagatttcactatatatggacaaggagtatttttaaactacgtaccagaaataatcccacgcaacgaaatttttgagaactcttccggagtcccaggaggaacagatacaccgtatccaaaacaaatccagccacgctaacaaagagagtagacttgtgctcttcggtgttaacgacgaacaacaggtgaaacaccagcaccatgttcagcatggctccagagaagacagaaaagggtgactgatatttcacggctgtttccaatcttcgcaataccaacacaagaaccctaaagaaacaatccagtattgtcacactttgaatttttccgaatttgatcttaaaatacatttcttcaatttgctaataaccaaaacaaatttattatgcaagcaaaacagcaaataaaaaaactaaggcatgccccacaccttctttctcccattggggcattttatcccagtggttattcgttcttccaaagagttcctacgatttataccggctcctcattcactcgccaatcaccagatgtgtcaatttgctattgtcagcaaagttcaagactcatctagaggaggtaaatcaatagatacggggtacgcctagttgaagcaacccctatacttctatgggttgttccagcctctactcggtatcccgcaatactatcgcacaatcctttagaatagtcaggccatactcttctagattgaacttggcctcgctcaagcaatccatgctatgcatcactacagtgtgcttattcatgctggcttccaccacaatgctgaactgctccctctggaaaaccaagctcttctaagcggacaatgtattatttgaattgtaaaaacctattcttgcgtcaccttctacttttagaaatggcaatcagtcctagattcaatagcagggggcagctagttcaacagttacttaccattttagggcttctttcgaaccacatgatttctaaaatgcgggaataataataaaaaacataagaataggatgtcacatactttgaattcctaggaacacgaaataagtagatacaaaaatacatttggatggttcacaggaatcttaaaggaaataacatgtggaagagagagcagagagagagatacttagcaagtgtttgaccaatttcacttacagtggtgcgaggtcgataaacaatgatacaatgtcgaacacaaatgaaactcgaccaatttcttcgacggcagagccatgcgagtccatctgtaaacaacatcgtgagtgtattagcacgcaagaattaaaatgatgacaaattatgtagtatgtacatttggattgagtgctagattcagagcgcaggtaggcaggtagcgacgggatagagttcgtaatttcgtaaatgcacaagagctaggttggtcatccatgaaagaataacaccaacataacaataaaatacacgcgtggaacaacataatattgcattttattattattatttttcattattacatacatgaaggtcacacaagtcaacacccacaaatcacaaatgtgcattctgatacgtgctaaagaaaaacagagaaaaatgctactaatattgatgcgtctactaacgcacgctcaaaaatacgaaggacaacaccactaaaatttaactaaaatctattcagagtgcacaatattcaagaaccccgggatcttgatgtcatgagcgttgcgcgcgacaaagcgagtgttgtgcgcgcttgcgttgctctggttcaggagatgcgctctgctctgcaccgtcacgtcacgagcaccacgccggcatcaccaagacctcctacttcggggttggattctaatagctcgagtgaacgtccacccgtttattgcatgtcaactaaatggctacgaaaaattttcaaaaaaaattggcaagatagatcaatatgtaatatatcactccacaaacatgcaagttaaaattcaacttctacaagttgtaacaaaaataacaaatttaactgtaaatatacatatagtaatttgagttttgtttgttatttatattataatctgtagaagttgaattaacttgcatgtttgtggattgatacattacatattgatctatcttattcatatttttttaatttttttcataaccatttagatgacatgcaataaacgggtaaacatccactcgagctgttaaaatagtttcccctcctacttcgtgcgcccaacgagctcctcccactcccaggactgctgatccaccgcgtcgaggcgaccgacgcgtgggagtacatcgacttcaatcctacccagtggccggcggcgagggcgtcgacacgacggaggccatgtactcgcggaacaaggagggccgtgcacgtcatgacacggcacgcgccgggccggtgcgacgcggcggcgaacgcgtgaaacgtcggcgtcgggcttcgctatgagtggagcaagttctacgcctccatggcgcatcccgcatgctaccaccttgactgcgacgagccggacgttcgacgtacccgccgggacgccttgccggcgcctcgttaccccttctcccccctctctctctctctctctctctctctctctctctctctctctctctc

SEQ ID NO: 40294 - DNA, 4790 bp, Oryza sativa
  unsure (1)..(4790): unsure at all n locations
gctcccgacttgcaccgccgcggcgttctaatgcgcgcacgccgcacacacggagacacctcgcctgctcacaaccccccacaccgcgccaccacacgcgcactctcggtctcgctactcacacaacccaacccaccaccacggcgccaccgctcgcgtgcgccagcggcgcttcgctctcaaccggcggcgcgaaccgcgtaagagcgcagagcgctccgagttacccatggttccatcactcacacgcagagcgttcgcaacttcgcacacggtgcaagcgagagaggggaggaggaggaggagacgaaccttcttgcctcttggttgatctggaagcggaacggatcggagagacgaggccggggaggaggaggaggcgccacggcaggatccaagcggacgaaactgcggttcacggtagcgccggccacggcacacgctgcgcttctgccacaagagagagacggtaagacaacgagaagatggcacggccgagaagaagaagagaagcagaagatggagatcgaattcgaaccttcaccaagcgcagatggtgtggtggccgaggcgcaaacgcaaacgggcacggaacctcgttttattgacggaggtgaaggggagaaacgaaagttggaatggtttgttatgcttttcagagctgcagtggcagctttggcaggcccagtgattccttgtgttaattatactgtaattcaaaaaacttcttgtatttttttctctctttttcagtttgaccaaaaagttaatttctggttttacattttacctctaaaataattatgcctaaacaaatattccctttgtttttttaatagataacgctgttgaattttttagcaacgcttgaccatccatcttattaaaaatttatctaaatgttatttgttttcttgtgtcatgttttatcactaaagaaaatttaaatattacttatactttagtacatttacactaatttttttataggatggatgaatgatcaaaacactgcttaaaacaatcaacggtgccatctattttaaaaacggacgtagtagaaggtaagaattatatatgaactccaattctactctactacatggtggtctcattggcaatgacgggatggttaagctggtgatcgttggggtttgtgccgccgtcgacgccgacgaaactagcactagttgattttgtcggttctgagaataatggtggtggcctgggctcgcacggtcgcatggtcttgcgtcagggtgccaatgctcgctcgcttgcgagccggcctggtcgctcaagaacgccgcgccctgcgcccgacagacatattctgtggcgtcgtgctgctagtctgttagacccctgtgcttgtgcgttcgggccggcgcggcgagcacggtgttctctgcaccccgaccaccgtacgccgcgcgaggtgtgtatgcatgctctcgcgcgcgctagcgtagctacgagccgtgccgacgtgccgtcccccgcccccgtacggttcgccgcgcggtcgtggtgaaagctagcgtccgtctttgtaagacacaggaagagagcgcggtgagcgtcgagcgccacgatcttggcagccgcgcgctctgctcacgcggctttcttccacttccaccagcgcgatcgagtgtgcatcccggggtgatcggtgcccccgcgcgcgtggcgcgcatggagcagtttttcgctgtaagaaaggggaaattccttgtgcgcgcatgcaatcttgcaagctcacagggtaagtagctggcaaggaataacggatcccgcgcatgcgatcatgcaagctccaaaggtgcagtcgacgaccgcgggcgcggcacctgtcgcgcgcgcgcccgccacgccgtgcgtccaagtcggcgcaggcaaaattcccttcgctttctgcggcatcctgccgaggccttgcatgcatcggctccggtccggcgcgagatcctcggccaccgccggcgtcattggtcatccccacttccccagcacaccagttacaccacaggcgcacaagttccggctcgccgcggcgaccgccgtctactgaacggtctcttctacgccaagcgcgcgcccgatcgtctgcctcatgcacaacgtacctgtactcgcgcggtggcagctagccaaccagacaagctgcagattttctcgccgaggtcagttcgcggaacgacgtactcgcggaaacatgggcgccgcgcgcgcgctcggcgccatgcgagcatgcatgcatggcttttcctcgcgccgccgcgccaacgccatcgtcaacttccattgcacgcagagtccgctccaagtagtcttaacgggatcgagcacaaaacgtcgcacaccgcccgcccggccgctgtctcttgctgctgtcatctcgcgtcgtcctcgggtcttggcgtctcgttgccatttcgatgctcagcgtgttgcaacgtaccgttttacgaaaaaatttaaaaaataagtcataaaataatattcatgttttatcatctaataacaataaaaatactaatcataaaaaaaatcaaataagactgacggtcaaacgttggatataaaaacctacatctgcacttaaaacgtgatggagggagtggtttttagagtttattgtctagttgggtttcgtttttaaaataatatattcatgatttacagaagtcctgtcaaacgtcaccaatgcactcctctacgtcccgtccgctgcctcatctctttattatcattgggattttaaaaatcgaacataattattgtttatgttttttttattttctagaagtcccaccaaaccgtcagcggtttcgccactgtactcttctacggtccgcctgctgcctccactccttattatcgttgggattttaaaaatcgaacttgattatcattgtgatttatttttactttctattaagtcccatcaaccactgtaaccgtgctacttaatgatatgcctatcgttcctcctcttagtcgtcattaggattctatttggggttttgtttatagttttagttgttccatcaaccaccaccactcaactcctttacgtgtgttttgcttctcctatctttattgtcatttgtcatcgttgtactctggatggactattttttaaaaaaaatcaatatttttattccattttttttctaaattgtattcctaattgaactcctataattatttttctattttcagaatttattttatttgttattccaaaattttattaatttctctagatggtcacttctttcaatagtcattatttttatacgaattttagttatttataaaatttattcctagttttacattttttcttttctaattttagaatttatttttttttgaattttaattaatttatattgtgctcaatatgggctattcttttaatattccttattttttattttcaatttctacttgaaatctttttttattttcttattttggattgttttattttttattcaaaattttgataaatatcatatttggctcttgtatggactcttttatttcagttattttttttattcctacttgaactctttctttttttctaatttcggattttattttttttatttgtaattttaattaatctcatattgtgttcttatataaactcttcttttaatattgcttatttttaattctgaattttagttacaaacatagtactcctattacaatgtttaccctacccagaaatcccgaatatagaagcagctgcaagacctccaacaagacattattctcaggaagattccacaatacaaattgaaacaagtttagttgagtctaccttccaaaatataaaagtattatcgtgtcaaaaccatatggcacaaaggaaatatgtgtagtcttatatgcatatatgcatcataaaaaattgggcttgagcctgttattaatgtcacttcaaaatacatgatatttgttatatgaaacaattgtaatatcatgttccttggttctcgttgtcactcgaaaacagtctcctgacaaaacttctccgcggccttcttgatcttgcagctgaagcgattaacaaagctcagttagtaatctaaaagtacaagaaagtacggcatttagctatttatataggataatgtgacgccaaatgtgatatagactgattaaacaactggaagtaaagttaccttttagtctcccagacttcaacaaagcttcctcggcaataggcttccattgctgagcacatgagaatctgaggcccatcccaacagtcaacccacgtaaaagttgtatagttcgaagcactgaaaatagctcttcagggaagctcttcaaataaaagaatagaatagagacaccatttagtaagcaattctggaagtcaaatagtaccaacaaatataaaccatccatctccataagaggttgcaagtaaatggaagaaaatatgttctctaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40295 - DNA, 14067 bp, Oryza sativa
  unsure (1)..(14067): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattacagtgaatgatttgtcaagaattttgatatttttactttcacaaattttgttgatgggacatagggacagcacaaatgataaagtagatcacacacttctagaattagtgctgcattttcaataacatttactatgtctggtttcttatgctaactaacttctgcacttccagttacgaattaggagcgcttgttgctgaagattgtgctgaaaccacttatgaagcagaaaagcagaagcattctaagaggtcaagagagtacatcccctctgctaaggctggctcacggcttccacatatgctaatgagagcattgtctacttcaaacgaggtttgctcaattcaccacctatttgatgtacacatttttagctaatattctacatgtgtaaattgtgtactccaatgggctctttcagggtgtgttctcaactctggatctagtaaatggggacaagcctgagtttgctcttatcattgccccaatgaaagtgtcatatgagcttgctcgtgctatgctgaagatagcagatgaactcaagttaccaaccaaaatttgtgttatatggccacaaggttcagttgatgctaaagtgaaagggagcagatcggagttggcaccatggacaaactatgttgatgtcgaagaagtacctagagctcctgttaattcttggtgggagatgtgccagataactagtaaaagtgtaattttggttaggcctgacgagcatatagcatggagaacagaatctgacagggtgacagatgcagattcagaagttaggagagtcttttctgaagttctatgtctaactagccgcatccagtaattgtcatcatttcagtgacaggagctaagtgtagttagggatctcagctgctcgatctgaactgccatgcagttcagtgttgcttgctatgacaaaatgccctgtccatgaccaataatttttgtttgtgtagttcttacgtacgctgattaccttgaaatgcatatgatcttaactcagagatgttatgtcaacgtgagtgattttctcttcgttaaaaaatgtggtaaataatttgattgtgtgatttcttgtttatgataacagcatttctgtttttcgaatggtaattttcagaatcataatatggtaacgaattattgttttattgaatagatagcattaatatcaaatcaaagaactgaatatcactaagtacaatgcaatgaacttaccaaatataacaaaatggtagatcaacaaccatcactgacatactcacattttagatttcaccagaataatgaagttatcgaacaaatattctgtacaaaaatcctgagaagtacatcacctgaacatacatgtatcacgtgccgtcaaaacttcaacagcaccacaacatctcattgttacaaatcttaccaatacctaagtgacaggacactggacaagcctcttcttcttcttctcaagtccccttcaaatgctagcaattcccatccaccttcaaacacagcatcatacaaaacctgatactacaaggaacatttgccctgctgttgctagcatagacccaagcaaagctccagcaacaacctggaacaagttttaacacccaaagaagttagcagcatacaaaatagatttttttttttttttttttttgagatagcatacaaaatagttggccatgactgaaagaaacaagaagatggtagcactgctgacgaagctgcatgatgtgacgataactgataagcatggggtgctaggtaaaaggggatctgatgacattggcacagccagtttgtggttcagttggtatccacgtaatcagcacaatcaatatgacatcgctttcgattggtgcagtataataaaatgattagtgaaaatggcatttgagcaaacctgggttggagtatggcctaagagttcacgcaatggtcttgtttcagacaagggatgttcagaaggaagttcgcagactatttgattcaacacctgaatatagttagaaatgagatacagttcagtataactgcacaaacaaatatctttctttgtgtcattacaatagaggcaaatctaatacatggtgttaaaaggtgtctcatgatgatattagcatgttcatattgatattaacacataaagaaacagtaactgcatacctctgcttgctttccagcatgtaatctgataccagaagcatcgtacataacctgccaatcaagtcacaacagaaattatgaaccctcgagcctcatcttttcgtttatgcttatgcttatcagccaaaatttgaattttcaaccttaaatttgaagttgattttagggtttgttcatcgaagtttatttttcagcctttgcttttagattgctaagaacacgtatataaaagttttattcacaatttttttttcgtttgtaaatatgaacaaaatctatgtccttcagtcaataagcgaaacgatggggactacatgtttaataataacaaacaggaaatcaacaaaaactcttgcacaatgcctacactcaacatcatggtgtccaagtcgaggcaagaaattgagtccaagcaacaccatcaatgctcgttgtctttgtcagaacaaaggaactcgattgaactaattaaacaggatacgagatggataacctaccacacttgcgaatattgctgctgtcgcaaatagggcacagccaaaaccatcttggaagccaatcgctacagctagtgctgtaactgtggcagaatgtgacgatggcatgccaccagaaccgataagctgcttaggatcccatctgttctccttataccttaatttcagaacaaacacacattaaacttgttgcaatattttctatcataaaaggacataatgagaactaagtcacaagatacattgctcatcttgcatcaggctgatgtcaatgaacaaaatctatgtccttctacccgaattaagatatagttaagatttacaatgcgcgcaaagaaaacttttttatacaaagaataaacaatgcttttgtatcctctgcaattggctcaaatggcacaacaatcaccatcgagctacttgctaatccaaagtggaaatcggataacaaaacaatgtcaagcaagaaaattcatacctataattttctcacttgtgaaagtactccaatttctcaaatgcacacaataacatgtcaaattgtcgattgtagtctagccatgaataaaacgcacattaaatctaagcaaatctaaatggcacctattctcctttaaacggttcttaaaccgaagagatcaccggcaattcctttgccccccatctcaaactccccgaaatcattcgataataaatctatacggaatcctaacattctcaattccaccattcttctaagcaagcaaaaagaaaaaaaagaatcgaaaccgattgttctgacggccggatcagatctccgggagaggaaaccggagttccaccgaacatcatccgaatccccccatgagattcgaattgaggtcgcgaggaggagggggcagagggcgtacgaaccgggtgacgaagaacttgatggactgcgcgacggcgaagcccagcaaggcggcgacgagggggtagttgtggaagacggcgaagtaggagaatcccgcggaggaggcgccgccatcaccaccaccgtcgtcgcccatggctctcccttctccttcccaccccccaaggtgcgtcccttccctccctccttccttccctctcctcgcctaatcccgggtcttccctcccctccccaactatatttatagcccacctcacctcacctcacctcctccgtaaaatgcttcctctttctctctcttctgcacaaatggcgatcttgctccgctcgattgatagacggattcgagatttttttgatgcaacagttgccttccatactggactgtctccctctcctcgctctctctagcttgcagaaaactactactctctctttcggagtacctcgtggacatgaaggaatcggaatttggagggggggagcatggagaagaatatgccgaggaagaagcaagttgcggctgcttgtattatggatgatgaattattggcgcgcttttatttatttatttatttattttatttttatttttttgtccgtgctgctgcggcggcggtagatccgggcttggttcaattcatgtttgcatgcacctcgttcgcgccgcaaaaaataaaattggcggaatttaccgccacgccaatatggtgaatctgtgggtgggtgtgcaaaaacagtttaaattcaaccgaaaaaaatctattatgatttcagaattgtcgaaaaatgttgctgtctagcccatagtttactctactgacagtttaaaatacaataattttcttaactatgtttttttctcgaacgcaattttcttaactatgtgagtaattaagcgattaacaagacctgcatggtggcgattcgtgtaagggacattttacgagcggccattttttttttggcacaaacttttgcagttacgcaactaagagcaacttacacaaagcttcacgtataaaacagactgccagattaattaatatcctaatggcgcaattaatcataacaaatgtagacgtagttaacccgtctggtgttgatcaggtccacaaaccatagattagccaataaacgaggagttcagatgaagaacgccaaagtcaggtcaacgaagacaatgccagatcttttttttccccttttatgttgcttcattttttccccagttggagagggttgacttatgttttctgcattaatccacatagcctgctattaatccaagcaatcatcctgtaattgcagatttgcagagctttttttttaagctgtgaagtggagttcacggtggattttccatgctaaagtcagtcaatttggattgctctgacatagactttgaaattgttggctaaactcctctttcactttccaataccaactgaattttgcattcttcagaaaaccatcacacataaaattgccaaaattacagctttgaacaggtgaccaagcaaacagcatagcctctagcagtctagcttcaactgtggcttcatccagggctatgccaggcaaagcatattgctggtctatcatcaacagtgttacatctcctacaaaatttgcacatacaacacccaaaaaaagagctactatgtctaaatcatagtgtgcctaacattctaacctgtcattttgtgatgaaacaccgattgtgtggcgcctggggatccatcatcttcttcaagtcaaggtccatctcatcctcatacttctcgtcctcctcctgtggctccgatgccttcctctgcctctccctggcttcagcggcttccatccgcaccttctgccggacatagtcgtcgtacgacatctcgcaccatttcttcgcgtctccgataacctgctggttgtgaagctccacctccctctctagcttggtcttctcggtgttcttgggctctccccagtagtcgtagcggtacataggcttactcgggtcgtagtaatctttgccataaacttcggtctcatccacgtcatatcgcccaggttcgtcgacaggaagcccaaatgctttacggctgccaatttttgagttagtggatatacattcggtggcatcaaatttgtagcagtagtaacattagttgcaattaccagcatatgtctctgataagagcttcccgctcttcgaaagaacggcgccattgcattaaatcgtactcatccatttctttgtttcgtcggagcttccctactttgtattcctctcctctttcctctgcttcctttcttagtttttttatcagctgcagaaattaaacttcagtatgttgaaaggaaatagcgagtgatcaataaagaattgtcctcgctatgagggaaagggtacctgacgctcagcacgagcggcatccagatcaagctccttgatatctatattctaacagaagagttcagaacacaaccagaatgtcattgggggatcattgtactgtaaaaaaaacaccctacgataattgaaagctagtaatcagtagctacgtatgactgcgtaccacaacttcctttttcagcagtgtgtctttgaaatacccttcagtatgttgaactctattttcttcatgaacaatggaactatcaactgtggactcatatgtcgtatccttgaatttatctggattttcctcctcatggtctaaaatcatttgctctgcattatgccacagccaaagctgcaaacaaaaaaaggatcaatttaatacaggaatagaaggaaacaaggcatgaaagctgccagaggatgcttatataggtggcgagaggcatgataagcatgttatcatttgagacatggtcaagagataccgtttcaacaaaggggtggtctgataccaaaggttctttctccatatctttcaaaggttttttcctaggaataggtggtcttccaccttcacgctgtcagtgcatatacgagtcagatgcatgcacagcacaatactgaagagtatgcatttcattaggcaaaactagtacgtgagaatgcacaaattattaagttcaacaaaattatggattcaggaggacagaggtcacacccacaactgctctgggttagtatcttccttgcggtgaaatattggtggatagtcgaacctattgaatctgcggttagaaagaaaaataagatgacaaacagttagtcaactaaaaacaaactgaagaaatgcacaagacacagggcactgaaacctccagattgtcagaaatcattggcacacgcatttcaaatgatgatactcacattagatgatcaatgttaggatatacaaagcgcatttcgagtgggaaacggaagcggtagggatctcgtttggcctgcatcatacagttatacaagctccattaattaattaaagaaatttccacaactcaggcaacaaaggaataaaactttttctatgaaaaataaattcattttcagttaatgcaaattgaaaagacacaattggcatattcacttagcaatgcgaacttcttaaatatttccttaatcttttgtattgctgccatcatatcattaaccactgtaagagtgaaatttgagatcactaaccagaatctctacatggacttccatgccaggtctgatgtgatgacggatccaataccaatcatttccttttattggtacccacctaaacaaataatgagatgtaaatggcacgcagaattctttcacaaataagtataccaggtccacaattgtatatcagaacaagaaaccatacccatcatgaacacaaccgatgtccacaaaagctccctgatagaggtgaacactgatcactcgaccacgacagatctgcatgagatgcattcaaccaaacaatcagaatttaagggcgagaacagtcaacaaattgctgaagaatgagagtacaatcagaacttctagcaaacctgtccaggatagaagaacgggagttcaagctgcataaaagcaatcaagacatcaggaactaataatatcaagaaattaaaattgaccaggcagtgaattgtcaagaggtaatgaacataccatgtcctctttgtagtcctcacctcttttccgtctgccagggtagtaatcctgatcaaactgcacgacaaaaatagccaaagaggggtattaccgcctagaacactacaaatactcttaaagatgacaagtgagactcaacccctaaactaaaggtctaaaccaacaaacaaagcttagttacaggagataaaatcaacccatggttatctgacgtgcctctctctgaagagagcataaaacagacaataccgagccactcaaatgaataacaaaacaacttgccaacatcgaacctaagagtttaggacacaggtgttcatgacgtacaaggaaataggcatctgagggggttctgaacaccataacagtttttttttttgggtcgaaaaggaactttttttaagtgataagaaaatacaataatagtagagggccgctacaaaaggggatcccgttgcaacgggatagatatattaactattctcttgcacgagtatcacaggtatcaggtcctaggtatcacaggtaccgggtaacaggtatcacaggtatagggtaccatgcagctggtaccacaacaggtattaggtattaggtaagtctcatataagggtatcccgttccaacgggataccgttgtctaggttttctgataatagtagactgttcatacaaatgtaaaatacttttattaagatatcacaaattcacaataaaccactgcagtaatcactaaaaaggtttattttcaactatctagttattaccagaataatgattttggactactgttacattctacaggtatttcttccatcctttgtgaacttatcacctctgataattatcatagtaattagcagcatgccaacacgttccataaccaatgtgaactgaatcaattggtctgcaaatatctaattacaggcacagaccactaaagcatgaacacttctacatctaactaacacaatgcacagtcaaacgcaaattcccagttaaatcaaaccatcacacaaatgatcgaacaaaattaacggctttaccttgtaggactcctcctccaacctgtcccgattggcttccacccattccttgtactgcttcaagaacatcttgtatcgatccagccccagatcatccggcgcgttctccaccttgtccacgtgcgtcacccccttggccgccaccgccgccatgtccagcctctccgtgaactccctgtgcgcctccctgatgaactccagctcgccggggtccacctcccaccccggcggcggccagtcccgcggcggcacgagccggagcgggagctcgccggcccacgaggtctcgaggggctcgggcgtgtcgcgcgtggcgaagaggcgctcctcgtacccgggctcggactccaccttctcccggtacgccggggtgagcatccggaacgcctcctgcgactccggcgtctggagcggcacctcctccccttcgttgaggctgtgccgcgcgaacgcgacctcgggggtcatgatctcctcccacggcgcccacccgtgctccacccagctccggcggcgggcgacgtcctcgggctcggtgttcttgacgaggatcgaggggatcaccggcgggtcatccgcgggggtctcgtcggggccggagggggagacggagacggcgatgcggcggaggcggcgcctgaggaggggcttggggcggaggccgaggtgcgggaaggtggcggtggccggagtggccgccattcttgctcgggttttggggacgacggcgtcgccggcggtggcgacgtcgaggggtttaagtgagctgaaacaggagaggataaggcaggtcgtgggccccacatgtcagtgagagattcagtccttttgctacagtataatggcccatgagatgagaaggcggaggcccaactaggcccaccaaaatttggatttccgtccgattgggccttacaacgaattcaccacggcgacgcagaccaatgccgccgccgccgcagcggcggcggcggtggcggcggcggagagagagcgagacagcggcggtggaacgcgcaggctggcggcggcggcggcggtggcggcggagagagagcgagacagcggcggtggaacgcgctggccagcctgctttcgcgttcggccgtgcgtgcgggtccgtgggagggaggggagctggagctggtgggggagggcgaccgtgtaatggagccgtggggcgttttcaagtgctcgccaactgttcgaccttttgcctcgcagggcgtacgctcggtatggactccctcccaacccgccccgctgtttctgatcgtagcatttagggaccatggatttgtatttccaattactttctgatctgccagcttcggcgtttttttaatgcatattgtgcatcagtgcttgtggagtagaaacccggtattcttaaactggtgggaggagctgtaggcgctgctcttgatatgtttctgttacctggaaattctgatgtgctaaaaaccgatccatgtgttatttcagcaaatatggtggcatggaaataggagctatgcccctttttgtttacaaaatcaaactatagggtggcatcgtactgtgacaaccaatataaaaaataccccggttatccaaacaaatcaacaacgaatgatttggtgaatataattaaggctacaatttattttgatctagtagttggtggaaaagaatatgaatctatctaagatcacttgcattgccaatataatatgaacaccattcagcaactgtccaattggtaagggctagatcaggaaaagatcagtatctaatgctagcatagtcttcacttaaaccaaaatttccttctgtacttctgatgcctgctgtccactcgtaaaccttcttcatgccctgttagtttcaatgttgataaatacaagtctagatggagttaagtaggttggtggctgcttgatatctctatgttaactctggttgatgtctaccctatgatgatcttcccacgaattccatcaccagctttgagaaagctgatgattcatctctgaggagattttctggagaatcaaactctagtatcttacctgcagtacgaacaataaaaaaggtacttccatcgcttaatatagttttttataaattagaattgcttttgttgaaccaaaggaaaaacatgggttattcgtggatatcttttaccttcacctaggacaagaacaaggtcactgtcaatcacagtaggaatcctatgtgcaattgtaataactgtgcaattgtttgtctcttgccttatagtcttttggatgatattatctgttgcggtatcaaccgatgctgtggcttcatccagaacaagtattttcttcttcattagcaataccctggccaagcatacaagttgcctttgtcctacgctccagtttcccccatcttcaacaactgcaacatcaaactttagtcatataacttgtccatctcgagcaaggaatttggaacgtgagaattaaaactgctgcaaggaaagatagttcttcatacctggtgcatccaacaatctactgtcttctctcacaatctcctcaaggcggcacttatgcaaaacctaaaagatgggggggaaaaatcagcactagactcgataaaggaagctgtctttaaattgttaactgctttcttgaaaacctataacagctatagacacttaaagaaatttcatttggaagagcatcttcacagcactatattttatagattgtttacctcccatatttcagtgtccagatgctgctgtagaggatccaggtttgttctgactgtcccttggaaaagagtcggttcttgtggtataacacttaatcttgaccgcagatcatgcactcccaaaagcgatatatcaacatcatctatgagtatccgtccttcacatggttcaacaatccgaaacaaagcgtgaattagagtcgatttcccactccctgtcccgcctaccaccccaattttcctttctccgggaattgtgcagcttatgcctttgagcaccattggcatgtccgggttgtacctcacttggagagaatcgatctgaatggttccacaccagggccatgattctcttggtctacagtcctcaatgactaaaggggcctcacttgttatgtttgagaactgcaaaattctttctactgaaatcattttgttctcaacgttgcacagattccatatgacccatgcttgtaacacattaaggttaaggccataggtagctgccagccctgcgaggcctaaacaaggagaaaaccaaaatgggttagagtttatagccatgtaataatattgtgatttatcaaagtactgtagagttacacatttagggtttctgaaaaacgtaaaatacaccacatggtttctctgtaaatccttttttttttttgtaacaacaaacactgttttaccaaaaagaataagcaggaatgcaatgcaagactgcagatctaattatagtgttagatacgatactattttttcatgggaacgcttacttggatcaatagtatttcgaggcattgagacaaggatgactagcgtcacaaagaagacaaggttgaagaggaagttgatgcgaacacataaccattcaattgttgctgaattgtggaaagtgatgtgggagtagtcatcaattagtgcaagactcttcctgaagaanttctctccatgattaaagcatataatagttgatgctcctgatacagtctctgaaaaatggtggaggactggagcttttcttatgccaaccatccttgntagttctctagctgaacagatgtaatagctctgcatgaagtttttacaaattactagcattttcaaacctgaggaaaacatattgcaatgaatgaaggtgtacctgataccaagtagagatggcaattataattatgaatagaatgaatataggccaggcaatttgagacatgatgaaaataatactgaggagctgaattaatgcgaagataagccctgcaagcctgtagggaatgtctgtgtcaactgtgctttgatctgttgaagcctgcaaagcagaaaactaagccgtgagaactggaagtaaggggcgtttttattacgatattcaaatgaagaggtagttggctcaccctattgaggattctacttgatggagtggagtcaaagaagttgattggtgctcgaaaaatactcctggtcatgcgtaagaagaactgatgagcagtttcaatggcaatcgttgaaaggacaatagctcttcccaatataaacacagaacttccagctgataacagcacaaagatacctatcatcttctccctgcttacttgttcctgcctctcagctgcccatgcaatccaatagttgctacatatctgcaatccctggaaaaggacttggcatgcaagaataacaggaacgagagctccgccatatgcagagttgacaaacttgcgataaatatcccatttaactcttccagattcgcgctcctcctcgcattccctgcctattacattgtgatctaattctatttctgtgagctcagtctgccttctcttgtgactcttatttttagtcaagacatgtgcttttgcaggtgtgacctgactaagggattggttatgtgcagccatttgcattgagagttctccattcctgtctgctaccaaatcatcatattttccggattgaacaatccttccatctttcatgacctacagttggacatttgcaatcatatgttagaccatataactctacatgtatgttcttagtaattattgcaaaaatgaaatatgacagcttgtgacaggtttgaaggatacaaaacccacccacttagtggttcgcttcccatttagttggatgtttattttgcacgtgtggcacttgcattaatggtcaagcaaagggactaggatgcatcaatgggctgaccaaagtccaatatgacccacttgcatccctagcagctgctcaaattaagatatttacaacaatatagccattttatttgacctaaagctaacaattacca

SEQ ID NO: 40296 - DNA, 2279 bp, Oryza sativa
taagggctcgtgtataaaacgattttatagaatggtcaaatataaaatcaaattggcatctaccctgacgcctcttgctgttgctcatgatcatcgatctctccatcactcatttttcctgccttggctctggaagcctcaggaacaagcaatccctttattatttgtacctctatccaacggtaaatcctgttttacttttagcatccaacggttaatattatttgaaagatgtggcacatccatgttacattatgggattcactttttcgtcgttaagatatggcttgccaaacaagcagcctctaacttatagcacgtacacattgttaattttaagaaaggcagttatgagtatttatattttaatttttttttctttgagacactaatttagatggcatacaattttacaattttattatgacttaaacatttatgaatatcagtgtaatttattttaggggtttgttaaacagttgatgttaaattagttgaattataacttaattgaatgctatattgaaacctgatacttgctatggtgtatataagtctcatgacaaatactgatattattttcagtggaaggctataggtaaagttaaaaagctacaagccatgaatcgtgagttacagaagctgaagctttgaatcgtgagttagcccaagctatgaatctcgagatgcattatggaatacgaatgattgtttgcttcctgaaaccgtcgattcatgttacttcatcatttatgctgctattttgagtaccagacattcactgctcatggtaaggatccattgctcatttatgcttgatcctttttttagtaaatggtaatgcatcaaacaaaaaacatgtatatattatatcaacaaaatatttttattgccacttaataataaaatattgcgtattaatgctactctaaaggaaatatcaaagatcaaagattatatgttttacaatttaatttattgtcacttaatgataaaatgttgcctattaatgctactctaaaagaaatattaaagatcatatgttttacaatttaacttgtactgttctacaggctgtgagcattaccaatgctattttcgctgttattctgcttggcatgcttatcaaaaagtacaagagctacaaggcttacagacaagagtatcgctctctttcctcgtcattagcgaatgtgtaatttgagtaactcaatgccagctatgagagcacaagcatgcattaattttgttttgtgggatgttggtactcaaaatcgattagctatttgatccgtggaatcaatcttgcatgtatgcgttcagactttagaattcagatactgggcgtgtaggtgtagctgtaatcaacagctgtattctttcttcgctggtcgttattgcccggcgagcatttgccttttgcactgtttacaacagcgtaccgaactttagtccttgagattttactgaaatttatgttgttattatctaacagacactgtgaatttgaagtagcgaagattagtttaaatatacaaatagagatctcgtgagttatgtttttaatatttttcaaaaaaatttaactaaaacggatgatagttggaagcgaaaaatcatagctgcacttaaaatgagaggaagggagacgaagggagtacatgttatacataagtactcccttcgtttcacaatataagtcattctagtatttttcacatcaatagaaatatgaaaaatgctagaatgatttacattgtgaaacggagggagtattataaagtatctaaattagtagtacctctgtctcatattacttgttgctttgagtttttatttgtaaaattttatcattcgtcttattaaaaaaatttaaaattattatttattttatttgtgatgtattttattatcaaaagtactttaagtattacttatcatttttcatatttgcacaaatttttcaaataaaacgaatggtcaaacgttgcaaggaaaaagtcagagcaacgactattatgggatggaggtagtacatacatttacagatttggaccaataaagtacaccgaaggttccttaacctcagacggttttgaaccggttttattcgacgtgacgactaaatcagcgtgggacccacgtggaccccacatctcaggaggccacttaagcaagccagcctctcctttcttctcctctcctcctctctggactctgagcaggccgccttcctcatcggcggtggctgcgttgtctgctccgccttgcacgactgc

SEQ ID NO: 40297 - DNA, 3797 bp, Oryza sativa
atgccgctgcctcctcttcctgtgtgggctggcttttagtccagcggtcagcgccccgcaaacgcagcggccgtatgttgttgctacgttggttcgcgcgggcgcaacttcctctacgagctcctctacggccgtccgttcgccggcgccaccaacgaggccaccctccgcaacatcgtccgctgcctctcgccttcccctccgcctccggctcgtgcggccccgccaccgccgacgccgacgcgcgcggcctcatcccgcctcctcgccaaggacccgccgcccccctcggctcccaccgtggcgccgccgacgtgaagtcccacccgttcttctagaccctcaacctcgcgtccgcccgtcgtccctggcaccggcgccgtgccactgcaccggtcgcagtcgggcaaggcggcgccgatgacgactaagccggcctgcccagtccagagtacagacagaagagagagaaagagaggaggaaaggagaggctggtcttacgttgacatgtgggacccacgtaggtctcgcgctgactccgccgccacgttgaacaaaactaggttcaaaaccgctgagagatctagtttatactagttttataagttgggggatacgttgtatctggttttgcggttagaggacgattttatagctcgatgacaagttaagggaacttagatgtactttttccatttcgtttcttcccacattcagatgggcttggatggcccattggagctgcattgtcacctgctgcatggctgtatggcccatgatgctgcacgagcatgcaagcaagtaaccgcgtagagccatgtacgcgccgtggtgctcgctcgaagcttcgccttgaagttaaaagttttaaattttggtatgactttttttcagaaagttttaaattttatttaaaagtttaaattttacgtatagaattttcaaatttgtagtaataaaaaggaaacaatgttcatggaaaaagagaaaaagaatagtcaccgtaattcaaatcgtgattaatcaaaacctgattacgctaatctgatcttatctgctgcccatgtgaacgtgagtatgtccggatgtccccacctccctgcactgcgtagctgtgcaatcgcgtgatgggctgggacggaaccgcgcgcgactttcgctggcgcagacgcgcgctataggtaattcgcactgggggatgcgaatgcgatgcgatgcgatgcgatcgtgtgaggcgggggcaagtataaaggcgacacgtgtcaatcaattagagggaacaaatggaccaattagctggcaaaatttttactccatattcatattttaatgtatgacgccgttgactttttaacaaacgtttgatctttcgtcttactcaaaaaatttatgtaattataatttattttattgtgacttgatttatcatcaaatgttctttaagcatgacataagtatttttatatttgtatagaaattttaaataaaacgaatgatcaaacgttagttaaaaagtcaacggcgtcatacattaaaatacggagcgagtaccagcttgagatagatagatagaagcttgcgggatgacccgccagctttagtaaaattcgtacttctgtcgagcatctttatgatattttagttgttgtggcagtagtattggttttttatccattgttttcattcataataattattttagacctttgattttttttcataatacattgtcaacaactataaagttaaatcatagaaaaatatagttaaatataaatattccttttgggttggtaatatttatcgtcttagacaattacacggtctccaaaaaataactgtaactgctaatttttattacaatacaatatatatagaaatatcaataaatatatgattttattaaactacttttaagactaatccatacgtttgctctgttatttaaaaatttgaccatagctttatcgaaaacaacaagtattaccggcccgaaggaaaggaagtataatgatactacatccaactttaaattttagttcaattattagttagagtttttaaatttgaatttcctaaaaccaaaccttatattatcaatgaaggattaaactcctacagttccttttgaaagtgattgtttaccatattatcattgtggattgtttatttaattaacaggataaattaatatttaaaaaaactaattcacaaatagattacacatgtggtcaaacaaatgcattagaagaaagttgttttagaatgtatttttaaaagcatgtagcaaataacccgtttcaaaaatatggaaacaaatctgaaaagaaccggcctagctagtgccctactctctccataaaaaaaaaacaacttctcgagataaatttggacaagcatttgtccaggtttattcttataagttattgttttccgatgtggagggtgtgcatgcatactccgcaggcaaagagcagatgaatcaacaaacgacagtatacattgctcgtactggtaccaggcaagtatatgtagaagcacccctccctctgcgtgtagctgtggatcaacaagtgacttttgttttggaatttgcaacacacagacatgatcccgtagatttaaatgaagtggtggatgcatgcagattaacacacagcatgctgattttcgtagctggcatatgttctgaggaagaaattaagcttgtaattaagtatctgctaactgacaaactacaatagctcgatcacacatgatgatcagtaacaacttgatcaattgagtcaaatatggtgccgtctattaatttccaagctgttagcaaattaaatgaattggtggatgcatgtacataccagttcacttaattacattggagaactcatacaggcgtcctcgagtggagaagatgatcagtccgatctcagcatcgcagagtatggcgagctcgtaggccttattcagcagaccgttcctatgcttgccggatgtcacctgacggcttgtcttcctctcgattctccctatgtcgatcaatcgatctcccttcacaaacatatacacaaccacaccctcctagtcctctatttgcagttcattacagaagacattcagcaaaacagagagagctgcccgacgccgctgaagcttggaggagaatattcattagctcgcggcaacaggccgcctgacaacgacgctgtccgtcaccgcggcagctggttcaatcgccaagtagccgcaggcgccattatcgccacgcgcatggggggcgaaccgaggggattcgtgctcgcgtgtgctgatctcgtccgccgatatcaggcaagtgaagggacggctacggagatggcgtcacgcccgcgcgtgggaggagagggcctcgccatcgtcggaactcgtcatatatgttgggatatgcgtaggctacgataacaaaaattaaaattttctatcgcgtaaaccaggaaccatgtaagtattagatcatatatcattaccactcgacgcattgtgcagtggaagaaagcgctaagaagtcaaaggaattctcgcgaagtagcgcgcgtcgatgtagaggaagttgtcgatcgcaccagctcgaccttctcctcctcgtgcgttctcctcgttgtattcccactccaatcagcaccgcaaaccagcggcgcctctacggtatccacacgtacagggacggaacgccacgcgcagatgtgctagcacccgcgcgcggctaaggttttgctcggggaggggagtgacggctagggtttctcacgtaatgcaatac

SEQ ID NO: 40298 - DNA, 5788 bp, Oryza sativa
cacacccctcactgtgaaacagtctgttctattatcctgaacatgagatatacatgcatgctccagtacttgcgcatgttccagtacatgcgacaatagagatcactgggatatggttcattaggataaggagattatctccaaatttgtttcaccttcttatccattgtaactgaatactgtaagccatggtagaggctgtttctaccactatttaacagagatgcggcccgaggcaaagggttcaacgcttcacattttatcacatggtatcagatcctttttccacctcgatagatcgcatctttcatccacatggcgtcgtcgtcgtcttcctcaggcacggcagccgccaatctcctccaaggccactcggtttcagagaaactcgggaaagccaaccatgcattgtggaaagcgcaagttagcgctgcagtgcatggagcccgattgctgggctacctcaacggcgatatcaaagctccaaacgccgaaatctcggtcaccatagatgggaagaccacaacaaagccgaatccggcatttgaagattgggaggccaatgaccagcttgttcttggctatctcctgtcatctctttcaagggatgtgctgatccaagtcgccacatgcaagacggcggctgaggcatggcggaacattgaagcactctactccaccggcactcgagcaagggcggtgaacactagactcgccctcaccaacacgaagaaaggaacaatgaagatcgccgagtatgtcgccaagatgcgagcgctttgtgatgagatggctgccggcggtcgtccacttgatgaagaaggccttgtccaatacatcattgctgggctaaatgaagacttcagcccgatcgtctccaacctttgcaacaagtccgatcccatcacggttggggagctgtattcccagctcgtcaactttgaaaccctccttgatctctaccgcagcactggtcagggaggagctgcttttgtcgctaatcgcggcaggggcggcggtggcggcggtgggcgcggcaacaacaacaactccgacggcggcggcggcggcggcggcagaggcgcgccgcgtggacgcggtggcggcggccagggtcgcggtggccatgggcgcggcacaggaggccaagacaggcgccctacctgccaagtttgtttcaagcgtgggcatacagcagctgattgttggtatcgcttcgacgaggactacgttgcagatgagaagctcgttgctgctgctactaactcgtatggtatagatacaaattggtatattgatacaggtgctacagatcacattaccggtgagctagagaagcttaccaccaaggagaaatacaacggcggcgagcagattcacactgctagcggagcaggtatggatattagtcacattggtcatactattgtgcatacccctagccgtaatattcatctaaataatgtcctttatgttcctcaagccaagaaaaatcttatatctgctagtcaattagccgctgataattctgcttttcttgaacttcactcgaaatcttttctataaaggatcaagtaacgagggacgttctgcttgaagggaaatgtagacacggtctctacccgatccccaagtcctttggtcgctcaaccaacaacaagcccttggtgccgccaagttatccctgtctaggtggcatagccgtctaggacatccgtctcttcctattgttaagcaagtcattagcagaaataatctcccatgttcagttgagtcagtcaatcagtctgtgtgtaatgcttgccaagaagcaaagagtcatcagttaccttatattagatctactagtgtgtctcaatttcctcttgaacttgttttttctgatgtttggggccctgctccagagtctgttgggagaaataaatattatgtgagtttcattgatgattttagtaagtttacttggatatacttgctgaaatacaagtctgaggtttttgagaaatttaaagaatttcaggctttagttgaacgaatgtttgatagaaagattattgccatgcagactgattgggggggagaatatcagaaacttaattccttttttgctcaaataggaattgatcatcatgtgtcatgtcctcacactcatcagcagaatgggtcagctgagagaaaacacaagcatataattgaagtaggcctttctcttttatcttatgcatcaatgcctcttaagttttgggatgaagcctttgttgcagccacttatctcatcaatcgtatacctagtaaaaccatccaaaattctacacccctagagaaactgtttaaccaaaaacctgactactcatccttgagagtgtttagttgtacatgttggcctcatcttcacccttacaatacacacaaactccagtttcgctccaaacagtgcgtgtttttgggttttagtactcaccacaaaggatttaagtttcttgatgtgtcatcaggccgtgtctacatctcaagagatgttgtctttgatgaaaatgtttttcccttctctacactccactcaaatgcaggagccagactcaggtctgaaattcttttgttgccgtcccccttgacaaactataatacggttagtgcagggggaacacatatagttgcaccagtggctaatactccattacctagtgataatttaatttctaatgctgctgatgtgacttctggagaaaatagtgcagcacatgaacaggaaatggagaatgagcaggaaatagagaatgtcatgcatgggaacgacgtgcatggggacgcggcatcgggacctgtgctggatcagccaactgctgacagcagcactgcgccggaccagggagctaacaccagtgacgcggtctctggcgcagcttctgacgcgggtggagacactgccaccctgggagctggagcagcaaatggcgcagcagcaggtggcgaagaatcccagccggtgccgcctgatgtgacgggtacagtagcggctacagtagcccctgcatcgagaccacacactcgtctgcggagtggtattcgaaaagagaaggtatacactaatggcactgttaaatatggttgtttttcttctactggtgaaccacaaaatgataaagaggctttaggagataaaaactggagagatgcaatggaaactgagtataatgctttgataaaaaatgacacatggcacctagttccatatgagaaaggacaaaatatcattgggtgtaaatgggtatataaggttaaaaggaaggcagatgggacacttgacagatataaaactagacttatagcaaaggggtttaaacaaagatatggtatcgattatgaagatacttttagtcctgttgttaaagctgctactattagaattattctgtccattgctgtctctagaggttggagtcttagacagttagatgttcagaatgacttccttcatggattcttagaagaagaagtatacatgcaacaacctcctgggtttgagtcatcctctaaacctgattatgtatgtaaattgaataaggcattatatgggctgaaacaagcaccaagggcgtggtattccaggctgagtaagaaacttactgaacttggttttgaagcttcaaaggctgacacctcattattctttcttaacaaaggagggataattatgtttgtcttggtatatgttgatgatataattgtagctagctctacagagaaggcaactacagcacttctgaaggatctaaacaaggagttcacacttaaggatttgggagacctgcactacttccttggaattgaggtaactaaagtttccaatggcgttatcttgactcaagagaagtatgcaaatgatatgctaaagagagttaatatgtcaaattgcaagccagttagtactcctctttctgttagtgaaaaattaactctatatgagggatcacccttgggtcctaatgatgcaacacaatatagaagtatagttggtgctttacaatacttgaccttgacaagacctgacatagcttattcagtaaacaaagtttgtcagtttcttcatgctcctactaccagtcattggatagcagtaaaaagaatcctaagatacttgaaccagtgcacaagtctaggacttcatgtacacaagagtgcttctactcttgttcatgggtattctgatgcagacggggcaggtagtatagatgacagaaaatcaacaggaggatttgcagtatttttgggttctaatcttgtgtcctggagtgctaggaaacagcctactgtgtcaaggtcaagcacagaggcagaatataaggctgtggcaaatactacagccgaactgatatgggtacaaaccgtgttaaaagaattgggaattgagtctcctaaagctgccaagatttggtgtgataacttaggagccaaatatttatcagctaatcctgtgtttcatgcaaagacaaagcatatacatgttgattatcattttgtaagagaacgagtgtcacagaagctgttagagattgattttgttccatcaggagaccaagttgctgacgggtttacaaaggcactgtcagctcgacttcttgaaaattttaaacacaatcttaacctaactaggttataattgagaggggctgtgaaacagtctgttctattattctgaacatgagatatacatgcatactccagtacttgcgcatgttccagtacatgcgacaatagagatcactgggatatggttcattaggataaggagattatctccaaatttgtttcaccttcttatccattgtaactgaatactgtaagccatgatagaggctgtttctaccactatttaacagagatgcggcccgaggcaaagggttcaacgcttcacattttatcacactcacgaatatataggatctatcactcgggcctccaaggcccgtaggactcttattcggatccctatccgaattaagctcatattagatctccatccaatccctttattccggcccattaaacatgcgaccctgtaggttcatgtacactcggctataacccgaaaacttcttttcggtccacgcgtcaacagcggcccctagcagaacgtattgacccaccgggcatacataaatatcatattggctgaacctctagtgtattcttatatgaaccttcacgatatcgattaagctcaaggctagatatgtgtcatcctctaatagctcaatcattcactcgaacctattgatagattatataacttgtgattgactcctcaatcacctttggtatgaccatacacttccataatctacaacatcgagggcccagagatatctctccataggaggggcaaatcccatcttgattattcatatcccactatatgtttcatagcatacccgaaaactacttttataactacccaattatagagtagcgtttagtagtccctaagtaagctactatacatgttgagaactatgataatttcagatctaaggattcaacaccaacactaaatgagatcactgatgacacaacacatatggctcttgcagtgtctcatgttgggtctatccaacaacatattccccaacatgtgtccacattattaatttggtatctctataccatgatccatgagacatgatcatcaattaatacatgtgttgatcatctaaacatatttgctccacatatgatatttgatcagggatcctttagaaataggaacaaacaacataaaaagtctcat

SEQ ID NO: 40299 - DNA, 8381 bp, Oryza sativa
tcgtcgcagccggtgagtcggtgacaataaatgttgtggaagcactgatggtctgagagcaggtacaatagcaggctataagccagctccaaatatattttaaggagataaacaaggagagagaagagcagcaggctacagatttgtagccagctgtagcgcgaagaactccaagacacagtgtctgtatgacaggtgggacaagatattaatagtgtagtatgtaactattgtatgaacgagctattaaattggctataaataaattggagctagtaaacttgctctaatgcatactcatccgggaagcactgccagcaacctgggcttcagatggaaggagctagatagacacgtggcagaattttggaggtgtctaacttaaatttttatggcgccacatggcccaatcggaggcttgattcttgaccctcaaatcgtatatagagatatgcagatactgtcgaatccctcacgctgatggccggtgcaaggtgcaaactggaggtaattaaattgatgactacttgattcagccctgccctgtgcaccaagtcattgtgattctataatccacctcctgttttaattaataactctgatggttgatcaagtttgctgctcgatcttcatcagcttaacgccatctgctttgtaggtttctttctagccaaagcaaaaacaggagaaaactcccctcgctctggaacacctccgtgcagcaaacgccatccctcgtctgttttgtactcctaaaacggaacgactcattagctatcttttttaaaaaatcagattaatatatttttaaagcaacttgcataacactctgtttaataatttgaaaagtgtgcgtgcgaaaaataagaaatactatgtgttgagaaactgaaccaacaactcagcgggtttacatcgtctaccgttgaggctgacggcaaacattgcaattgcattcatccgtgcgaccgtgccacacatcctcctatcaacagctgcgtgcagtgatcccaccattatgattaattagggcctactaatcagcagaattacttatttttcctccaaaaaatcagaaaatagaatatgcaccggtggcaaaacacgcaagaacaaaagcagagtagattgttttttaagatttgatgcattccatttttctaacttatatcagtttatatatgtgacatcccagcctagggcttaatagaattaatagaatactcataagttacaacttcttttctggaagccaatcttcatataactctgaggttaaacgtgcttggcctggagcaatttgggatgggtgaccgatcgggaaattctaacctcgtgcttggcctggagcaatttgggatgggtgaccgatcgggaaattctttccgggtgcatatgactctgaggttaagcgtgcttatcgggaaattcttcccgggtgcatacgagtgaagacaacatatgcagaatacgagtgaagacaaaatatgcagaaaagacttgtgttaatctgtgaggatagtcaaataaatggctgtgagttgtattctcaaggattttgtcagtaccttcatttcgctactagtttttggatgaaaaatactatatctaagacatagtaatagtgcaacaatgctgtttttgtcaaatgaatacttcaatattttataagatactcccccgtcccaaaatataagcatttttggaacgtgacacagtcttcgagatactacttttaccaacaatatatatatataagtaagatgttttaaataaaagagttacatattatgatattttgtttaataataaatctaggaacatcaattttatatgattgatattttttaatttttttttctattaatagttaaagttgaaaatgtttgacttgtcattatgctaaaaatgtttatattttgggacagatgaagtatgtacaattattcgagtatttggatagctcttagtataaaagaagcttgctttgctgtagtattatgctctgctttacttctgtgctcgcgcgctttgctgccgagtgcgtattctatttgctgattttttttaaagagaaataattaattctactgattagtagtccctaattaatcataatggtgagatcacttcatgtagctgttgataggaagatgtgtggcacgaataaatgtaaatgcatcggcaatgtttgtcgtcaacctcaacggcagacgatgcgaacccctgctcagcctaataattgacactggatgagtgaaaattattctaccatattgtgccaatttttaatctaattttctcgcccacgtgtaaactctgaatgctcactgtcaaacaggtgattgttgagctcgctctgttgtacttacaaagttaaaaacatcatagtaaaccaaataaaagaactccgtatcttatatttataaggtgttttacttattttctaaatcaaaccatctaagaaaccaacaatataaaaagaattcaaaggtcggttttttagcgtatttttataatataatattataagttgttttgactttagtcaaaattaaattgctttaagtttaaccaagtttgtaaaaaaatagtagtaatatttaagttaatacaaatatattacgaaaatatattcaagaaaactaatataatattataaatattactatatttgtctataaacttagctaaacttgagttagtttaactttgatcaaagttaaaacgatatataaactaaaacggaggaaatatttgtttggacttgattaaacttatgaaaaaaatccattttgttttactacgacgtggacaacgcggggtctggaggcaacgaggtacagctcgtccaaagtctccaatgccaccggctaggatggagatggacaacttcggctcgccgtatcagcaggcgtggccaccagcgcaggccaccgtcgacgtcgcgggtcggtggagacgtacgtcgcgcgttaggaagaagaggttctagccttctaggatgttcttgtcagctgcaagcagaaggttgaggccttggaggctatagagacaccggcgaggcggcgacagcgccgcttcgggaaggtgagggtcagggggttggtggtgacggtggcggaggaggggaggagctgacgggatgcagcccgcgcagcttctggtcgcctgcgctgaggcggtggtgtgtgctgcgaccgcgcgcaggcggcaacgctgtaggccggcgcgcccgtgcacggcacggcgttccagcgcgtcgcatacttcttcgtgcaggagctcctggaccggcgagcatccgccggcgttgggccctgcgagcatggcgttctgcatcctgtagtcgtcgtgcgcgcgggaggcgcgacggcttgcgcggcgaggcgttccgtacctgtggttcgcgcacttcgtggcgaacgcgtgcacgctgcaagccttctagggagagagcaacgaccacgtggtggacctgggcatgacactgggcctcgacggcggaaaccagtggcgcggcctcctcgacggcctagccgcccgagctagcgggcgagagcgaagatggattctattaactcagagtggacgttcacccgtttattgtatgtttactagatggttacgaaaattttttaaaaaaattgacaaaatagatcaatatctaatatatcaatccacaaacatgcaagttcaaattcaacttctacaagttgtaacaaaaataacaaatttaattgtaaatatgcatatgtaatttgagttttgtttgttatttttgttataatttttagaagttgaattttaacatgcatgtttgtggattgatatattatatattgatatatcttgttcattttttttcattttttttctcataaccatttagatgagatacaataaacgggtggacgtttactcgagctgttaaaatagtttcccaacatgaatgatgaatattactacgtgtcaagattatgaataccacgtacctaatagtagttgactaaatctcggcaggacccaccacatactatgtcttatacgaaaactaacctcggatatggagggagttccggataaagaaagacaactagagttctacatgaaaacgaaaggactactcaaattgtatccatattagtttccctagttctacttggacaaggggacacctataggtataaatacaaggccccctaggaggacaagagacacggaacaatagatcaaacacaaaatcaacatacaagccaacatacgtcaagacaagacgccggatatcgacttcagagataagcatagctagtcccctacggtgtctatggatactgtcagaagagacatagcgttgtctttgatctcgccggatgcggattcgaggaggaaggctatcctgttgtcgactacgagtcaacacttcagaccgccaagtcgacaacagttagataggctaccccaaatattgtattggtgtgattatggtgaataagagtaacgaccggcttcggccaacaggatgtagggctattacatgtaagataaggggcccgaacatgtataaaaatccctgtctccatctcttttgcctcaatctcgcatataccatggtaccaacgatccccataccatccagataccatagtcgcgatatcaaacatcgacactacgaatgtggattttcatccctcgagggaacatccctccgttgtttgcatgtcatctaaatagttataaaaaaatttgaaaacaattgacaacatagattaatatgaaatatatcactctacaaatatgtaagtccaaattcaacttctacaagttgcaacaaaaataacaaattaaagtaaaaatagttattgcacattcacaactatatttgttatttttgttacaatttgtagaagttgaatttaaacttgcatgtttgtggagtgatatatttcatattaatctatgttgccaatttttttatatttttgatgactatttaggtggcatgcacgaaacgaggatatatcccctcgagggatgaaatgactttccctattactactccctctgttttagacagagcaagtttaatagtatagcccactactagctccaaatcatttatagccaattcatataataatagttacttactatactatcatacctggtcccacctgtcatacacacatcacgtcttggagtccgtgctgcagctgactatagatctgtagcccgttgcttttctctctcttcctttatctctttaaaatatgtttatatatagctggcttatagactactattgtacctgctctgagacgttttgatgatgctgttcagagcaagtttaatagtatagtccactactagttccaaatcatctatatctaatgtaatagccaattcatataatagtcgcttactgtacaattaatacatggtctcacctgtcatacagtgctgcatgtagcccgctgcttttcttttttttatctctttaaaaatatatttatagctagtttatagcctgctattgtatctgctctctaagccggtccacaacggtactgttcatgcgacgaccgcgtcggcgtcgatatcgagggttcagtattccgtacatccccacagtcccttgacctctggatcaatcgatcgatccacgccacgcatgcggagatccgcgcgaatctcggagcctccggatcgattccgttgcagctgattagttataaacccgtatctcaactgaaaaaaaaggatggatgtatacgggactgctcgcttatatgtagaccttcctctactcgttggtaaacaatttggttatacgtctccgcgttcttctctcatggcggcggatccatccccacagatgcataagacgaagaaactagtcagggtgaggaagcaagtagaggtggtgctgccagtagaggtgctgccgccgctgccgccgttggccgtcatctgcaagcacaaggaacacgtatggatcacgcaggacgattacacattcaggttgttcgatatcaacctggtgctcaccttggctgccgtcgggtgcgccgggctaggcttcttcctcttcccgaggaaccgggccctcgggatggctctcgccgccgctttcttcgtgggcttcttcgcgcacgccaaggcatcgatgctgctccactgggacgtcttcccgcggttcgtcctcgccatcctcgaccggggccgccggcttatggcggtggcgtgcgttgccatcgtcgtggtttgcgttctccgcttcggtacccaggacggcgtccgccgtgccaccttgttcatttggaccgtcgccatggcgctggccgcgctgaccggctgggtcctccgcgtcgagaggcgcgtctccgccgctgcggaattcgttgaattggacggcgacacgagcctttggaacatccgcaaggatgggcgtctcgccgccgttgcagatatcgaaggagacaccacgttttatttgctgacatctcgtggaattattccaactggctacgatgtagtagtacatactgccaagccatgtgttacatgtgtatgatcgatcaggtgatcgaatgattgattattagcgccgttaatcaaataagttacgcctctctgtttccggtctactggcctgtacgtggatgtctgggtataaatgtttggctagaattcttatgtgtgaaaagaaacttcagatttgctataccacattcgcatgaaaattagcgcaaaaatttacatttgtttttttgtttgtatgatttgtgctgcgatcgtgtgctttggtgtgcttctccttttcatccagcgaccagttaagattcggtgtagagggaggctgaggcggcggcgacaggagaggcgacagtggtggcaacttaatgggaagcaacggtggtgtgtgaaaaaacggttagggtggaagatgggcaatggtggagccacctcctagatctggctgcatcgttgcagtttggctaattcttaatagccgctcgggctcaacaatgttgctggcactattaccgaagatgagggaatagatggtttgttgacgtataggaaaaatggttggccaatgagaaacgccattagtagttgaggatgaaggaagggatggttgtcattgacgtgtggaaaaaaaattactacctccattttaggttgtaagacatgtttaactttagttaaagtcaaactactctaactttgactaactctatagaaaaaatagtaatatttacaacactagcataatttcattaaatctataattgaatatattttcataatatattagtcttggattaaaaatattacttcctccgttccagaatataagaagctttagagttggacacggctattaagaaagtgtaatgccgcgcttcgagcaagacattaaagattaatttaataaaaacctatccgcgaaaagtttcgttctttgtgtgcgagtctaagtcgtgccatggaatctcaaattttaatctccttgatccctctcatcgacatccaaaatccacctcatcgaaatttctcttccaattcaagtctccgaaatcaaattccaaatgtcaatcgcttcctttgaatcctcgtcaaatacttgtccccgttaccaaaaatatcaattcccattttgatttccccctctttgactccaccttatgttcctaagaccaagtatcaaagttagatccaaatccttctcaaattctctccaaatcaaaagtttctgacgaaagtctaattagggtccctcttgctctgtgggccgattttctcttcccggcccatctctccctctcggtccgtctctctctcgcacgtgtgtcgctcgtgtccaggagcaagagagagcgccgccgtctccttcctctctcactcgattttgggcctgttcactttgatgccatttcaaccttaccaaattttggtaaagttaccaaaaaagtggctacatttagtttgctgctaaattttggtaactatataagaaatcctgccaaaattttaaaaattttggcaagttgccaaagttttggtaactatgccaaaattttggcataatgttttttttggcaacaaagtgaacaggccctttctctcccggcgccgacttcccgccaccgccatctaaatccccaccaccttcgctggctcccgccgtgtcaagccctggcaccgcccgtgcccacgcccggccccgctgcctctgcgcgcatccatccaaggatgggaggcagaactccctgcctcgcctcctcctccttcgcctttttcccaaatcggcaagagcaaagctccccttttctccctactttttcatttttcctctcccggaccgatgccctgcc

SEQ ID NO: 40300 - DNA, 1769 bp, Oryza sativa
cgccatggacagcgagcgcccctgacgccaccgcgccagcccctgtcctcgccagacttgttgttgcctcggcttcagcctgcatctccgccgctttgttttcttgctctctctaataggacagaaactccattaagccgtcacgaggaactggcgatggcgtatattgttgtgtttgtgtgtaaaatttttagggtgtagctatatttatgacgccatatttttcatcaaaaaatagtcggcatgtatttatattgtaagtccctaaattacatatgtaattttagtgtatttacaatgtaagtctcaaaattacatatgtaagtactaaaattacatactaattatatatgtataagtggggtttaaatgaggtgtaactactgtgtaagtagctgaaaaaaatcgactgtagcatatggcaccatatttttagcaactccgaaatttttattcttgtgtttttaatatgatgtgcatgtaacatctttattttttgtcccgtgatttaggatggagtgattcgatgtataagtaaaaaaaatattcacatataatttgggggtaaactaattagaccccagtaacaccctccttatttatttttcctttttttttcttgcttgatgcactctctataagaaatcatcaaccgcaataatgcaattactacaagttaatgcaccatcaatttttatttacatcgacaataatacgaatactacaagatttgatcaactaatattgttcataatccaacaactacaagcacatgcaacatcaattttcatttatgtcgacagtaacttgattactacaagatttcaccaagcatggttgttgttaatccaattactacaggcacatccgcacatgcaccatcaatttcatttacatcgacagtaattcaattcctacaagatttggtctcagtttattgcacaccatattgtaactacctcgattggaaacagagataaaccaattacaatgattgttttcaaccgaccaccgattttacggatctgtaaatgatttacccgaatttaaatagaactaaaaaaacacgaatattagggaaggacctaatatcaaataattagaaggggtgaggcttcaaacccaggtcgtctagtccaccaccttgtggagctagccggaagacccctgggcgtttctcagaactaatctacacagatcgaacgtgggcaaccgaacaccagtttttgcggactctgggcgcgatgtgcggtgctcggaacaatattccgcgctctagcgctcggaatagcgctaccggtaaatattactatatttgtctacaaatttagccaaatttaaattattttgactttaatcaaggtcaaaacgatttgtaatttgatgcggaggaagtatttgtttggacttgattaaacttagaaaaaaatcctatttgttttactacgacgtggacgacgcggggtttggtggcaacgaggtagaggcgtagagctctcatccagggtctccaaggccactggctaggatggagatggacaaattcagctcgtcgtatcagccgtcgtggccaccagcgcaggccaccgtcgacgtcgtcgggtcggtggagacgtacgccgcgcgtcaggaagaagaggttctaggatgttcttgtcagctgcaagcagaaggttgaggccttggaggctatggagacgccggcgacggcgccgcttcgggaaggtgaaggtcaaggggttggtggtgacggtggcggtggccctgac

SEQ ID NO: 40301 - DNA, 18945 bp, Oryza sativa
  unsure (1)..(18945): unsure at all n locations
ggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagttcagaggaatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgcgccattcttcctcggccggttcatggaggcgctgcactactacgccgggctgttcgacgcgctcgacgcggcgcttccgcgctacaacgcgcggngggcgcgcgtcgagcagttccacttcggcgcggagatctgcaacgtggtcgggtgcgagggcccggcgcgcgtggagcggcacaagcgcgcggaccagtggcgccacagcatgagccgcgcggggttccagtcggtgccgatcaaaatggcggccaaggcgcgggagtggctggacgagaacgccggtggcgacgggtacacggtggcggacgagaaggtctgcctggttcttggctggaaggggaagccggtcatcgccgcctcgtgctggaaatgctagaccgccggcatccggtggccggccgccggagagaggtagacaccgatgctggacgtaaataaagagctcgatcgagcaccattgtccgaccatggatgatgggcaaacacgatgctgttcaagccattatatgagcatgaacacttgtataaataaggccactggttagaggcttgttgttttacaattttgtgtaggttcttattgtttaattagctcatctaacaacatacacttatattgtccttttattttctgtcaaagtgcaacatgacacatcaggtttgtggtgggctgccctgaactttgactgaagacgttttgtacactttgagggagatggttggattttatgatggatgattagaagatgttcggggggatacaaattgggtttcttttgtgtgtttggtaaaaatttggctatcttaaccaaacccttcgtatggattcgtttgtgggcgagccaaaccctatatcctactccctccgtcccaaaatataacaattttagcactcaggatttgtcccaaaatataataacttatccatcaacattctcttcacaaccaatcacaatcctccaccatttacttttctcacctatctccactactcatccaatcataaccttctgccactcacttttctcacctacctccactactcattcaatcataatcttctatcactcatttctactctcttaataaccgtgtacaactttaaaacttcttatattcttgaacggagggagtaattggttagagccacctttgctgtcactagagttcatagaggttgatggttgcaaaggataagcatatcggagcatagatcgcaacacatatcatatgaaaagaaatatgtaagattttgctcaccgccatcccttccctcattcttggtggcggagctagtcgacattgtcaagccaaagcgaataatagcgtttctaattggctggcctgtcttttccataagtcaacaaacaaccaacccttctctcatctctctggtggagccaatggcgtcgtctgtcttgagcaactaatggcgtttctaattgtctgatatttcttccacatgtcaataacaaccatcccttccttcatcctcaacgactaatggtgtttctcattggccaaccatttttcctacacgtcaaaaccatctattccctcatcctcagtaatagtgccaccatttttcctacacgtcaaaaaatcatctattccctcatcctacacgtcaacaaaccatctatagtctattccctcatcctcagtagtagtgtcaccatttttcctacacgtcaacaaaccatctattccttcatttttcatacacgtcaacaaaccatctattccctcatcctcattagtagtgccagcgacatcgttgagccccagcgactaagagttagccaaccatgcagcctgatctaggaggtggctccaccattgcccatcttcctccttatccgtttttttcacacaccaccattgctgggttgtggccaatgggcgatcgacgatcgatccccatcccccctatacgctctctctccccccttcctcctcccattcttctcttcctactacaccataaattttaaaaaataaaaaataacaaagttggaaaaaatatgtatagaaatactatatataaaaaatatttgaatttaaattcaaatttgaaacggatatgtaaacttttgacttataaactttagatctataaactaatatttgaattcaaattcaaatttgaatcaggtatgtaaacttttgatttataaactttgggtttataaactttaggtgtataaactttagatgcatagaaatactatatataaaaaatatttgaattcaaattcaaatttgaatcggaatataaacttttgatttataaattttgggtctctaaactttagatgtgtaaacttgaggtgtacaactatagatgcatagtaaagtaatgcggtgaaaaaaaaaagagaaaccgtgcggaggagaggagagggggccaatggccccttagcaatctcgaccattgcttcccattacgttgccaccattgtcgccgccgcctcagcctccctctacgccgaatcttaactggtcgctggataaaaagaagcacaccaaagcacaagatcgcagcacaaatcatacaaacaaaaaaaaagtaaatttttgcgctaattttcatgcgaatgtggtatagcaaatctgaagtttcttttcacacataagaattctagccaaacatttatacgcagacatccacaggccagtagaccggaaacagagaggcgtaacttatttgattaacggcgctaataataatcaatcattcgatcacctgatcgatcatacacatgtaacacatggcttggcagtatgcactactacatcgtagccagttggaataattcggcgcacccgacggcagccaaggtgagcaccaggttgagatctaacaacctgaatgtgtaatcctccggcgtgatccattcgtgtaccttgtgcttgcagatgatggccaacgacggcggcagcggcggcagcacctctactggcagcacgacctctactttcttcctcaccctgactagtttcttcgtcttctgcatctgtggggatggatccgccgccatgagagaagaacgcggagacgtataaccaaattgtctaccaacgagtataggaaccggatggtctacatataagcgatgtatatatccatcctttttttcagttgagatacgggtgtataactaatcagctgcaacgaaatcgatccggaggctccgaggttcgcgcggatctccgcatgcgtggcgtggatcgatcgatcgatccagaggtcaagggactctagggatgtacggaatactgaaccctcgatatcgacgccgatcgacgcggtcttcgcatgaacagtactgtcctggacgatgggctggccgtcttgaacagcattgtcaaaacgtcttataacttaaaatgggagtagtaatattcatcattcattgttctctgtgtacgccatttaggtttgtgtaatatgttctctgtcatgttgcactttggcagaaaaggagcacgatacaagtgtatgctgttagatgagctaattaaacaataagaacctacacaaaattgtaaaacaacaagcctctaatcagtgggcttatttatacaagtgttcatgctcacacaacggcttgaacagcatcgtgtttgcccatcatccatgaacggacaatggtgctcgatcgagagctctttatttacgtccagcatcggtgtctacctctctccggcggccggccggccaccggccaccggatgccggcgttctagcatttccagcacgaggcggcgatgaccggcttccccttccagccgagcacgaggcagcctttctcctccgccaccgtgtacccgccgccgccggcgttctcgtccagccactcccgcgccttggccgccatcttgatcggcaccgactggaaccccgcgcggctcatgcggcggcgccactggtcggcgcgctcgtgccgctccacgcgcgccgcgccctcgcacccgaccacgttgcggatctccgcgccgaagtggaactgctcgacgcgcgcccgccgcgcgtcgtagcgcgggagcgccgcgtcgagcgcgtcgaacagcgcggcgtagtagtgcagcgcctccatgaaccggccgaggaagaatggcccgttgtggccggcgtcctgctcgacgagcacgaacgccctgggcgacagcttgcggatggtctggagcaccgagttgagcgccccgcggctctccttcaccacggagtggagctccaggacactgttgatggcgacggcctcgtcggcgtcgacgccgaggtcgtcgatgtggaggctctcgaggccacggttgatgcctctgaactcgaggtacatccctaacccctccgcgtacgcctcgagctcccgcccgatcgctctcatggtgtccatgcgcgcgccgacgccggtgacccgcacgcgcgccggcttgccgctggcgcgggcggcgaggccgtcgaggaggccgcgccactggtggccacggtcgaggcccagcgtcatgccgagatcgaccacgtggacgttgctctctccctcgaaggcttccagcatgcacgcgttcgccacgaagtgcgcgaaccgcaggtacgggcacagctcgtaggccagcgcgagcgcctcgccgcgcgcgccgtcgcgccccgcgcacgacgacggcgggatgcagaacgccatgctcgctggccccagcgccggcgggtgcgccagcggcagccggtccgcgagcccctgcacgaagcacgacgcgacgcgctggaacgccgtgccgtgcacgggcgcgccggcctgcagctcgcgcagcagcgccgccgcctgcgcgcggtcgcggcacgccaccgcctcggcgcaggcgaccagcagctgcacgagacgcatcccgtcagctcctcctcctcctcctcctgcgccacccccgccgccgccgccgccatcaccggcaccgacccggaacgtcgccgtcgccggtgtgtccatagcctccatggcctcgaccttctgcttgcaactctcaagaacgtcccagaacctcttcttcctgacgcgcgacgtctccgacgacccgacgacgtcgacggcggcctgtgccggcgaccacgtcggctgatacggcgagctgatcatgtggtccatcctggtgaccttggagaacctggagacgagctctacctcgttgccatcaaacgccgcttcgtccacgtcgtagaatcggtagtaataatcaagttcttgattagtacaaataatcgttgaatcttgttgctgtgtcagagtcagatgatggctctgctgctgggaacagtctgagatggagttgcatggctcaggggacatgcccatgttcatgtgaggtttgcaagggcaaatgacctaacaaaatttgttacaaggttaatacatacccggtatatatagacttgtagagttcattagtatagtgtttcattagcttaaaaacattagcattgtgtttaagctgtctgacatctcaggctagccgtttgcctgtctctcttttcgataagtagtagtgctactagaaccctagctaatactagtgttttttatttggttaattacgatgctgtttaacttgttaagtaagtacaatgcagataaaactcacaatcagtctgtctgacagtgaacattgagagattacacgtgggcgagaagattagattaaaaattggcacaacatggtagaataaatttcactcatccagtgtcaaaaaaaaatcagaaacatgcacagttcagaaatgcatctctatcgtctgtgctattcaattagtagatgagtacaagacagatgagggatcgcgtttgttgcacggaggtgttccagggcgaggggaattttcgcctgtttttgctttggccggagagaaagctgcaagcagatggcgttaagctgatgaagatccagcagcaaacttgatcagccatcagagataattattaattaaaacaggaggttgattgtagaatctcaatgacttggtgcacagggcagggctgaattagtctcttcgttaatcgttaggagcaaagtggttatcaatttaattacctcctgtttgcaccttgcaccggccatcagcgtgtgggattcggcagtatttccatatttgaatgtatttttatatttagactgctaatcttcgccacttcaaattcatagtgtcaattagataataacaacataaatttcagaaaaatctcatggagtgaagttcggtacgctgttgtgcaataagggacacagtacaaaaggcaaatgctcgccggcaatagccagcaaagaaagaatacagcagttgattacagctacacgcagagtgtctgaattctgcagtctgaacgcatgcatgcaagattgattccactaatcaaacagctaatctcgatcaattaagtaaatgcttttgctcatctctatgctcatggagaattaaaatagctggagaaattggagcactttcacccaaaacgtcactgtggacgccactctctttcgtctgaaccgcagtagcacgatcaggctcagctccgatcgagggccaggtatacattcttcctagttcgagcgttaaaattttagttgccgtatgattagtttgtgcgttaatactccttcatcgacaatgcgtgtgagatctagatgattgacaagtgcatgccattatgtcatcatgccaaccataaacaaattaattatggtgttactgatccaattaatatcttgctaagtcatgagtgtaacgcgaaaaaatgccgtaatgatatagttcttaaccataaaaaaatgtctaacatcatgcagattatcttcgtgtgttctaattggctttactcttattgtatgatgctttcacagaaacaacaggatactatacgcaatggtgctacacgcttgaaattggtaaccaagtaacttttatttcagtttggatagcgtagtacctacagaatctcatggtagaatctacgtgattttaaaaacattattttagtagatcatattatcggtagaagttgggggtttgtcccatctcgtcttttttaagctcttttctattcacttctaaactttttggctgtgtgtctacgagcagaggccggagatgtaacccatttctattatcttaaaaaaaattgagtgtaacgtgaatgaaatatctctagcagcttaatgcgaaatatgaaaattaactagctgtagtgaatctatggtttgtaaatagttcggtactactgaacatgacgtacgcatcagaaaattcagtactatttttaaaatataaattggttcaaaatatatatcgagcttgaagtggttctgaaactgaaacaagtggccttgcattgttcgttccgcttaatggtattctaagatacgtggattgatgattgatcaaggcaagaagactgttgtgcttcctttcgctttcaaatgaaatttgaaattatatagcatttcgctaatcgctagtcatgcctatgtacatcatacatgagccctctctacagtagtcagtttgtatctgaattggttttcaacttggtcggcgcagctaatcatggacatttggaacaccagtgtgctagtgcccatttgtttaattttggcggttcagattatacagagtggtttttcttgagatttctcccggtcccaatccattcaggagaagacaggctatatagtgacatttttgaaagggacaccaaagccagataatttccatgttatgtttggtccaaaactggcagcagcggtaactaattactagctaggttaccccgatgcacgatgcatcttacttaggtaattttttacattttcgccgaacatagtggagatgaggctcaactttctccaacttgtgtagctctgagaggaagcaggcgtacgtacgcatgttttgcagttgctttcgtgatatacacgcactcgaaaggttaaaaaaagtaaaaaaaaataaattggtcgatttaattgaagtactttttctgaacagatgtatgtccagattagtaataataagatatgtcacttttaaaactgttttttccgtcttataaaaaacgaatttagaatccgatatgacacatccgatattatattgattttttatagtatggaggtataggtaatgcgtattccttgtacgaggagggtgaaaccatcgtacgattagtgcgagattcgtcactactgacgatcgcaaagcaggaaccatgcggcgaagtggtccaattctcggttaattaattgcaaatggtagttaagaccgatgttgcatcgatgagatgggagcgccaacgggctaatatttatgcctactttgaacccatgggtttcagaacgaatttggatgatgaattatcgccgaatcagttcgattttgctggaatttgaaatttgggagtgcctagcaatcattcgaatgatttttttcattcatctcactcggatttttcaacatatggatgtgcgccacgttgcagagggaaacggtctagcttaatcgtaagttctaacaacggacccaatctaatagttataagtccaaagaggtttaataaaaaaaatgtcatcaacatatgcattaaaaagttacactgtaattttagtataattacactgtaattaatttgtaagtagtatgtaagtttgttctttggacacaaaacaatattggttccttgctcagttggtaaaaggcctttgttcggcaacaagagatcgtgcggtcgactcctcgcttacacgtgaacacacacattttattttcccacccggtccaaaaatcgaatgatatgtaacaaaaaatctgtcgcaagatttatagcaaaaccgttgaaatttttcgaaacgacgccttacatgcaaagccgaactgctggggttttggtaattctccatgggctaacagctgacatgaagcttaacttttattgggccaagcccatttgtgtcataaatgggctagcgagtaaaagttgccaagtcaacccggcccatgtgcactagtctacggtcttcttatacgtgtaccagcgtgcgatgaggaggtaggcggcgaagttggcgacgcagagcgcggtgagcagccagaagaagtagtcgaggtggccgcggttgatgtcgtcggggatccacccgggcgcgccgcccctgcgcgccgccacgacgacgagcgccgagctggcgtagtcgccgagcgcgaacgacgtgctggagagcgccgagcagaggctgcgcatggcgtcgggggcctggtcgtagaagaactccatctgcccgatcagcgtgaacacctccgacgcgcccaccaccgcgtactgcggcacctgccagaacaccgacggccgcgcgatcagccggcggcgcgccgcctcgagcgcgccggcggcggccatggcgacggtgaggatgacgaggccgacgcccatccgcgccagctgcgtgaacccgccgtcgtggcgcgtcacgcggcgcgccagcggcacgatggcgcggtcgtagagcgccacccagagaatgacgctgagggtgtggaagatggagagcgcggcggcgggtaccttgaagcggccgaggctgcggtccagcgtgtcgccctggaggatgaaggtggtggtcacctgggtgtacgccgccgcgtagatgatgccggtcgcccacaccggcagcagccggagcacgcacttgagctcttccacctgtgtcaccgtgcacagtcgccacgggctctgcgccgccttctcgccggcagtcttcaccgtagctctgtccaagaacctagatcaacaagcagccgagttcatgaggcaaacgatttgaataggtgatttagggcctgattagtgagcttaaaattctaaaaaatagttagtcggtaaccagtttctaagaatttagaaaagctcggttttccagcttttgacttctagtttattttctagattttacaactacaacttttcaaaattatgaccaacgctaaactttttaagggagtttttaattctagaaaaagctgcagcagttagaagctctccaaacagagccttagttgcgccatgacaatatgacatgtcatctcaaagaaagggtcggcaattaaaagttgatatatattattctaaactagctgaatttttatgtgcagtgcatagagctaatatatgttccactaaagtaaacttttttgtttacctccctttgataataaatatttgacgtttacttgcaaatgttccactaaaagaatatttattagtaacatctcaaactttgaactttctttgtttatttttgtggcaatcatggtttttatatctcttagtattaatgcgatggcttgtacataaagaaagacttttaaaaaacttgcatttattatacttttgtcgaagttgaattaccttgagttacaaataaatttgatgcggagtgagtgtaacttaacttgttggtttctttgtggtgcaatccgatcatccagattcaagtttagacttggcgtgagtgctcgcatttgcggctaattatttttttcagtggtacatgacgtaccccttgataccaagacattcgcagtgaattcgttagtatcaaaatatgttgactcagtcttttaaagatgctcatagctagaaataggatgtgcatgtatgcatttataggggtgagtatgcgcgcgttgtgagcgcatacgtttgtactatgtttctaaaaagaaaaagaaatatggcatattatgtgtttatggagtgatatttcacatattaatttatattatcatattcattttaaagaaacatttgagtgacatacgagaaaggagaggatgcccgcttgagaccttgttcgttcgatccctacaagaataagattgagaggaattaattccacatctcataataggtatgaaattattcttcttcaaattctcttgtgggtgggattaaaaggaaaaggcctgaggcggaaaatccatctccttatagactagactggacgattagtactattaacacaagaatttgatggtactaatatttggggttaatcaatccacatgatttttagcaatctcaaatcattttttcctccaattcaaagagaaacgacaaaggcaattgcactaactggaaatgcatacgcttgctcacctaaactgaccggtgtggaggagtcggcggcggccatgtatcgccggcatgccatcgacggcgtcgctctcgtacagcatggacgagtccgacggtatctccacgtcgaacttcctgaccgcggcgaccaccacctgcgcgatcctcgtcagcgggctgccccccggcggctggtcccgccggtacgtggcggtgccggcgaggaacacggcgacggacagcgcgctgaagatcgccgggacgccgtacccgaccccccacccgacgctggtctgcacccacaccagcacggtgccgccgacgagcgagccgcagttgagcgagaggtagaaccagttgaagaaggagctctgccgccggccgcgctgatcgtcctcgccgtcgtcgaactggtcggcgccgaacggcgccatgatcggctccagcacgccgccgagcgccaccaggtacatcccggcgtacagcgccgcgctctccagcctgatcaccgacgcgctcgccgccagcacgccatagccctgcatgctcgaaaaagaacacgcgatgtataaagcgtgagctagagctctctgcacacatccacgacgtacgccggcggcggcgacgaacgtaccacggcggagatgaccatggagagcacgatggtccagtatcggccgaggaaggcgtcggcgaggtagccggcgacgagcggcgcaatggagccggtgccctcccagttggtgacgttgttcgccgccgacttgctgccctcgtgcagcctgtacttgaggtagttcaccaggttcgtcgacacgccgaagtaggccatgttttggaagaaattgttcgctgatcgaccaacgcatgcaccaaagcacagaagatcgatatgcaagtatgcaacacgttacacgtactgggatatactaccaaaatgtctgaatttacgagcgtgttttactttaccgaggatgaaggtgcaggcccaccgattccggcgatttgacttccggcggtcggcggcggcgccgccgtgccggtcattcgattccacgccctccatggtttcagcaattcagagaatcagagatcctggaaaaatggctggaaaaggatgcagggttggtgtatcagagatgctgcgaggctgaggtcgaaggtttcgaaggctgctggagctgtacagctctatcttcgatacacctatacgatctcaatatcttggcccttttacttagggaatggcttatccctcagggataagccttatcgtttactacatgtcatttaaatagttataaaatatttaataataataataatataatataatatttgatatattacttcgcagtctagtagcatttaataaaatgcaccatttttttatttaaaaaacactttcaattaatggacttgcagatgcaacttatattctactgaatgcaagaagcaaaaccaacatgctagaaacagagctaacatgcaactagtactagtaaagaaagaaataaaggaacttaacaatctatgagccgatttcaaaacgggaagaccgccactcaacaatgctaatgaggaaacactatactatttcaaaagaaggaagtttggaagcaatccaaggagcagaacaacatggatatgaaaaaaatataatccactacttggggaagtgccgtataagtgtaaagcaataaccacaaaaaggaggattatactcaaagagtcaatgtctaaagaaataggagtatattcctatgtccaaatcaactaattcaactgagcatctaagtttaaattctacctatgtaggttgtaaaaagacagtaaactctaattaatatacgtttttgttttattgtaacttgaagaagtctaatctgggcatattattgtaaaaaagtcataaagataattatcaaatgcttaggttttaaaacaacagtacacataaatttgccttcaaatattattataacattataattataagtttattgtattttataaactcctaatatcaacagcattagatattcatgtcttcatcgataaagggtagagatggaagatcacatcgaaatgccttaaaatttcatagtggcatgtattttaataaaaataaataaatggtagagcaataagtaatttgaaacgagcggagtatatattggtagtgtttagcaatatctataaccagtagagtattcattagagttcaaaaagaattcctaagcactattatgtactccctccatctaataaaaaacaaacatcacattagatgtgacacatcctattataacaaatctaaacataagtttgtctatatttattataataggatgtgtcgtattcacgagattagtttattttgtgatggagggagtacgacattattcatcagtcacccccgaaggtactagcatacactgaaatataggctgtatgttgaccataggggtgaaaacggtaacggtaattaccggccgaccggcgttcgttttcgactttctaccggccgagccatatggaaatggtaatcgaccgaaacaaaaatagaaatggtaaaaaatatggaaatgaaaacagaaatggttttgctgttataccgatcgtttccgtatttaccgtattctcgtggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatatatatataacatacttatgtaaagttaaatatatgtttttatagtttaatgtttccgtatttgttaccggtttccgatctgtaccgacatgtttctgtctgtattgttccgtttccggttttccgatatttccgatatcgttttcatttccgactttaccgtttccgatttcgtttccgagaaaaatatggttacggaaatggttgaggctgttttccgatcgtttccgactgttttcatccctagttgaccatcataccctctattcagtatgggccaacatatatgtagcccactccgccatacaaagcccaaatccaaagtgatgtggcctattgaagcccagcccaacactgctgatatacggtcgatgcaagtacggcaaaccttacggtttagggtacggtgggccccacccagctaatctacggtcttcttgtacgtgtaccaccgtgcgatgaggaggtaggcggcgaagttggcgacgcagagcacggcgagcagccagaagaagtcatccaggtggccgcggttgatgttgtccgggatccacccgagccgcccgccgcgcgccgtggcgcgcgccacgacgacgacgatcgccgagctcgcgtagttgccgagcgcgaacgacgtgctggacaggccggagcagaggctgcgcatggcgtcgggcgcctggtcgtagaagaactccatctgcccgatgaacgtgaacacctccgacgcccccaccaccacgtactgcggcacctgccagaatatcgacagcggcaggtaccccccgtcgccgtcgtcgccgtacaggccgtgccgcgcgatcacgcgccgccgcgccacctccagcgtgccggcgacgagcatggcgacggtgaggatgacgaggccgacgcccatccgcgccagctgcgtgaacccgcgatcgtggccggtcacgcggcgcgccaggggcacgatggcgcggtcgtagagcggcacccagagcatgacgctgagggtgtcgaagacggagagcacggcggcggggaccttgaagccgccgatgcgcgggtccagcgtgtcgccctggaggacgaaggtggtggtcatctgcgtgtacgccgccgcgaagatgatgccgctcgcccacaccggcagcagccggagcacgcacttgagctcctccacctgcgtcaccgtgcacagccgccacgggctcggctctgccttgtcgccggcggtctccacggccgccttgtccaagaacctgtgaatcatgcaacaaaccggacgaggaatggctaatttagtcaatggactagttataaaactttcgaaagaaaatttctctaaaatctttcaaatataactacactgtaactgtagtgtgtttgtattattactcaagtgtaaatcgaatgtaactagtaaaaaattttacaagtcttgtaacagcgcaagtggctagcttgcgtggcttgcgagcataggtcctgagtatgattgtgcaagcgcacaagcaaatccaacggacgaaaaatggaaagttttttttaccctattttctgtccacgtaaatttagcaaatccgtttaggggaatagatagatcgtcttaattacttctgttccggcgcaaacgtaagagtgggatgttgaaatggtcacggtgcatgcgaaaatgacttcccaagttctcattcacctctacccaggtcagaaccaaatggaaaatgatgagaaatggaccagacacgagtacgacaaacttacttctcattcatctccacccgtaatttccaagagaaaaggaccacatttatatgcgctcgacgactccaagtcaaccaaaagtattgcccggctacaaactttctcttgaaaaatactcgtataagcattttgaaagataccccaaattttgtacgcgccttatggttgagaacgtctttctttacaatctaatcgctagtctttctttcactaaaaaaaataccgtcgatgtcacaaggaacagtacgcaaattaggtgcaccggtagactaaacactgtcactagagtcactagactactataaactttttttaaaaaaaattcagagaaactactgagcaagtgagcagtgtgacacgtgtcccaatttttaaggcgatgcatgttacgcctactcacctaaactggtcggtgtgcacgagccggcggctcccctgtatcgcggacatgccatcgacggcgtcgcagcactcgtgcagcaacgacgcgtcggccggcacctcgacgtcgtgcttcctggcggcggcgaccaccacctgcgcgatcctggtgagcgggctgccccccggcggctggcaacgccggtacgcggcggtgccggcgaggaacacggcgacggacagcgcactgaagatcgccgggacgccgtacccgatcccccacccgacgctggtctgcacccacaccagcacggtgccgccgacgagcgagccgaagttgagcgagaggtagaaccagttgaagaaggagctctgccggcggcgctcgccctcgtcggcctcgtcgaactggccggcgccgaacggcgccatgaccaccaggagcccgctgccgagcgccaccaggtacagccccgcgtagaacgccgccgcgccgccgtgcagcagcgccggcgccgcggcgctcgccgcgagcacgccgtagcccaggacggagatggccatgaagagcaggatggtccagtacctgccgaggaacgcgtcggcgaggtaggcggcgacgagcggcgtgatggagccggtgccctgccagttggtgacgtcgttcgccgccgacttgctgccctcgtgcagcctgtacttgaggtagttcaccaggttcgtcgacaccccgaagtaggccgtgtactgcatgaagttgttcactgcccccatacgtgacagcatatgatgcatccatccacatcaatcacagatgcaaaatcatctcgaaataatgagataatgagtatgtgttttgtgttaccgaggatgaaagcgctggcccacgtggtccggcgatccttcttggacgtccggcgatcgtcggcgtcggcgtgccggccattgcaggattctacaccttccatggtctcagcggtttcaaagaacctggaaaagagttgagacgatggggacgatgcatacaagacgaaggctgagggtgaaaggtttcaggaaacggacctctgcactgaaccgtttggagcgatcgatagagctgtgaaggccagctgctctatcttcgcattcactccagcttcacgctacgctctcggtatattcgtcgcgccctttaatagacactctcgtagggtggttggatttttcacattttggtccttttgaaaaacttatttcgtaagtagacccctagaaaaacttatcccaaaaatggtcctttttggggcgccagagtgcctggcgccgtcattcaacaggacggcgccagcctctttggcgccgtccccctgccgacgtggcggggcgatgctgaggtggctagggggagtgcgccagagtggctggcgcccccccgaatttttttatttttgttttatttgtttgatattttttcacgcttagggacacacaagaaccaaccatagaaaaattgaactcaaatggacgtaatatgtgacatgtagaatttttcctctcctctcctctctccgaactagtgcagaggagaaagatgtgcaacttttttatttttattttatttttttgatatttttttcacacttaggaactcacaggaaccaaccatgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagctggagagaatcggatgtaactttttctgtagatgcccgtgcatatattatttgcctgattccgtgtccgtatgagaaagttacgcctattttaatagatgacatattttgtccgtttcggtagagttttggaaaattctacatgtcacatattttgtccgtttgagtttatttttatacggttggttcctatgttctcctaagtgtgaaaaaaatatcaaaaaatgaaataaaaataaaaaattacatctctatgtactgtttaacttatatagagattaagtaatttcatatagtggtagagtgcatatagtggtaatattttgaattagattaagtaatttcatatatagtggtagagtgcattatgtttaacatgttgatcaaagagttttactaaaggagttatggtctaattttagtgaaggtgcaaagtagactaagtggtatgctagatattttcagacttagctaggtggtagttcgagtttaaattttttttgtggttggttgtatcgtgatcctgagtgtgaaaaaacatccgaaaaaataaaataaaaatgacaccgttgcaactccatatagagaaacaggaatggaggcggcggcgcca

SEQ ID NO: 40302 - DNA, 6665 bp, Oryza sativa
tctggcgccccaaaaaagaccatttctgggataagttttttcaggggtctatttgcgaaataagttttttaaaaggaccaaaatgtgaaaaatccagctctcgtagaactccacgattttgggttttggtaatttgctctgcgtcacatataattggttatgtcgccacttgagctagttgcagagttgagaatgagagtgctgagggagggacctctggagtactgcatgacatatggtcccatagatcatcgttgtcttgcatgtcaatctgtagtatgtattgcatgtgcagtactacagaggatctgaattggagagtgctgcgtgcattgaactactgatatgtgcgaatggcaaggggcaacgttgtagcgggtacgctttcctaattaagaaaaggccaggtcaagtggtctgcatttttcatgataaaatttcacagaacttccagcctcattgcttgcccatatttcctgataagtcaaaatggctgcccatattccctgataagtcaaaatggcttattagaaaataaaaaataatttataggtaaatcttttatatatttgtttataacaacttaaaagtcagtgctaaaagaaaattatatatgttgaaaatatcttaaaatcaacttcatatgcaagtttaaaaatttaaattttagctatcgctttaatttattaggccaaccgttggtgctcttcatattttagggcactagttactttcacaaaaccctatattttgaggcttgtttcagcagaagaatcaatcctgtcaattctactgtcaacacgtggttacagtctgccccaagacacgtgtggttcactaaaacaaacctcgaagtatatgattttgtgaaaccaattacaattaaaatttactcatttttcatgccgcataaaagacgacaacacatacataataggccacaaataaacttccgtgataaatcgcttgcaaattcacactgaagcacgggagtatatatgaactccaagatttctgtaccgtcatggataaagtcatacacgcattaactctatatcataaaaagagtttcccaccgaattaagtatagtttaactggttaggtttcttacgttgaaactagtctatccggattcaaatcctatatttgacacgggtacttctattaagggctaattattatttcaatggtagacgacgtatctgtcgacagtgagatacttgtgatgacttcgtcaaacccaaaatataccgatccagtctttcagtggtgttcataagtgtgtaaggtgcagggtgtgcgtctgtgcgttcattacgaacaggggcggattcaacgtgggtgggtggggggggcttgagtccctcctacaaccaccagactcatggataccccccgagtcccccctcaattttttttgtcatggttggtaagatagaagttgttaaaggtctcttaatagcgttttagcacaatttaatactgagatgatgtgtttatactggtgtactagcatgttgagtatcctaatcttttgtttctgatccacccctgattacgaagagtgtacgtacgttatgaacggctgtgtttgtattttctaaagaaaaaaaagagctggccaataaaagcaagtgaccgtggcggctgtcagtgcacaaacatgtgcaatatgcaatgtgacgtactacgtggccgtgcttctaccagacaaacggagccgcaccgcacgaagaataggcaacggccgcgaaaacgcatgtggtttcctttcactgtccaagccctcccatgcatgcatgtgtccgtggcacattggtcagctgaaacataggcccacacgagaatgatggtgcctgcatattttagtaccagtggcctcattggttcccctaaagcgaaactatattaaaaatatcttaaaaccaacttcaaaaatatattttaaatttgaaattttggctttagcttatctttttttaagcatagccgatggggctattaagagtaacagggaatgcgtgatggtatttctctgaaattgtccgggagcatgcatggtgtggactctggagactggagtggatatctaagccatagctaggctttggcctttgcccgatcctagctagtggctgctggtgacgatcgatataggccattatctcctatcacgaattcaggataggcagtagtgctctagtactactccggtttactatctccatcctactagtgcgtaccaattggagccaagccagctattgctatctatcattaatactccttcacgtttgcgtccatctcgatcaccctacagaatataatgcatatacggagaattttctcgtgcttttcatttggcttcaccgtgagcaggacatgacacaaaaattaaccgtgcgcggtgtccagacctttggtccgccgcgcttgccgatcggtcggcgtgttacgggaaaacggacacggtgcgtgtgtgaatgagcgttgtggtggcttgcgcgcaaacgcacaaaaccgtggttccgaaggatattagttcatccgtgtcataaatatgtttatcagtatcaggatgttagttatatttagaacataatattataatatacaggtaagtagtttaattattggttattaaaaatcgtcggtgttgtatgacactgacacaaccactatggatgatccgaccgaaacaaggaggcgccgagcgacgcgcggcctttgtgcagccggatgcaatgcggcgcgcgtacgtcacacgaaccgccgagcgcaacggccggtgtctgggtggcggagcagagtgaatgagtgatgggtggaaagcaaagcgcgcggtgccacgccatgacgcggacggaatttcaggtttgggatgagatgggaaggacagtgagtggtgtgatgtggtgtggtgcggcgttggatatgtttcttttcttttccttttttatgtatcagctcgatctcttttcactgctaataatgcagatcaatcagcatgggtgtaagtgtgcaagggcgtagacgagcaatagtggcgacaggtcatgtgtaccgtcaagctcgctgctgccttttccgtctttttctcatgctgtgtttgtcaccgtgcgcgtccaccactttagtccgtgtggctctgttccgatgtgcatcagttcatgcatgagtgcacggatcacggatgcacctatcgatcccaggtatagccgccgtataccagttcctacttcctagtgcaaaatcatcataccggggtccatctcattctcatgcaccaatgcaatcagtctactattgcagtagtacgtgctcttcgtctgtctatagatatatattgctcccaaagttgcatgtcgctgttgatgccgtcggctgtcggggatccagccgagccgagccggcgccaagccccttggcgtcctcgccggacggcggggcgcgctctggtgattgggcgcaagcatggatggcgcgcggattgcgtcgggcagtgaagcgcgggagcggaggacgaggagatttcgaattaaatttttaaatatacattatttttctcaattttgtgtatacgtacatacatgcttctaaaaattttacagaaatatacgtcttccgctggttggggacgcggaaccgcgctgtcgacgcggctcgaagacgtgggatcgactggagggggcggttccgcagcttcaacacgtgtgaccgggacggtcccgcgccgagataatgcggcaccgctcaacccgcgactaggccgtgtggcaccaacgcggtaccgatgggagcggacgggagtgacggcggaatgcgtcagactaggtcacggtcccgcggaatggttaagcgggtccgccaaatgcaaacgatcaaacacataatcaaataaacttttgttcgtaatgctgctaatgcatgtgtaatgtgctatatatgctaatatgcatcactgtgctacactgatcaagcggcggtggcgctgactgatgacgcgggaacgcccgcggtgccgcatgcctgttctgcgccaccgccaagcggtggcaggcatgcacccgagcagcggccggtgcggcggccgatgcggtgccgcaccgccccggcgcgggaccgccccagtcacgcatgttggctggaggaggcggtgccgcatcaccagcctgcgggagacgtatatttatgtaattttttgacgtatatttatgtaattttttcaaacacatgtatatatatacaaaatcgaaaaaaaataatgtatattttaaaatttaattccgtggatttcgtggagagacaaccgtgcgcggtggaacgcgtccggcggcggcatctcgatctccgtacttcaatctcggaacaagctgggaggctgggacggaccagattggattttgtgggcctagttgttccgctggcacgaggccccgtgccgtaatactgggcttcgtcaaaagcccgttgtatttacggatggaataagttcactttgactccctttaaagtgatccgaatctaatgcatgaccctcgaccgcaaaaccagataggatgactccctgaacaatttgacagcggttttggacggcggttttattgacgtggtgatgttgacctagtattttttttgaatgacgaatggggcccacatagttttttattttaatgcctcctaagcgtgacgtcaacaccacagaccaagtcaacatcgccacgtcagtgccatgtcagcaaaaccgtcgtccaaaaccccaaaggaattcaaattgcactggtttgaatagttcggggggtcataccggttgtgcggttgagggtcacggattaaattcaggtcactttttaagggagttaaagtgggactggttcctttacggacacgggacataggcgagttttgggccatatagatggcccgcataggatctctatcggtaccaggctgacttctccagcccgtacggtcaagaagcggcccaagtaaccagggtcacgtaggcggcaggccagctggccattccagatagacaccgacggtgaaaagaacggcttgactcggttgcgttgcagcctgcgtttttccactttgaaccttcgtgctctcgcccgtcgcgtctgactggttactattactcgtatatacgtaatacctccgtattttaatatatgatgccgttgacttttcgactaaaccattcgttttattcaaaaattttatgtaaatataaaaatatttatgtcatgcttaaaaaatatttgatgacaaattaagtcataataaaataaatgataattacataaattttttaaataagacgaatagtcaaacgttagacaaaaaatcaacggcgtcatacattaaaattaaaatatggaggtatatacgtcatacgtatattgtacctgctggattggtcattggcaacgcgttactacatcttaccacatgattacttataccccgtgccgccgtgcgtacgtgcgtgccgttgaaccgttccggttaatcgatcagctgcttctcacaatcaaaattctccgcggtctagttgtctatagttataatcgccgtgtcgccggctcacacgtactatgcgcacaagtagcacaagtacaacgacacggtctttgcgacgagcgaattggctgcaggatgcagggggtatcctccgccgctcgtggcgttgacggcggctcgctcgcgggtgaggatttgttacctcttcccagaaatcgcctgacccacccgcaccgacaacacatggaacgtgcgtgatcagcaacccctttttttctgggaggaggtagagaacgtgaccagcaatcttgggagtgagaactggatgctgtgtactagtactaatctcggatacttggccttgtgaacaggctagctaattggtctcgattgcgctttggttagactggttaaaacggttgacacttacactaacccgtaaacatacaataatttcagaacattctaacggaattcaccatgagaagagaaacagagggaggcgggggtttgaattgaaaaaacacggtcgcatttgggagcgggcgttcgcgtcggctcggctcggccgcatccacggaatcaaatcaatccaacgagcgagcgagcgaacgaaccaaccccttcttcgcctcggcttcgcttccccgtcttttccttccgcctcaccaacctcgtctcgtctcgtctcgtctcgcctctcgatccttccaccccacgccgccctctgccatcatcgtcgtcatcccatccggattgccacccaaccaatcgccatttgcttctcgctttccctctcctcccccaaccactccatcatcattcgcaatccaatctcgctcttggttggcgtcgattttgacgcggtctggttcgtgaatccgacggagccgggtgatctgcggcgggacttgcagatccgagcgggcggggcggggcgggttcgctcgtcggatgtgtggatcctggtgaggtgaggcgatgccgggcgtcggcgtgaagatctacagcgtcttcttcaagttcctcctccgccacaagctccagtcgctcgccgcggcggctgcggcggcggcggcgggaggggaagaccacgcggcggcgttcggggtctcctgccgcgcggacgaggccacgg

SEQ ID NO: 40303 - DNA, 4672 bp, Oryza sativa
gcccccgcccgccaccgccaacggcgggagcgcgccctacaggggctacctcccgcacgccgtctcctccccgcgcgccgcggcgtccgcgcggcggaggctgcccatcgtcgtccagttccacggcggcgggttcgtgtccgggagcagcagctccgccgccaacgacgccttctgcaggagggtggccaagatgtgcgacgccatcgtcgtcgccgtgggatacaggcttgcgcccgagagccgctatcccgccgcgttcgatgacggggtcagggtgctcaggtggatcgccaagcaagcgaatctcgccatgatgagcaaggtcggtggcggggtggacacgttcggtgcttctaccgtcgagccgtggattgctgcccatggtgatccggcaaggtaagatttgttcaatccctcttgtttgtacttgtgttaatcggtagtagtactgtattgcagtaaatgggtaggaacttaacactgcattggcaaatgaggcaaacaaaagaattgagtgaagataattgggtttttctttcacaaccttctatctattgatctaatagttctaatttgtcatccactagcatttcttggtactgtacatcaaaattgctctagtttggtgaccatattagaagggatgagtaaatacttggtctgttggagattcaaatggtaataatattatgaatgtgttgagttccacaatagtttccatttctgagtggtaccagatttaaaatgtgcgagaatgttcgctgagacaggttcaatgtttagtgcccgttaattaggcttgttcgatatgtcatgtgtaatttatgttgtatcacgccatctgcatgcacttcagcttttcgtgtggattgtgatgatacacaggctcacaacagtgtgtagctccagaattaagaataagcattcaaaaaattccaaatgccagcccaccaggactgtactccagatggttgttggcatttataatacattgtgccattttaagattcgtttgacttgtggcatgtgtgttgactttttctttggaaaaaaaatgtaagtttttatcttgttgggaaagctctattcatctggaagctaaatgttgagtagatgtctgttaatggtctctccacaatgcaattgctttaaatgcaagcaaaattacatgttttcgtattgatgtaccatcttcacttcaacctctgtcgattgatgttgcaacttcctgggtgtagatgtctcaacgttcaaagtgttcacctaagttcaatttccaatataatatgttagtctttaccacgccaacaactattcttgtcttgctggtcaatatacctgatcatttatagttattccttttgttctagttattgagcattactattactgtaatctgaccatgcattctgtcttttgattgaacagatgtgtactacttggtgtaagctgtggtgccaatattgctaattttgtcactcggaaggcagtagaagatggaaagctatttgaccctatcaaggttgttgcacaggttctgatgtacccattcttcataggaagcgttccaacacactcggaaataaggcttgcgaactcatacttctatgacaagtccacatgtatacttgcttggagattatttttgtcagagaaggaattcagcctggatcatcctgctgcgaatcccctggctcctgatagaggagggccaccactgaaatgtatgcctccgaccttgacagtcatcgcggaacatgactggatgagggatcgagcaattgcatactcggaggagctccgcaaggtgaatgtcgatgcacctgttcttgattacaaggatacagttcatgagtttgcaaccctcgatgttttcctcaagacaccgcaggcccaggcctgtgccgaggacatcgccatatggatgaagaaatacatatccctccgaggacacgagttctcgtattagtagttgtagcaaatatatcagaactgtgaaatagacttacgggaaagcatcaacatgttctttttcacctggtaatgggagcaattgcaaagtggaggccaggaacctgttagcctaatgtgagtgagtactgggctttttccccccatttattatggtctttgtgagagagaatgtagtgtgcaaattgtagactgaactcaaagacgatgctcttccccctgtagagctcaattctttaatttcttttgtaccctttgtgtaatatgaaattgttggggcttgaatttaccatttttgagaaggcaagtgtcattgtccaatgatcaatttaaagaaaaagcgttgatataccatcgcgtctgccaatcaactcaattttcttttacttggttaacctttacttgttttggttgtaattttgataccactcaggttttctaacgcaaattccagaacaatattcaaatggaagttatctccaacttgttttggttgttaattttgataccactcaaaggtttactttgcatttcacccgtttacttcaacctcaccttcattttgcaaggtttaaggcgacacattgcttcgtgcttacaccaacagatttcaggcctaagtttcgtatgtcttccagcttcttgtttaatccacatgcatgttcttttgacacatgtatgctcgtatgatcttttcaagtttcagcatcgtcaatgaagtgaagttaacttcacccccttttcccagttgctaattgtacaataaacggacattgcactacatggctgaaacttgagggcagctccgatgtgagaaaaatgactgctcctagataccttgtcactgcaaaagcattctcgttgcagtaaaaggttgaacaaacgaacagatcataatcagatctcagcactaactattccctcagagaaaaaaaaataattcaacactaattaaaccttcaagggttacacgatctttcacagactgttcctcgttcggctctgaatgaaagcttgcaatgatggttctcgtccaaggtagtcagatatgatatcaaggggatttttcgagcctcctggagccaatacctgaataatgaaagcattttagaacaattgccatgagtcgatgatggaaatacataatgcctcaggagcactagtcagtaccttatttctaaaccgcaaccccgcatgctgatttagcaagtcgtctttaaattttgatgcaaacagatcagccgcaaacacctgcattgtaaaagtgaatgtgctttactaatggtttaaaatatatgatgagtgtaatatgcctttggagttatgcttagatcagacctcactccatatgtaactgtagcacacagcatcatagccaatagcaatacgtggaaaacatgaagctgggctattcccttccaacaaaggtatacctagcattacctgaaaaaaaaaggagcattacaccttcagttgtccatgcaagtaatataaataatgaatcagttatttacaatgtacctttggatgaagatccttgattaagtcatcaatgttcacattttcgcctgtatgtattatctgatcaacaaggcctggtaacagcaaaagaacacgtattagctagcactaatgaacatgtcaaaaagcatataccaggttgggattacacatataaaaacagtaatttattcagtgaataggcggaaaacaagggaagtaagactgtttttcttttgttcaaaatacaggtcttaagaacgacaaatgagtttatttatcagttattgtgttgcacaattagagaaaacgaagtgctggggacatcaatcgtcaatgtctcatagtatccgtatctcactatgttgtcagagtatcagagatagtactgttgagaaacaatcttcccagcaaaatgactcacacaaaaggatctcttgtttcagtttcaggccagcaaatatgtcacgccttcttttcagtgattggcaagcctcactagtgatagacttcgtaatgtcctacaatgataagaacagaaactatttcaagtgcaatttgaaacaagtttcatcaggtcaacactaacttgtctaagtctaaaaagcctgtatcaccaatacaattttttttatgtgtcatcagattcacttcatgtcataaacaaaagaggaaactattcccagttcatatactgctttcttaatctaaacaatgtttttccggtcatgcaaaaaacatccacttcttattcataagcttggttgttccattgcctaaaataacttggtagtataaaaatctaaatatctcctctgtagaggcagtgcacaatgtttcaaatattatttcggcacataaacatcatgctaacttgcatcacctgatggaagccagacatcatttttagagaaatgttctcatagcacctgaaatggcaaatttcatcttacacatcagaaatgacagcttccaaagtgttggtatgttactgaagaaacacagcaatacctaccaattctcaagtaacagacttggaatttcagcaaaatccccctccagttgaagacccgaaaatctagaaaaggtggctctgttggagatatgatggacctacagaatattggagaccaatcaacgcagttttatttgatgttcaacagcggaagagataatcagcaatctggcattggtcaaa

SEQ ID NO: 40304 - DNA, 2535 bp, Oryza sativa
cgggctccaatagaatccacatgtacatttcaccgattatagatatcacgactcgtgagaaactgagaaccgcagagtcgttttctagcttgtaaaattttgattgtcttaagtctccagtagctttgctttagcaagacaccctttttacactactttgaataaccagtcctttcaattgagccgattcgaacaattgatcatgctctaactgcactagaaatacatgaattctctacattacctttcttgtgccattagaacacaggcatctattctgaagtgccacgacgcaggtatgtgcatattttccttccctgggaataaagtcaagtagttcatcaaaattactttatttggtcgcaagtgcaagtggaagtgtgcatttttttcccttgtgatttgtgtttccatgttatgctgtttatccttaatgtttctttcatgtgttctgtgtctgcatttatcaagataagattttatcctaagagaattggctttcagaagtaatgtttcaatatgcatgctcaactagatttctaaatagtagcgtgaggctagcaaaattattaaaacttcaccagcatgcatccaaacaaacctggaaaagatatccagaaaaaagtaacccaaaagatcacttgaacttgcatcccagacagaaaagagacgaactgtatcgtgccaagtctcagcatccttcatttcctcaaatcgcagtgctgccaaaataagatgagagtaaaacacatccagtcatattttggaagaggtatatccagtcgaattttatgaataatggggggttatggtttattctctgatgggtacatcttaccaaacagatcttgaaacatcttcaatattcctgatatgaccaggtcaacagggaaaaattgtttaatttcaccaatatcaagatcaaccttgagctcctcagctcttttcatgtagtataacaggtcttccacgctaaattgagcatcaccctcctcctccatctgaaattagaagattgactatgagtttaaattgttaataaaaagagtgtaatcaataaaaagaaagagagagatcaataagagctttgtccaaaaccttcagatctttgagtacgctgagctccctattagctaggccatttaattgttctgacatctcctccaaaaactccaagacctgtaggtacaagtcctttagagcatgagtgggtcttggtatcatatgcaaatttaggtgagcatgtgaaaggggatgcaaatgaaatggctaaacatcatcttgttggaaaactgatgatctgagagtaattatatcagtatattgagacaaaattaagaatgcagatttagctaaaaaaaatctctagcagatctgcataatgggaaagtacaaaccttccttgacgtcctcggcattctaggttcaatagcataatcagcataattgggataccccagcaatctagcaagccggtgtcttagctggacctattattatgttaaaaggggggaaaacacaacttgtcagctgctggtttccattatgaactgagattatgcatctaaaataagcaattgctttaccagttaagaaattaaaacattgtaacgcttaagtcaaataatgctcataaatgtggattgcaccctagtgcacctctacagcacaggttggacgtaaaataataaaatcctatttcaatgagctataatgttacatatctttcctgggtaattgaccaactgcagcatagaacttagttgtgcgaaataaatgaaatcatgaatcgaaaggtataagttccttatgagtttacagatatgaatatttggagttaccaatttttccaggatggctatattctcttttccacctttctggccataagcaacagcaatcagtttcctggtagagccaaccttgaaaacaagaaataaattagaccagttagcgattatataaaagaattgtagtaaaaagattctaatcttaagtactccacagcatataatattaaatgccttatgcagatgtgcatgaaaagaagcacaaaatagagctgaccttgcaatgctcaagaattggagtaacatgataactggtcagcagaaccttccacttcccatttgtattttccagttcctgagttgaacagtcattgtaatgtaggatcagatagaaatagtatcatccttttttctcttatcacacttcagttcattcgtaaagtccgaaaatagctttcaataaaagctgagtactcccattttttaacagtccaatgttcgcacattgtagttcctaaaggtaaactcattaaagaatgatattggatggatcatggatgtgtgaacattcggaagtgtgtatactgcatcctcccagcttacctttaagaactctagtggcatcccagccaggtcttcctcgttcaatagaagaaattttgtggaatcatttaagctttgaatatacttcaaacttaactcatcaatgtgagatttcagtttctccatctccattttcttgctt

SEQ ID NO: 40305 - DNA, 5577 bp, Oryza sativa
aacagattcataagtaaagtagctatacatccactgtctaccttcaactttgatctatagctaaaaacgaacagatattaatcttttaaagtcaataaatcataggtgaaatgcaaaacgaacaagaaaagatagagcacgcacaaaggtactccctccatttcatactataagtcgttttaacttttttcctagttaaactttttaaaatttgatcaagtttatagaaaaatatatcaacattttcaacacaaaataaacatattatcaaaatatgctcaatgttacatttaatgaaacaaatttggtgttaaagatgttgctaattttttctataaatttaatcaaacctaaagaagttgactacgaaaaaagtctaaccgacttataatatgaaacagaggtagtacatcggatgaagaaaagatacaatgacaagggacatctatagagctgcgtgatcatagcatcattcagagaagggaatcgtctaccatgcactggacaaatcttgttgcttcaaggcctattctttcacctttctgtgtgaatgcctttatgacacgatacacatcttcacgctgcctggacaccttgcacgaaaaaacaaggtacttatactagagtctcaacaggaatttattagatcggaaaggtcaataacagggaattcaggttattgttttatttgaaacaggggcccttgttttattaaggaaagggaattcagattctattaagaatgtgttttcttaaccatatcacttcatttaaccatatcaacaatggaaaggaatgaatactggaatgatgttatgtgttacgaatgctcactgaattggttatataataatacaagtatcgtggattcttaagataccaagataccaacctatgtgcatggtttcacattatttatcaacagtgattgcaactctgtctggtagatgtataactaccagcagttacaccgtgtagatagaaaaggaaataagtaacaagttgcacctgcactgctggaagtgagaatccaatcgtttctctgcttctgcactggcccttcgtacatcatcagacggtgagaccattctaggaagcacacaggcttgaaccagtgggaactgctgagcatctaattccgccagaggtgcaatgacattagagaagctgacctgcaacagaacatatcatgtaccaaaatatgaaacccgtgccactctttggctttatgcaggcaaatagacagtataggatgaatatatcctgccagtgttgaggcatttaaaaagaacccacacatttattcatgtcacattatcaacttaatgaaattaagaaacaacatactgtaaagcgtacgtgtttctgctgctataccacaaaaagcatttcaacgtaatggtgggatgcaaatgaaataatgcagcatatacacattccaaaacaatgcctaagatttgattgaaaaggtatattccataaaaaatgcagaggcagcagagtgttggatacatactttatctaggggaaccgcagccacagcgtcgtatgtttccttcgacttagaaacgacgcgatcagctaatctcttgatgtcagcagctgagaggttgacttgcgcagtaaaccctgggagctctgcaaccatccaacacattcaaacattcaatcacgcgaaaactacgccactaaatcttcataactccatgccccaagagttaaattcctgcaatatttattgcgatcaaacacatatttctacatctcacgcgtggatttgcggacagaagggcaacattatgggggccatttttccactcttcacgccccccccccccccaaaaaaaaaaaaaaaatcaacagcggatgctacattgctacacaattgagcagaagcaggagaggcgtgcacagcttgaggaaaaagtagagcgacatgaggggagcatcgtaaccaaaactccgggggggtttcgggcggcgcgtacctcgccgcttcctgcggcggtgggcggcgacggcggaaaaggcgaggttgaggccgacggcgacgagcgccgccgcgccggccgcggcgatgacccggcgctcccgcctccggagagacatcggggcgggaggaagcttctggaaggttctggaaggcgcgccgcgggcggcgaagaggagagagaggggaaaaaaaacggaagagcagctggagcagcgggcggctgagagctagagctaagcgagcggaggtgacgatgatatgcgagatctggccgttggtatccgcgtggacggctggatttaagggagatttttgcacgcctctatagctgtatacagaaaattgatttgtacagtactttctactttgtttatgctggttgatagcggattaccagctacaggatcagcattaggattaatgctaaagagatggaaagcttgtccatcaggtttttttttcaagccaaaagtcactgttgagctatagagctaaagataagatcttctggatttgttcaaatagagtttcgttattaaaaaaatagagttttgtccctatctttaaacattggcgtagtgaattttaatcttggttttaaggatgtgtttgagatgagaggaaatgagacgattgagatgatacacgaaatgaggtgagccgttaccatatgatttttttataggaagctgttaacatatgattaattgagtattaattatttcaaacttgtaaaaatggattaatatgatttttaaagtaactttgctatagatattcttttaaacgaaaagacgtaccgtttagtagttcaagaagtgtgcgcgtaaaaaaaagatagacttttttctcttgatccaataccatttaacatagacttaattaagcaatgtaatatgattagcttatagcttaagagctcatttagaacacatgatttagaaaataaaggaatagaaaaaatatagagataggatgacatggatgttgaatctaaaaatggtccacatgagtttgtaacaaatgtcttttggcaaaaccaaagaaaaaaatatagtaacttcatgactctagaaagagagagcattaggttagttttcctctgaaaattttatgaattgattattccaaaggaattttaaagaattttgtggaaatccagtcctttgttccaaaggatcaattttcatataattctaattctctaaatttcttccatttttccttcgttccaagggtgtattctgtaccctctcaacttctatttttttttgtcacacgcatacttctcaaactgctaaacggtgtttgtttaaaaaaatttatatagaaaagttgtttagaaaaaccatattactaccatattttaagtttatttttactaatattcaattaatcatatactaatgtgtcttttcatgatcgcagcctaaagaggctcgtttgtgcagtgcccatcggaccatctctaaatacaagcccatgcctcggcccacaggcccatgtgcatgcatccgggccatccggcgcgttgtgaaggttcagatcatgagcgagtttaatgcctgtgtgcgtacggaatcaagttgcacattgccagtcatgacaaaaaaaaaaaggtgtacaatgtagactcgtatactagccgtcgattcatcctctcaaacatgccctgatcccgaaaaggttgtccaacacactgaaattcctgtgtataattatccatgttcttgttgaaattgaacgtgcgttacacgcaccatgcatgtcaagttgatttttttttaacacgggaaatggaagactgggttgatggtaagatatatagaaagaaatttaagcaagcggtaatcggtgaaataactagctctaggatgatatcttatatttcaagacacattttgaatgtttaagcttcatatatttggggacgaagatactaatagataacaccgctccatgatggtgtgtctgtttatacctctgtggttaatatagttagagaaaatatagtgcaaatcacatatctagtggaaaactagaaactactcctagattgaaaaatgaacatataggattttttacgttataataagagtaaaacttttattcaacaatagtttttttattttcagtgcacttgtttttcatatagataatccatccgtggtgtttgaatatcctacgcaaaatgaggtgataataacgtgtgattaattaagttttaatttttacaaacttaaaaaatggattaatataatattttagaacaactttcatatagaaagttttcatacaatacataccgtttagcagtttaaaaagcgtgccaggaatatttataacttaatccactttttttaagtggaaacgaactgagcaagaaatgttggtcctgcggcttagctgttcgtggcccgcgtgccatcaacccgtactctctctgtagaaaaagcaaatcatgggttttcgtgtccaattttgattgtttgtcttatataaaatttttttataattcatagttttattattattagataataaaacatgattaatattttatgcgtgacttatcattttaatttttttcataatttttttaaaataagacggatgcttaaacgttgggcacagattttttttttatttttttttttttacggagggagtacgtcgtggtgcctgactggcgactgcatcttcatggtggacacgctgggtccgtacgcgcgtgaaaccgactgctcacgcgcccaaagtacagggcaagctaagctatagctgtactaggctactggctagctagtgctaccgtggtccgtggatgtgtacgagcgctgcaggcaatggcagggggcagcgtcatattcacgtggcagacgaggatgcatggaccgccgcccgccattcgctcgccggagacatgcatagcatacgtctttctctcgccggccgccacactattatgtcgacacgctgtgcacacacgcacgggtacatacgtccaaatgtaggcgtttgcctttaatttgcgagctgaccaatccgagagaaacacgttcaaaattgggtgggtataccatactccctccgttgcgtaaaaaaaaacattcttcctccgtttctaaatatacaccattgatttttagcacatattttaccgttcgtcatattcaaatacttttgtaaaatatgtaaaattatatgtatatatatataagtatatttaacaataaagcacatgataggaaaagaattaataattacttaataagaaaaacggttaaacatattttaaaaaatcaacagcgtcgaatattttgaaacggatggagtattttttcaagtataaaaatgctatatataggcatatatatatatatatatatatatatatatatatatatatatatatacacacacacacgtacatatacgagtgatgttgcgtgcgtctgtctccatggcggtcttcatacgtcttcttggctgaagcattcggacgcggctggtcactagttaaaaggctatgtagatgagaagcagactaaatattaaatattaatggtatacactatattttt

SEQ ID NO: 40306 - DNA, 4464 bp, Oryza sativa
agatgttatatgagagaaacaagtgggccatatattaatggtaaatagctatctattatatatgtaggctaagagaaggctgcaacaaattttatagccaacaaatcagctgtattagccttgctcgggttaattactttaagcacgtatttgcgtgttgccgtctacgaagtctctggattgtcatgcatgcatacaggtaggcatgggcatgattaaagtcactcgcaatcttccactggtatcttcacgaaggttcaaattcctgaatgtttttagaaactcatcagatgtgaaaaacaaaatctcagattcttacgggagtgaattggttcctgcccagaaactccgatataaatcaatgaatccaaacaaagggcttattcactttgataccattttcagccataccattttttaaaaaattaattaaaaaatctacgtttagtttgttgtcaaatttagtaaatacataagaaatcatataaaaaatttgacaatattgccatcttgttaaaattttagcaataccaaaatttggtaatgtttattttggctacaatctaaacagacaaaaaaaaaaagtcctgattgtttcaaggaagaatgagcaagagcgataattaccggagaaatcaagtcttttacaaggaaacactaccataataatttagttggaacagtaacagagtgagatcagtaatttagttggaacagcaacagcgtgagatcagtaatttagttggaacagtaacagagctgtagccagtaagcgaaagggcatgtagccatggttaccagtgcctcagtagcaactgagatcctgggttcgactccccatggaagtgaattttccagaatttaacggcgctgtgctttcagtggtaggcaatgtacccgtcgacagcgagacgcatgtggtgacttcgtcaatttatccaggatttgccggcccagtcttcgaagatgctcataagggtagggtttacgtgcgtgtgtttataagggtgagtgcgcgtgcgttgtgagtgtctgcgttgtattgtgtaattcttaaaaaaaaaaagagctgtagccagtagcctgtaaaggctcccagcacgagaaagattcacagctgcaggaaaatgacaagatttggcaatctgatgatctgatcagaacggcgccgcgccggcatgtgcagataaaagagcatcgggattcacgggcactgagtaaaagcagcgtcgggcccttttctagcacgaatctggatgctacaggtataccaacagcaaaacgactgaaaaaaattgggtccaaacaatatgcactaccacatatggtgccatggtcctattctccgctctttccttgccaaaaaaggggcatcgatcgcgacatgcaaccaaggctcaagtcgtgattaaaaaaaacatatagtcattccagatcattaatctaaacaagaactactgcttgacgggaggaagtaaaataaatatcaagcatgagacacatttccggctgcaacatcgaacaaataaaagaagggaaagaaaagatgctattgcatgtgttcagtaaggcacgaaaataaaatagaacaaaccgtagtcctctcttggtcaatggcaatattgatcgtaccgtgcttcctgaatccttctcccgaccgttttcatggtcacatgcacctgaaaaagagaaactaaatagagaataaagtgataattatcatcaaatcaacatgacacgacagtaccatccatccatacagaccacacacacaaaaaagaagacattaccacttgctaatacaattgagatgtgcttctatgctcctcagaaaaaaaaaagcacgaatgttaaagatggtgaatggtctaaattaaaaggtgattaacaggctaaacgttattaggaagggcaatttcgtccttgaggtagttacccatatcccaaacgttcaatcctgatgcagcgccgccccgactgccgccacattcgatcgcaagtacaagaaaaaaaaataaggcattccatgattccaaaacagcgaatcctcctctgttccggctacacatgtgcagcacctcaatccaccatttgattggcatccatgttcttgcaaaatcaaaaaatgagatgggggtagagataagaagcatgacaagaaaaatcagaaatgggtgaaggcagggagcacgccgcggtagaccaacgggacaggtggtgtggtgagaggaggaagaagggggtggcgcagcaaaagtatacgggcgatgcacggtggaggaagcgagcacgatcgctgagagtcatcgatttgtaactcctcatcggctgatcgagtatgtgataacttcacaggacaaaattgcccctccctaatgacttttactctgttaagcaacttttaatctaaatcattcatgagctttaatatccgtgcaggtttttttagtgagaagcatagaagcacatcccaatacaatttcttttaagttcacctgctactaaaacatgttctgcgacgtggataatgaacagaagataagataaaaccacgaagtatgaaagttaagcactcattttcccattctttcttcccaagtacatcacttatataaagtagcggatccagaaaaaaatagcaggtatcctatacctattaatagtttacttatcaagtaataatattgtaattaacatggccaaaaacaaacatcctaccaggtgtcgtgtgccccaggctctaggttctaccttctcttccacaaccacaaggtcctaaccaaccaaattggacgcatgtatgtgtctttcgctcaccttctactcacatgccgtcctcttttgcattggccacctcggtagttcaatgatcatgcactcgatcgtacagccgaaggactcgatgcaagtgcacgcatggtggacacatgcatgtctgcacagcacactgttggcagtttccactgccaccgagatgccgctccaaagttgccgatccggcgtcaggatgccgtagcgagatttgatctctgtgggcaacttggattggtgtcccggtttgccatactttctgtctgcatctcataacatgttgcagatatagccattgcgtttggataaacacttcagctgtagttactacattttctttatgctgcagctcaaggtaccttggaggcccggacatggaaatggaatctcaaaaatcatggatatgtctttttaaagatcagagcacttcttgtcgtgaacgagttgattgcaggtccgattaaaaagaggagatcccaagtccagatcctataagtcatatgcaatcaggttctccttttggtctgctcttatcggctctgcactcctcactttgtttgctggctctctttcaagtttgccttagccctagactcttgccttgctccaatgtaacagtgcagttcctgtcatcttggtgttctgtttctctctgccataagcccattatccgtctggtgatttcggcattggatggagaccttagcagtattggattatgtccgcatagcatcgttcgctatcttgctggtttggatccttgcagagcttgccaggctgaacaagagacatcgccgagaaggacatggcgacatggtttcatcacaaagaaaaggggaagtcctgctaccagcttatataattgtactttgcaatgcttcaatctccttgatgcatatttgtttttctgttcttgtgttctggaagcgccaaactgtctccctggatttgatcttcaaatcagtctcatggcttctagtgactctcttcttgctctactgcaaacatgaaggtgcaggagttgtatccaactggccttcagttcttctctcgtggtggttcttcagcttcttatccgaatcacttctcacttcgttgcatttgcttcacctcttcaactctgcaactgttgtcgatttcacttctcttcccttgtgcacattcatctgcctcgtggcagtaactatgagaccttccaaagcaaaccagcaagaccagaaccaaccgctgcttgtgagagaagacagtgatgacagtagcacagacaggttctccaactccgggtggtggagctgcctcacattccagtggttaaacccaatctttgagaagggacacaaggtgcgtcttgagctcgaccatatcccatctgttccacagtctgacacggcaaaccaatcttatgcattgcttcaagagacacttcacaagcagaaacctgagccaatgcctatgcggagagccattatttgtgctgtctggacacctttgatcgccaatggagtctttgcaggttagtgagccattggaagaacaaaagtggagctaccctttgacctttatattatactaacatgatgctttgcatttattaccagggcttaacactattgcttcctatatggggccattcttgatcacctacttagtgga

SEQ ID NO: 40307 - DNA, 1508 bp, Oryza sativa
atggtattttggtgccagcaggattggtttccgggtgggtgcagcactgatggtatccatttatcagaaatccctggtgatgaagaactcaagcacagccagggggaaaattgtgaaattcatagatgtagatgttgagaaggttagggaatttttgtggtaagtacatagaatttggtgctacccttgcaaatatccttggcacttgccattttctaccgtagccttggtgcaatggcctcgctgtctgcagtccttgcaacagttttggttatggtgagcaacacaccacttgcaaagtcacaggagaacctcaacatgaagatcatggaagcgaaggactcacggataaaggctatggctgaagcaatgaagagtatgaggatattgaagctgcatgcatgggagacagcttactttgacaagctactgaatctaagggatgtggagaggggatggctcaggaaatatctctacacatgttcagcaattgccttcctgttttgggcctcaccgaccttggtgtcggttgtcacatttggtgtatgtattcttgtggagatgccattatcagctggaacagtcttatccgccgttgccacgttcagaatcctccaagatccaatctacaacctcccagagctcgtttcaatggtcacacaaaccaaggtgtccctagatagaattgaagagttcatcaaagaagaacaccaggggaagccaagtcgttctgacaataacactaggactaaggacctgtctatgactggtgcaatggaaattgaaccaggggtatatggttgggaaattgacaatagcttgaagaagacaaaattcatgcttaagattgacagaaagctgagcatcagcaagggtcaaaaggttgcagtgtgcgggccagttggttctggtaaatcaagcctcctttacagcatcatgggggagatcccaaggattaatggtgcagaaacaacagtttttgggtcaagggcatatgttgcgcagagtgcatggattcagactgggacaattcaagacaatgtgctctttgggaaggatatggacagaagcttctatgaggaggtgctgcatggttgtgctttggatagagatttggagttatgggccaatggtgatatgactatggtaggggagaggggcatgaacctgagtggaggccagaagcagaggattcagcttgccagagcattgtatagtgattctgatgtttacctcttagatgatcccttcagtgccgtggatgcacacaccggagcacatctcttcaaggtacagtacatgagaaatctgcaacagtttagctgtaatgagcttcaaatgaaatgtacaataatgttacagcacaaaggcacaaagcaagaaccataatcaaaacaggaaaacacaaaagtattccacccattagacaatctgcaaattatctataagcaatcaagtaccaaatctaattagtaaccgcaaatggcttactcactgaatcgtgagat

SEQ ID NO: 40308 - DNA, 14177 bp, Oryza sativa
  unsure (1)..(14177): unsure at all n locations
caacgtccgtctgcgaaaataatcttcgcaggcggacggccgccccgcctgcgaagacccttttcgaccgcttgcgataatgcttttcctagtagtggaacacattattcggatacaccaaaaaataatttgagtatatatatatatatatatatatacgggtttatgattattgaggcataggtggaattgtatgttgtgttttctttctgaaactttaattttatacattatgatggagagcgagaatggctatagattctgttgaagcaaatgtcggggtttatccattatctaaagagaaaatgaagagatcgaggggatgccatgttaatattcacatggatattttcattattgacatggatatcttaaatatattttttatctaagtattagaacgttgagtgataagcaataacttttggactaagcgacaatcttcttcagactgtctatccatttgtcaggtgatttctaaccaaaaatcacccaaattttttctactcctagatttacatccaacggactacaaaagaatataacaaatacatatttacttaacatttttttatcaaaattacggtgcacttacatgtcttatcaactgaatttacaaatgtaattttagttatataggactgtaattttatattttaaagaaaattacaaatatatatttacttacacattattttttttcaaaattacagggcacttacatgtcatatcaactgatttacaaatataattttaattttagttatataggactgtaattttatattttaaagaaaataacaatatatatttacttacacattatttttatcaaaattacagtgcacttacatgccatatcaactgaatttacaaatgtaattttagttatatatgactgtaattttatattttaaagaaaacaacaaatatatatttacttacacattatttttatcaaaattacaaggcatttacatgatatatcaactgaatttacaaatgtaattttagttatataggattgtaactttgtatttcacggtgacgacgacgacgagagtggccgtactgccggcggccagctcaatcagaggccaccttggcaccgtgcttctccatcatcacgcgcgcacgcggtagctaggtaacacaggccgacgtgcctgccggccggcgagctgcatggaacgtcgaccttgcaaattgccgctcgcatcgcaagctgcatggaggccaaaaaaaagtgtcaaatgccagcaaaaaaatcacacgggagatggatagcaaaatcaaaaaaacaatcttcttttcagataggaagacacgtctgtcatgggcatttaatgggccaggtaaagacctattgaacgggccctgatgtaaatcaccactgcgtggccaggcccaaccccaatttggaaacctgactagttatgggataagttcatctgaggtcccttaactttacaccgaatccgattttcgtccctcgatcagaaaaccagacacagcgggtccctcaattattaaaaccggtgcagattaggtccctcggctgttttgagagcggttttggctgacgtgacacctatgtggctaatttgactcggtctttgtccgacgtggcgcttacgtggcaattcgacccgtgggacccacatgtcagtctcacatagaaaataataaaaaatcgtgggacccacgtgggtcccacatgtcagtccaactcacccctcttcttcctcctctctccccatctccctctcttcatctccctatctctgctctctccaggcgccacggaagacaacggcgcgtggcggcgcgcggccggcggcaggagaggagggagcaacgcgcaaagaccggcgaggtgggcagggagggaggacgcaaggaggccggcgatggccaagcgccgtgggcgggggcttgatggcgacggacagagggagaggtgcgcagccgacggcggccagcgggagagggagcggcgaccgccctccgccgcaacctacctccaccaccaagctcgtcagcgactgcccaccggagtgagcaggacgacagccggcgacgggtgaagaggatgaaggcggcggtatggagcagaggtcggaggagggcccccagccgctaggatggcgctcgatccgtcgcgtttcaccaccaccgagctcgtcagctgcagcccaccggagcgaggagcgaggagcttccgcttccccttcctcccattgacgccgcagccgcagcaactgaggcgccgctccccatgccgccgcttctgtggctgttaacagtaaaatttggtaagcccggagtagtcattggcttagagtcaatatcggtttggaagtcctgagattagccgatgagagttgtcaagtcgtcagttgtcggattcttgctatattcggttaaggaaattgatctactaaaggaagcttattcagaagagaccaagttcaaagagaatgcggcatagcaagttatctattaattaggaatagtttgttagtttccttttatctctaggaaagtgtgtttagtgtcctataaggactttatcattttcttttatctttaggaaagtttctttcttgtccgacaaggacttgtatcaacccatgggtataaatatgtacacccggggtctatgtaatctatctccacgatcaatacaattcggtgcatcgccaccttttaccttttctactttattttatcatccggcgggacttggcacttgacgcggggctgcatcggtgttcgatctccggctaaggggtaagtccaatgttccgccggcccagggaattgtatcgtttacgtcggcgtcgttcaaggctgcatcagtacattcgacctcttggattgctctggtttggatgatatatttgcctacctatttatcatatgtatctgttaatctagtcttagcatatcaatttagctctatcggctacttctcgttttagggtttctgccggtatcggctaaatcgtgttgctagattagattagcttagacatctaccaccctgaaaactcagtcaatggcttgattgtctagatattatgtttcttttcatacttagtgctgcatcagttaagtttgtctactaagtcgtgcttagaaccataatctctagcctgcttcttgattgccaataagggtatcatcggggtttcagccagtgagttatctggacgttgcatcggctcataaggattgcatatacatataagttggatttagccgatgacaataaaggtttcactatttaatctaatcttgtggatttcatgacatcggacctccagccaatgtgtgctttaaacctcggatcgatgcttatttatcatatcattgctagccgattggtttctaccggattatattgcaatattatactatcatcagccgattgcttttatatcatcatctacattggacatatagccgatttatcaaaatcctatcgctatcggctggtattggcatcggctattatcgatatcggctgagattgctccatcggcttgtcagccaatcgactgttttgatctactatttgcatatcttgtcagtttcaggatcaaactgactggcacgcccgcatctcatcaatctttggacctgcacaggagctaagcagatctcccaggccagtatgttcgattttttcgtcaacagtggcgcacgccggatgcggacggggacgccatggccgtggccgcggacgacgtcgacgtcgacctcggcatcctcggcaactcccaggggccccgcgccgccaccactaccgggaggaatagcgcacggcggacgtcctcctcctccggctgccaccgccacgcctccccgcatggctgcatctcctcctcctccttcggcggccatcgctgcacgccgccccttctccccgccggccaccgcccttctcccggccgccactgccggatctcgattgccggcgctgctctggggggagctgtgttaacaaccaaatttggtaatatcagcatcggaaaggaagatcagatcgaagcggaatcgaagatgaggattatcgctgaaacagagtaagaattggctggagtccagatcggctatgattggatcggctgagcccgagtcagacttggttaagtgatgtagccgattccgacaatatgacctaatgtacaacgtcgggttgaattgatatgcttcaagatgattgccacgcatggatagagtcctgataaggcaattgtatctattaattaggatattttgtgtaatttccatagagatatgtttggacaaaagtctgccgcaaagatttatggtatcttagagtttgttagagataagagtcgtgtctgatatggacatagtttgtaattttcgggtataaatagaccccgaaccccatgtaatcaattaacacacacgttcaatacactttcggtgcatcgccaccctttttgctttagtttatttcgacgagttcttactttcgggttgagctgcatcggtttcgatcttcaacaagaggtaaaacttgttatgacggcttgcgttctcgggattggtgcttccatctttatgatactctaatattgtttatgtaattcgtcgagttatcatatattttacataatctctggcaatatcgcaatttaacctattatcggctaaacatctgtcggtagaaggcagccgattaggttaaatatcgatgttgactttgattatataggatatctaccactctatgaaacctccagtgacttgattgtctagatattgttcttcttttcatacttaatgctgcatcagttgagtttgatctattaagtcgtgcttagaatatcaatctctagcctgccttctggttgccgattagggtagtatcggggttgcagtcgatcttatcttatttaactatatttactctatatgcttcattgatatgttaaatctgccctttatattaagatcttgttgcatttaagtatattagacttttgtttgatatatcctacttgtcttaatatcttagtataaaatggtatcggagtattagccgatacatgctaaatctgtttgatcggctatgctatgaacatatataatcctattattaatatatatttcgatctaagtgatttatactgtctcggcatagcgaccgatctatctcaatcacttgatttaagtatatatcgatataaggattatatattgttaatatctacaaccgatcgaatagatttagttccttcatatttaataatgactgccgatcgatgtatatatgacatcggctcaaagataaatgatatgtcatcggcacttagccgatcggctatcgtttatggatttaaccacggtttctttgtttttgtttcttgttgattgcaggatcaaatcaactggcacgctagcataacccgcagcgagttttggacctgcactggagttaagcagatctcccaggcctcgtgttttacatcaacaacctgccgccgcccgggtcgatctgttccgcccaccgccatcgccgattcccttttatcgccccagcttcctcctccagctcggtgctctcgctggtgggcgtcggtctcgccgccccctctagctcgccgctctcgccggaagaggagaggagaggggagagtgatgaagagagggagatggggagagaggatgaagaagaggaagggtgagtttgactgacatgtggggcccacgatttttttattattttctatgtgagactaacatgtgggtcccatggattttattatttttccggatcgaattgccacataagcgccacgtcaatgccacgtcggacgaagaccgagtcaaattagccatgtaggcgtcatgtcagccaaaaccgccatcaaaaccgccgagagacctaatctgcactggttttgatagttgagggacccgttgtgtcttattttccgattgagggatgaaaatcggatttggtgtaaagttaagggacctcagatgaacttattccactagttattagtgtactttttcctattaggaaaggcctgttacaagcctaaatttaaccctcctctcaaaacaagaaaggtcaaagctttaggttgatcgtccttaaattcttctgtaggacgtttttttttctttttaaaaaaatcagtattaattctgaccgttgatttcttgtgagttgtattcttagtttcaacttaacagccaccaacatcatttagacggaattgctacatcacatttaacaaaaaaaagtggaggccggctagctataatcttgtagttttcttacattagggaatgcttcacgattcgtgcgagagctcattctcctctagcttcagtgcatccaatgaactacagcaaccgacagcgactcaacaattaaggttcagtgttcaaggtagggtcaagggtggacgctcacaatttcttctttaaaaaaatatttggactttggagggatgtcttttcctccaaatctctttttttttaatattagtcaatcccttatttgaaatcactttgaaatatagatccgtatatataaattcaaattaaccaactggaaaaggttcaaccattaagcaaagtctggttagaacgcgctaatactctctttagttataaatatttgacgcatagggaaagattttgtcaaccttttaaactttgatgcgagcatctccaacagattatccaaatcggactctccaaacacccatatagccaactctccatctaatttggctagtcaaactagttacttactccaacagactctccattatgtatctatgacagcgggacccatatgtcagcctcaaataccccttcttcttcctcctcttttctccccttttccccgagccctccctcaccgacccctctaccacgtcgtctccaatctcactagtgtcgccgctccattcatgctgccgccgctcatcccttcttctctctctccggtgctcgagagcagacggcgagtgggaggccttcgcggcggtcgaaatcggcactaggcgctggcggcagcgagcgggaggctgcagcgatgctcgccgtcatgctacctgctgccgcggccgcgggcggatcttgtgctaattgtctcgccaccgcccaagtctccaccactgcgcagccgactaggcgggaaggcgagaagcgaggcgagatgggtggagcagatgacggggaggaggaaagggtggggcgacggaggcctggggcggagatgttgacggcaatggcgaggctgggtgacgactgtgctgccgcgtcggatggggagatggcggcggtggctgctcgaggcgaggggatttgcgcgacgcttgacgcttctactcgcgggcgatgtgatggtggcgacgccgtgacgatggggagaggtggatgggaggtggtggtggcggcgaggtagctgctcggaactcaggaggcgttgtcactggcatttctcagggcagtgttgcttgatgatgtctttggccagccaaaccagctggctagatttggctagcccacctgatcatttggccagcgagatggcttagccatccaaatggagagtttgttgcacctcattttcttgctatgtttgctattttttaacttggagagtgggatggctgaccggttggagatgctcttagatgcctaaaatctttttaaagaaatgttgagatttggcttggaaagttatataataaatttattggaatttacaaatttattctaatataaaattaaagatcaatgtttcacaagtttaataaaactttatcctaaacattaaatatctatgaccaaagagcatatatactccctttaaatgaactaaacaacatcatacacaaattaaatgtaaagagggagcagtatttttcatggatgcatatgagcatatccaaaacggtcgttgtatatatccggcccttatttaggatagaacatgtgtgctaggtagcacacggtaatcgaattttaatttgtcgttctcataacgtcagctggtagcagcaatactcgttcgtccgttcttggttgtacaaaactaattgcgctactccctccgttttgtaataggtaacaacgttaatgttttatcatatatttaacgatcgtcttattaaaaacattatctaattataatttattttttaagttattttgtccttaaaagtattatgagcatgattgatatcttatacattcacataaaaattttaaataagacgaatgataaaatatatgtttaaaagtcaacaacgttatctattaaaaaatgaagggagtaaactttgccttgtacaagggaccaagaaagagacgacgccgttgacacgctagctagctcactgcattaatcacacacacaaaacaacaaatcaaatgggactaggaggagaccaaaccaatcagtaacatggctatatatatagagagagagagagacacacacacacccatcctgatccagctcgatctaaccgatcgattcatcatcaacaattcacaagaactccatcacttacagtgcaaatcaagctgatttcatcagacaaatttcactaataactagcttagctgccgtagagccgtgtgcgatcaagatcgtatcatccatggcgttctacaagtacggcttcgccttcttggccggcaccggcttcggcgccgcgctcaccagcctccgccgcgacggcgacagctgctgccccatgcgccgccgccgccgccgctgtcgccgccaccaccacgacgacgacgaccagctggtcgacggcgacggcgacggcgaggctgcaggggaagagcgagacatgaaggagagcaagagggcgacgacgacgacgaatccgaaggccaagaaaggcagcaacaaggagaagaaggcagctgctagtgttgctagggaggaggaggatgacgatgatgaataggattaatttgagttgattattaattaagttcagtttgagttcagctattatatatttttaggtgcttgattccgttgctgtgccagtttaattgtgcttgtttagctctgtactcgttatcctgttgtgtgtattgacaaaaataagagaatatacatatatacctctctgttgttaaaaaataagtacctttgtttgacggtttttattttttgcgttgtgaacgggagtcgtcagccatctcgatcttgaggaactcacaactaagataataataaaactagctagtagaataaatttaggctaactcgggataaactcccattttgtgaccggaatggaaaattttctggataaatctacaaacgaattacgcttagcaaaacgataaagattgaacaaactaaggcaagatagagatatataatatgaaaagatgacacaattagctaattgtgtgttggattgttggttgttgtcaataaaacctaccatatttgttataaagatatcggtcttataatatgagagtttctccatgtctgttatagagatcaattaatacttgataaatctcaacacaagcaacaaaatatgagaaatatctcaactaggctcggaatcagagtttactggtcaaactggccatcatggcctggttggactgctagatttcagttagaccggcccatataatggttagatcggcctcttctatataggtattgggctttttaaatataatttggtcttgctataactgcccaactacaaaatttggttgtcaacatacaattccttttcttctttttttttttacaaatcaggaattaaaaagcacctacacatcggtattaagggcaataaaccattatcaaccataaaaaaacccttgtgagcatctcaaaaaaccggatatcttactgtagaaaaataattaaccgtaaataagaagactcggatcgtactaaacaggtaaaaaaactaattaactgagctaagcccacctcactatatttcaacacaattaattaactgcgcaagtctcctagattgctagcgagagaggcacaagaaaaataaaaaggccacaatttaatcgaccagacaaggacaagccttgctcggtgggtggttgggggtattacaaaaggtataaattcctgaagttcagctgttgtagtctgacccttggagaagaagttgatcatgaatcttttatccaccaaaaccgtgtgatagtggccaccccttgcaacgtcagatcatttcaactattatactactagtagttagcaatatcaattactacctccgtttcaacgttggacctattcgtgttatttgaaaaattagtgtaaatatgaaaaagaataagtcatgcttaaagcacttttgataataaagcaattcacaaacaaaataaataataattttatattttttaaaaaataagacgaatgattaaaagttaccaatctatacctaattaaaaaataagtaaggcttccggttaatctttttgtccgtcattaagagtgggcccacacgataattcgtcgctaatccacgatccgaaagcgtggccacgatctcttacgcctgcaaataaaggagaaaagaaaaataaaaagagaaaaccttgtttgtggagcagcccatccaaagcagcctggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaataaaatgaattatttaccgacaaaataaattcttttttaaaaataaaaataatcacatgtgtctttctttttttttagaaagagtaatcaccaacaaattgaatcatgtttacatttggatttttttcgctcatcaattgcttattcgccacaggacacctaatcacatcactttttttttcattcattgtataatttcttctattatttagagtgaaagttattctgcgatataccacatttttttctttccttctgattatttaagtgagtggttatgcaattggagtgcagtgaggttgatctgatagctagcaaaaaatatttcttatattatggctactctttacaatatgaaaaaaaagtgcttatcaatatcgagtaccaaaaaaaaaacaaagtactgcaattgactcataataatacatgacaaaaaagtaaatattttttgtggtttcaaagtttagtatccatgtcagtggatttagagcaacaaataattatatcatgttagcgtcttatttgcactacaaagattcgattcgactataaagacctcaatgaacctggtggttttatgctcccacacactaattactattttttcttcccccaatgcaacgcatgggcattttgctagtaaagactcaaagcgataagtattttaagatggaggtagtattcaactcttgcatagaacatggccatcaataggttattaatctgttgtatactctgcactattattcctagatctttacatttccttagctttgctcccttcaattcctttcttgaacccttgtccaagaaacacatattcatccgattgatggacacactgatgctagcttcttcaatccagctaattaattacacacacataacacatataaatagcagcacagatacacgaattgttctcatccattaacaccacttctcatctgcagttcagacacacacacacacactgacacaaacatatatacttacatataaatacagatatatatatataggtggttagctacctgtatagtttatacattagctagtgtatgtgttgttgttgatcatcgatcgccggcgacgacagggagagatcgatccacgatgggttgcctgctgcggcggctgttcccgttcctggtcggcacggcggtgggcgtgtacgcggcgcagaattacaaggtccccaacctccggggcctcgccgaccgcggcgtcgacgccgccaagcactacgaggaggcctaccgcaagaagccctccgccggcggcggcggcggcgggagcaggaagaagatgaacaagaccgtcgagatcgacgacgacgaggagtaaattagttgatactgctagtgctagctcactagttattacattttctatgaaaacgagcagctagtgtgtatgatatgtaaattattggaatgttcttatgtgtacacgtaaaacttatacgtaaaccttatttgtactgtttctaaattaaaaaattaaaaagaacggatatattaataaaaataaaggacgaaaaattgatcaaatggcgaagtagtggccactttcactattgcaatcagccgaacgtgtaggtgaatcgaccattttgactcccatagaatcagattcgtaatctactactggagaaactatcgacgtttgatgtcgcgattccggtatttgtatagtatggggatcgttggtactaggatatatgtgagacttaggtaaaagagacggagaacacaccagcctatctaactgttgtcgacttggcggtctgtagtactgactcgtagtcgacaacagggtagccttcctcctcgaatccgcatccggcgagatcagagacagcgctatatctctcctgacagtatccgtaggcaccgtaggggactagccatgcctatctctgaaatcgatatccgacgtcttgtcttggcgtatgttggcttgtatgttgatcttgtgtcttgatctattgttccgtgtatgttgattgtgtcctctctcctcctaaggggcctaatatttatgggtaatttggaaccatgccattataacttttgtaaagtttgagatatgccatcggtatctcaatgacatgcaggacccacatgagtcaatgacatgtgggtcaggatggcatatttcaaattnngcaaaatnanaanggcanggttccaaatttccctatatttatacccataggtgttcccttgtccaagtagaactagggaaaccaatatggatacaatccgagtagtccttgtcgtttccatgtagaactctaatcatccttccttatgcggaactcctcctatatccgaaggttgtttcggatacaatgcacagcctcctgtaccgataggagcaagccggccaagcataatgttctcagtgacacctctcaggtagtcagattcagcatatacagcagcatcaagcaagatatccaccgtctcttcaaaggaacatctcataagaggccctgtgtcattacggttgataccatgccttgtaatagccatcagatgccctctgtatgtcattgtatcacaaagaatggccagatgtctgtaattgacataagaaccatcgaaagatatgaccacccgcagctcatccaagagagctcgacgaacagcctcgattccaagaacctcaattacttcgatcaaatggttacttgttgtcctagtagcatcaacatcttcatggcacatgacagccaagagattaacaccttccgtatcaagcatccactcattatctgctttgaagccaacattgtcctcaaatttattgaccttcccatatttgataaaaactttgttaatatctggaattccacgaagtgccatctctgtcaatatcctcagcagactcatgttactttcaatcttcttgaggaagacatcatcctcagcagactcatcttgtatttctccctttggagcttcatcatttgtgatgcggacacgaaggatcagtttatctgcattatcatcattaaatatgcatgacaagtcatcatcaaattcatgattgatcttctctgcaatatcagccatgctcaacttcttatcaaccatcatctcacgattcagctcgatacgcagcagccacggtgaaattttatctgggtcaatatcctcatcaggcatttcataataggaccggacaaattcaacatcttcttcaataatggttcccagtggatcaggatcataccatatctctgtagcatgtgtcacactgcgcagagtaggggctgcaggaattc

SEQ ID NO: 40309 - DNA, 895 bp, Oryza sativa
attcctgcagccctgaaaactttcagctcgagatttaaaaaattttaagttaagatttgaaaatttttaagttaattttaaaaactttctacaaagacatttgaaaaacacgtgttgttggaagattaaaaaagtaataaaatgtgaaaaaaaatcacggaaaaaagaaagcgaaacttttttctaaaaataatcgaaaaaaggaaaggaaaaaatcaccaaaaaaaagaaaagcgaaaaaaataagtaacgctgtcggcgcgcgcgccggcgggcccgcgaattagctctaccgcacaagtataccctataaatgaacgcacacacgggtattcggtattccatataaaaaaaactagtttgtcatattttaagatgacacctcgtcgcctaagactgattcaaacacctatgcctaatctagaacttaaacacgaatggagcacaaagaaaaactaacatcttgtgtcatactctgaatctgatgcattcagattcatcaattataacatcagtaaaacattcctttaaatgattttggaagttctatcttgcatgatgtgggctgccatttctacaaaaattggccgttattgggccccaatccacagcagaggtgtaaaaacaatccaacaaattggacccagtaactatttcgatggaaccattatcacagcaggatacattagacacactgagctaacgttacaaggatgaaacagaaactcaaaattgatgtactacagcagttgcagccttgcaggctaatcaggcaccaagagatttttgcttcttcgctgtgttcatgtatggccgtagcacaaactcgttttgcgcctccgcttggtcgacagttcctcgcttgatctgcaagatcaaatgagcaaagaattaa

SEQ ID NO: 40310 - DNA, 7124 bp, Oryza sativa
ttagaagcaccaagaaacagaagtaaaagaaatttttggaaataaacagcaagtaaagttggaggatctcagtccagagttttgaatggatttaagcgtctttcatagaagaaacaagtctcaggttaacgagaaagacatcacagaagcctccatacaacttaagaaacactaagaaactgaagtaaaggaaattttggaaagaaacgggtaagtaaagttggaggatctcagtctagagttttgaatggatttaagcgtctttcatagaagaaacaagtctcaggttaacgagaaagacatcattgtaacctccaactttgcaacacaggtatttacatgccgggatgcaagtcacaaaaaagtatacaaacaagattattaggaagtaggaacacatggtacacccctcaccacgctacaatatcagcaagatattaaagctgctcagataagttttggaatggatagatatagtcctcatggtagatctcaggttaacgagaaaaccatcattgcagccaccaaaaataataagcaaatcgtagtgtaaaaagatgttcacttctatgcattataattgaatagaaacaattgtgagaaagacaatgagcataggatactccaaagggaacaaaacaataaatatgctcaacaacagcagaagaatcaatagaactggaggtgctcagcactttcaggtaaaaatgaactttgtatcatcacttctagcaatattgcttaacaagaagccattattgccagtactcttgaattcctgagaatatgtatgtgtgtatgcatgtgtgatgactgacaggttgccttccagatagatagatagatagatagacagacagacaggcaggaaggcagccaggcaggcaggcagagagagagagagagagagagagagagagagagagagagagagagagagagagagagagaggagaccatttggcaagagtacccggattagaaagaatcatcacagcaccctccagttcccgcgtgttttaacacatgaacatgtcaatgaacttacgaaaacatcgaaaagagcatcatagtaggcttgaagcctcccactttttgaagaaaaagataaatgtaagcgctcactattgtgttcatcatgacacttcaatcttgtataccttggtttgaaaaatcatgaatccttttcaaacaaaaaaaacaactttcaaaacacataagattatctacttgccatgcaacttaaatatattgtcttaaaacatcagataaaacccgtttgttgcttacacgaaatgaacgctttagaacaaaacaactcaaagcaaagtatttcagtaccttggttgtgaagttatctagtattaaatgggggtacgcttctgacattttacccatggccttcctatctttaatatcgtggcgtgtacctgttcaacaattatatccagggttaccaaaagtattgcctcgcaacccaaatcgtacatgacgaagactcagcatacattgataataacacagatatgcactacttaccacattgagcaacccaaaatatgcagttggcccaaatggaagatggcagacgattaaaccatcgggctggccacgatgttcatgcaccaaaacaaggtcggtgatatcatgcgaacggcaagactcaacaatttccgatatcacctgccgaaaagaaactatagatcagtaagatgcacctgaaccaagttcacaaaagcttgaaccgcatttcccaactattcactcctagcaacccaaatctgaattctattcaagcacgcgcgacaaaaagagacaacaacatggagtattgccgaattatacctgaccaccacggttcattctttgcgagttagggaagacgactttgagctcctatcaaatggacagaaacggctggtttagcttcatcatccaaatgcacccattttcaacttatcgagaacccaaaaaaaaaaaagagaagtccacgaatcaaaagccgcaccttgacaaactgagtgaggggcgcgctgggattgcgagaggtggtgagtaggatcttgggctcgcggagcgccgcgcccgcgtactcgtcatcgatgaggctcctcggaactgcatcacaacatcacagggccaaatctaaggcgacggggagcgggagaggaaggggaggagggaaggggagggagctggaccagcggagtccttgtcctcgaggtcgatctcgcggcggagggcgagctcctcgttgcggagctcggtggggatgggcttcccctcgtcgagcgcctcccggaggcgccgcttcttctcgtagtgctgccgctccttcccctcgaggctcttgcggtacaggtactcccgccggagccgcgtgttccgccgcagcatctcgccgccgccgccgccgcgtgcaaaaccctagtgaagtggtcggagcggcggcgataaaccctagcggcttcaccggcggcgacgccggacaagggcacgtttatgtagacgcctagagggggggaatgcgtgggtgtgggccttgatgggcttggcccattaggcccatcatggtatatgggccgagcccataatgtcccgcttcttcttttttttttttaagacaatgtgtcaatgtcttgttttttttgttgtccaccccataatatatatagcaacatagttacgcaaatgaaacatatcataatactggagtaaatctatacatgatgtgtctcattccatactagattgctatattatgagacgaggaagtagtatgattttcgtacgagcgaaaattgttcaacaaaaagaaaatcttttgaaacactaagtctatgttttatactatattttcccaatttttacttccttattttcttcgcgacgtttctcggatggttaaacggttcgttttttcaaaaaaaaagaaattatataagaaagctagtttatttttaaaatttttatatctaatatttatttaatcacgtgttccgctccttattttaagtacctgcccaaggaaaggattcctagcccaccacctattgtaagtgcgggagtacaagtgaattgtacttcttttatatagttgaaaaaaaatgttcaatgaagagttggaattctcaaaaagtgtttcgtttgagattcgttctaccaaacggaatcgcaaattgcagcgaatggaatggaagatcaattttatttgaatttgagcaaagccatcgtcaatcagtgagaggcacacacgttgtttctcccacctgcactttaatctatttatttactgacgggtggggccaccctcgcacgcccattaaagcgccacgtcacgcctcgccccagctcagcctaaataccatccatacccctcacccccttgcgctcacacccacccaaaccgagggcattatcgtcattttaccgcagggtcccaacgaacaccaactcattcattcactcgacgaaatttctcccatttttaataaaagcttccatccatccatcgcggttgcatccacgagctcgcgagcggagattttcccccacgatttttgctgttcatccgtgtgggggaggagagattccgcgtcgattggtggtcggatcggagcgaggagaagcccccgtgttcttggctttttttcccccgatcgaatccggtggaaagcgagcaataaaaaccacttcttttctttttcgtttctggttttctttttcttgttgggtttctcttcctcctgctcgagtttgatctcttgattcgtgaggagtgtggccagatgagcgcgagtttcctcgagatccagccttcggagctctcattcccctgtaagtttttggcccagatctcgcctccttcccctccccctgctcgaattgatcgatgtgagtcgttgatggatcttggtcaaagctttggatcttgggggtggaagagaggctgtttgctctctgtttgatccgtgtcagcttgagattcgtcgagtgctgtggtcgattcggccattggatcgtggaagagagaaagagagagagagagagagagagtgtgtgtgtgtgtgtgtgtgattcttgtggtggttgctcttgctgctactgcatgtgtgtctgccttgtttgttttgctgggatttgtgtgagctaggtctcgtgtggttggttgatgaatcgatacggggactaaatttggtgatggcctgcttcgcatttgcgtagaatcatcgtttggtagctgtctgtacttccaggagttttgggatcttgtcagctagtatgtgccttttgaccatgctgatctgctcctgatttgtcgggaagctcgaatgcaatgtccatgcaattcttcatggttattgggatttgattcgatggcagttataagtcttagattgatatagcatgcttagtatgttgatttttttttcatttttttacttaagtttgttgcttcttttttcattttgtcctaaaatgatagagtatgtctttgtagcgaatgtccggtgggttctattgtgttttttttttttttttgcttcagatattctcttgaaactaatttactgtttcgtatatgcagttgaactactgaagcagagctcatgctccatgcaactcaccaataagaccgaccattatgttgcatttaaggtaatctacttgagatgtcacctctcacacgtttctagttgtcaccattcatttctgaatgatttaaatctgttacctcatccatggctggcaggtcaaaacaaccaacccaaagcaatactgtgtgcgccctaatattggcgtcgtattgccggggtctacatgtgatgttacaggtagctgccactccattacatagtgaaactataggataataccagtacaagtctgtttaagatagatagctcagatatctatttagaagtctgcttaacatttggttttattagtgacgatgcaagcacagagggaggcacctccggatatgcagtgcaaggataagttccttgttcaaagtgttgcagctgagaatggtgcaacaactcaagatattagtgcagaaatggtaactactttgcagctcttcattttgtgttgtttcaatcaatttgctatatgcatctgttacaacatctcatcccttatgtttttattatgataacagttcaataaggtggcaggaaaggttgttgaggaattcaagctacgtgtagtctatgtgccaacgactacatcctccgcaatgcctgaagactctgaacaaggaagttctgctcggccatttgcacaagaaaatggtatccataattcaacaatgccacaacctgtaagtcgatcatgtttcctcatttctttattttgtgctcttgtttgtaatcagacttcggaggatctattttttaattatttgtaccgatgtgcaacatttaggtttttagatcatctgctgaaccaacaaaggagaggcccacagaggtagtctttttatcttacttttgtagttagatatttaattgaagaatcagtattattatagaaaagtattgcaactttctagatgaactaagtgtcaaataataatgttggaattatgtgatgtgcccttgttcttttcgactttacttattgtgctcaagtaactaataatgcacagcttatgataacaaagttaagtaaaactggagataattgcagagcataagcccaggcatcctggatctgagtatatgctgtagttgaattgcaagtgatcatgaatcctgactgccgcgcagcatgacattttagtgtttagtatgctttcatgagaccaaaattatagcttttgtttgctttcccagcatgcccctctttaaaattgaattgatgagcacaattacaacatatatgtggagatgcgacatgtacttataagtaattcatggatggcatgtcaccacatatatgtttattatctcactgaattgatttatgcaaaatatctgattacttgctaatatctaatctgaaagctagaatcaacttagctttaaattcagtactacacaagtcaatattttcttttggaaaaccggggcgccttggttgtttatgattcatatgaacttgtctatttgctgcaagcttttccttgctttagccatgaatgacagagtgcatccaatgagtgatgagcttggcacacaggaaaatataggtcatgatagtaatcaggcattttacgtaccgtatgagataattcagtgataatagaaaagccaaaatacaggaacaggagctacatttagttgttagcatgtctttatattccaaaatgcttttaagatttcttttgataaatcacttgttgatgatttatattcttatcagccatcgtccatgatctccaaactaaatgaggagaatagggttgctattcagcaaaaccagaagttacgacatgagctggtaagtacttcaaccattatgaaacagcactagtcgtaccatcattcaaaggaaataaataattgcgatcacaagaactgatggttgacattgctaaaaggcatatcaagaagttgctgctttcttcgtacaactggacttctactttttttttttatggactgtgaatttcaaatttgtgacccattggccattgtttttttgttctgcttaattcaattaaaccaatcatatcaactgtcatgtgatgactagaatctggtgactaagttctcactgacaaatccagatttgtcgatttggagacaaaacaaacatgcgcaatacaaatccggctgctaaattctgcacttgctcaatgctgcattttatctatagcttgcacacgcctgtgaatttaatggattctacgaactgaacattgtgttgatgaaatctctatttatctttcaatcaggagctcctacggaaagaaagcagcaaaagcagtggcggtttctccctcaccttcttggccatcgttggtcttctcggcatcatcgtgggctacatcctcaagaagacatagaagaggtagaggttcccaacaaaagttatactcccaggaaaggatacccctcatattggtatgccgcgcatcgtgtttttttccctcctaaaaggagcacctgtcctaa

SEQ ID NO: 40311 - DNA, 2948 bp, Oryza sativa
tttaagagttttaactggtgcaactgtttgacattctccataatcttttattctttctttctgatcaatttatcatcatactgttaaactttaaatttctcttccagtcacattggcaggcagtgcttgatctcatatattattagcttgtcagatctttaaacatgaactctatgcaattgcaatgatgcaaatctagcattcatctcatatcagatcatatcataccacaagtgttgaacatgtcagggtaaaacctgagagaagttaagagaagataaataatgtacaagcattacttgtgtgctgctaccgttggatcgtcagaaaatcttcaggttggaacgaagcaaagttcaggcgacccgccgccgccgccgcgcttcaggaacagcatcgccgccgccgccacgaccacgccgacgacgaaccctagcagcagactcagcacgtgccagtgccacacagccggagacgtcgtagccgccgccgccgccgcaggcctctccccctccgacgccgtggctatcaccgtcgacgtcgacgtcgacgacggcgacggcggcgacgagccactctccttcccgccgctgccaactcctgtcatcttctcctcctccgccgccgccgccgccgacgcattgccgccgccggcggtgacatggtcgccgttgctgccggacatgtcgccgtcgcgattcatctgtgcggcggcggcggctggcggtgactctcttctgtatacgatacggcggcggagagtcgcttctggtctctcttcttgaggcttcgtggggggttgtgggccgtcggatcgggtggggaggcgacgtgggccgtcggatcgccaactaactcccggatttgtaggctgtagcctacgccgcgcctttctgggaaagtggcacacgctttttctttgggagtttgcatgcacgtttgtggggttttttttgatttggtttggagtttggatgaacatgaacacaagttgagtgaaattggagtttttggggatatttcttttttgaaaattcatgggccgggttgcctcgttgggtgtggtctatttcgtaggaaattacaagggaacaatgatgaagaggtttcatactctagttagtttgttcatgccgccaaaagggtagtttccatgctttctcaaaaggacaaaatatagctcggatttactttcttaaaacaaaactatgtagcttcgtttaactatgcagtttcctttctttaaaacaaaacatttataactcacacataacattagtggtaaggatttaaacccttaaatgtatagttgtgtgataattttattattaaatctgtagttttgtgatatttagccttaaacttgtatagtttatgataaatgtattgctaaatttttagttttgtgatacatcatcttaaagaaactttgtagcttggatttcctttctttgatggagggctagtttataactatatgtagtttactttctttaaaaaaaaactatgtagcttggatttcctttctttaaataaagtatggagttattatttttcactgtttaattattttgaataaatttgatttgatggtatctccaactcaacatgtcgaatcggcaacacctattatattcttaacagtattcttcaatatgatttaaccaagtttatttaaaaatttccaaatgcaaattcgatactccctccatcctactagcatataagtatttttagctttgaatcggaacacctatgagcatctccagaagactgagccagtatatcttgatattaacgaagtcaccacatgcacctcaacaccggaacatgcacccaccacagcaactaaaacaactatgagcatctccggaagaccatgccggtatatcttgagattgacgaagtcaccacgagcgcaactcaccacaaggaacctaatcagttgagctatgctcacttcgcacttggtcacaagaacctaaccagttgagctacgctcaatgtgaccctaaccagttgagtgtctttgcccttggtcacattatgactattttttccaaattttttatttataataataagtaatatttaaattaaataattagtaattctctaggaggattaactaaaataggatggacgcgggtagaaacagcgtccagacttggacgctcattcaaacagcgtccagacatggacgctactagaaattgtctggacgctactagaaacaacgtccaccttcctggtgcagtcagaccatcactacgccaccaatacgctaagagaagtatctatctatctattatatactaaaagtccattaaactttctacaaacgctctcaagccgccacgtggcgctcctacaaacgcttctagatcggcacgtggagctttaacatccaaccatcggttttcatttaatctagtggacccattatttttaaccactagatctttattttaagaaaaaacaaatcaatctatctaaaagaatcccacgttactcggccgtgtcccctggacctatatgtccgtatgtccgatgtacgtacatatcccctccatgtccttttctttttccttcttatatacttagattagatgaaaaactaaaaagttcatgttaaccatatgttttaagttgtaaaaatatatgttattttaagttttattctaaatagcgcatctcattgaaacatccataaaaaaatattaataattaacattatagactatatgattgtatatcacaattaaattggacttataattaaaaaagcaatttaaattttgagtagcattttaaaaatttactcacgccctattgtgtaatactgatatatccaaatgacattattaaatttatcaagaatgtattttcatatattctatgtttctgtattcatatattttttttggaaaattaagggctgcaggaat

SEQ ID NO: 40312 - DNA, 6671 bp, Oryza sativa
cctgcagccctgctgtcaggcgtctaacgactttctactaacttaattaatttctcttaacatgcctatgagggctatgtacctatacaaattgaccttgatacttttaaaacgatcttattaggagataaataaatattcataagaaagatgatcatagcatcccaattacacatatgatctatgaagtcactaatcataataggtattcatctagcaatatagacaataggttaaaaataaatgtgtggccagttgaacatcataccaataagcatgtgggttgcacctaggaatcttaacagtgaaacaaccttgaggcggcctttacaattggaaattgagcaaatgttgctagatttaaaacccactgtaaatagaaaaattctgtttgaatgaatatatatatatatatatatatatatatatatatatatatatatatatatatatatatatatatatatataatacaatcaatcaaaaaattgatattattggatttttttggttgtaagatatcctactggggagttaaatatcctgaattttcttataggaaccacctcctttgtttcgacacaatattttctcatcaattcaaaaccacatgttctcaagtaattttattttagaatttaaatgttacaagggtaattataagaaaataatcagcgctcgaatcacacaaaatacatttaactttataatataataaaaaatattttaataaataacaccaacacataaatattcataataaaatttcacatattatataagaaggtgcccgcgcatgtgcgcgggctatctttctagttgaaacaaaagttgttcaacctggctagggtcagggatcaccggtgtcgtcgtattcgtcttcgatcggggggctgtattccgtacgcttcaccttgcaaaccacgtcgccactattactgtccttgtcgacgccggcgccttggattggtccattactcagcgccatcaatccagccacagcgtcttgagcggcaagttcgttggctgctcgctggcgacaggtgaactgtaagacatgcatgtctttcacattgatctacttatgtctttcggtgggaggcaacaggtgcccatgcatacgtttagctaattaccattgatcaactgctgtatacattgtgttcatacgtactttatcaggataatggaattcaacggtctcccaggagtcgagcagatagcagcagcagcctccggggaggacaacaaccttcggcctcccaaattggaagccgccaatggcagcgtcctctggaatcgatgcgggcggtcgtgagggcctcccgggggcaggcgtctgctacagcctcccgatgttgaggcaaacggtggaaggaggcaacggcggcggcggcaacctaccctagcgccgccgtaatttttcttccttttttttctttcgctcggttcgctgcatttgaagtggctacaccggtctagacgtcgtttggattagcgtccatccgcggacgctgtttacaggagcgtcctgatgcggaagctgtttagaatagcgtccttcttattttggtaaatactcacaaggaattactaattatttaatttaaatattattaattattataaataaaaaattcggctatttttttaagctacgctcaatttgcacttggcgacatgaatctaaccagttgatctatatttactgtgactctaaccagaacctaactagttgagtgtctttgcacttggtcacattatgacactttttttttacgtacctcacttcgcgcttggtcatattatgactatttttttttgaatcactgactcaacacgtgtacatgagtctctgactaaaaaaaaatgcctattgtttggagagttgcttataagggtaattgtgcatacgtgtatatgaacgtatgtatgtgttatatgttttttttaaagaaacaatatgtcacatgtcatcttgcattatacgaaaagaaaaacatcatgtcaaatgtgaagaagacactgtcaaaggagacaaatagacgatggatgaactgggacacaacaatgattttgtaggttaatgaaaagcacgcaattttttcatcttttcctttcgatcggatgattgtacactgatgaagccgtggtgttctctttttttttaccacaccacgaagactctcccacacgacacaaaatgcaccaacctcgagtcactgacaccccgaccccaccaccaccacccttaaaaatctctccctaatccccaccattaatttcgtcattttttttactgtttcccccctctaacaagttattaattccattatactacacgcaggcacacgtacacgtatacgtatacgcatacacgcctcgcttggtacacacgtacgtacgtacgtactagtagtatactagtatatatatagtacaagatgcgaagaagaaatcgtagccgtctgatggatggatggatggacggtgtggatcagtggaggcatggctcggcgtcggccatctcgacgccgccgtcgccggcggcggcggcgcggccggccttgtacttgtaccacctggcggcgacgaggtatacgaggaggttggcgaggcagacgccggcgaggagccagtagaacttgtggagctggcccttgttgaggtcgtcggcgagccaggggtggcggtcgccggtgagcttgtggacggcggcgacgagcgccgagctgacgaagaaccccagcgagagcgtgctcaggaacagccccgtgctcatcgtcttcatccccttggggcactcgcggaggaagaagtcgagctggccgatgtaggtgaacgcctcgccggcgccgacgaacaggaactgcgggatcagccagaacacggtcatgggcacggcctcgccgccgccgacgcgcgcgtccctcgccacgcggagccgcctcacctccgtcagcgcggcgcacaccatggcgacgatggacagcaccagcccgacgccgatgcgctggagcggggtgagcccgtgcgggttgccggtggcgcgccgcgccacgggcacgacgaggcggtcgtagatgggcacggtgaggaggatggagccgacgaagaagacggtgagggagcccgccgggatctggaaggaggcgccgatgtggcggtccatggtggtcgcctgggacacggagaaggtggtcatctgggcgtacaccgtccagaacatgatcgtcgtcgcccagatcggcagcatcctcgccaccgtcttcacctcctccacgtccgtcagcgtcgccagcgtccacttgctctgctcgccgtccggcgcgtcgttgatcgccgcatggtccaagaacctgaggagaaaaacatttgcaacttttgttaagcttacttgcagaagaacatcagttttcagttactaccaagtttcagccatttgtattgtactgtacatcaagttctttcaggttaagtttcaatcatcatatgtattgtaacatcaagtttgttcagtttaagtttcaatcatgtgtattgtgcatcaagttttttcagttaagtttcaataatatgtattgtacatttaagttttttcagttaagtttcaatcatgtgtgtgtacatcagtattcagtgaagctgcaatcatgcgtgcatcaattttcagttgagtttcgatcatgtgtagtacaattgtcagttgagtttcaatcatgtgtgcatcaatttcagtcaagttgcaatcatgtgtagtgcagagtttattaagcttacttgcaaaaagaaaaaaaaatcaatttccagttaagattcaatcacgtgtgcatcgattttcagtttaagcttcaatgatgagtgcatcaattttcagttaaaattttcaaccatgtatagtttcaatctttgtgtgcattaactttcagttaagtttcaatcatgtgtactacagttgtcactgaagtttcaaccatgtgtccatcaattttcacttaagtttcaaacacgtgtacatcaattgtcagttcagtttcaaccatgtgtagtacaatcgtcagctaattctttcaatcagcatgcaggaatttcgaaggattgagttgttctcttcagagttcagattcagaaacctcatcagcaatttttgcaaacttggtaacttttcaaaaagtttaggcagtgattgcagaaaacatataaagtaagacttttgcaatacttgtgtctatcattgacctattttaattgaaacaaaagctattgcaatgttcttttcacctttgggaccaaagaaaaaaaaaggcaacaaggaggtcgtgtgcaagctaaagcagtggtcacagaaacaagatgcttcacaagaacaagacacaaatccaatcataacactaaaacaattttatcccagttagttgctctgattatgcccccattaacatgaccatctataatctattcgtcaaattaaaatcaccctctcatttcgtgagggaatcgtcgtcagcagctaagtcttccagggcttatctttctgaaaacaacatcgtcagagtttccagccaaaactaaggactaaacaatttgtcaagtgtgtctcatagttggcagtattcttcccatttgcacaagttgatctgatctgtcaagctactaattagtatcaggaacaagcaacatgttttcatgtgatttgatgcaatgttgataataatcatatacgcatctgcggctctatacatccccagataaactctgaagatgtgagttcataatctggagacactgacagatcgaacagagactaaacaaccatgtagactgacaccaacctatcgataagataaaacataatctcataatgtttttattcaaagtgttaatctgacatgactttgattgttactgttcaaaaaaaggagctgaactttatcatgtggaacaccatggggctgaagagttcatggcagggaagttgccatgaaggcattttcttgaactctgccctactatatccgtgctgaggccgactaccatggctaaaatgaatgtgatcacgtgtgcctaactaaaataacagtcatgaatctcgaggtgagtgacacgacaagtgtcgctcgcaggcttaaaaagtgtaattaattaaccacgaggtgtacctgaattctcacatatcaccactgctcttttgacttaaaaaggcggctttttaatctatgcgaacaataataataactacggagggtagatttggtttctcctatcaacctcaccaacataagataactataggggaagagaaggtaacttttttatcgatgcggacaataataataactatggggggtagatttagtttctcccatcaacctcaccaacctaagacaactataggggagacccacaatgctaaaactacactgctcacatgcccctccttccttttctcaagctacttttgcatatggtccaatccatggagatgaatgatccccattgcttttgaagcatcaagaaaatggacagatgtgcaatgcaactccaagtgagccatgccaaaatgaaaggctgatgcatgtgagaaagagaaagacaagagagacagagagaggtttgctgcttagatctccttgtcctgatcacttgcaagatggagattgcctacacaaaatgatacactagctcttgttaagctagttgtggcttctagggctaactttcttctgtttttttctacctttttcctggcctctaactttcggtgtgcacacgtctcggtcctgttcagaaacagtctgctaataattgagacgatatgccatatttttttactagttgcttttggattagctttctaatggcccacaatggagttctcatcatggaatttcttgtacacacgtgtatgtttagtcactattagtaactagtgattcttgaatattttcttagttctaatgcttgatcctactgtactgtgtttgcaatagtagcagataagcacagcttcttcaaggcttcaaagagaggcttaacctctctttgaagcaatgtcactttgatttgataaataatatgtagaaataagactttttaggttatatagtttatttatagagcaaatgagatttgactttcacaagctaactccatgatatggttaaatacttcaagtgataaaaagttgatgctgatgagacatgtactggcatttttgaatggtaattaggttaacttttgttttaacttgcaaagatcaaatcatcaagaagatgacatgaggaaatgacagccgatttactctctcagaccagatgggagaccaaacagaagtactagaatacaagctttttctcttgagaagctattccaaccaccgtactagtccatgacacatgtgagctaaatgctttagctaacaatattcttgcccccactctaagttaatacttggttaactttactatgttcatgtcttaatcacactgaagaatggtgttctaggcttcgctaattattcgagatttatttttcaaaaatcaggtatttttctaataacactttaggaccaaggaatctgaatcaaccttttgctccaaaacgtttccagctatcataaattgcaggatgttgagagcaccaaaacatcaaagcactattgatcctatttt

SEQ ID NO: 40313 - DNA, 6674 bp, Oryza sativa
aaaaattccatgaaacaggacatgaaatttctctgaagtttcgactagatagcagcagtagtaggtgtgagacagctttctctccacaggaggaacaaggtgagtgatagatagactgcaaatgtactattactcataaaaaaaacatgccaattaatcgaagtcttaaatggccatttggcatagcctgccgaccagcctgatgagtcctgatctccaatatcttctgactagttttatctttcagaggatagtgttctgtttcagagtctgcatttcagtgcagagcatcaggcacaggatgacatgttcatcaggattttcaggatcagatggaggtcagtagcagaactacaggaagcatagtccgtgacacatgctgcccgattagaatacatgcaattattggctggtcactgccaaattttctgtttgtcttctcctatatggaagtccatgcatggttgttggttatcctagatgttatattctctagggccatcttgtcttcaagaaagggatttttcgaaaaacagttcaattctcgtcggaatccagaaaattttcctcttgactctcccagaatctagaaataaaatctcttaattctcgtatccggaaaaaaaattccctaactcttgtcggaacccaaaaatttctcccttatttcaccggctgtcgtagccgacataccatttgtcggcaactattatagccgacatcccacttgtcgatgacccaattgatagttcaagttagtaccatgatgaataggtgacggatagaaaccacggcgagacggatccaagccctagaggaatatggacccgtccgcagaattcctacgcggttagcaataccatagatggtactgcatctaagaaacacaagacacatttgcggattggtaaataactacaaatgcaccaaaatgcattcattggtgtaaggtgaacatcatcatgtgacattgcaacttgggagaagatgataaaactagctggagtagggggacaagatgaacagtgcaatctgaatctacacccaacttgcaaatttgattggacccctcaatgttgtacattaaaatctataaacaattctcctcaagtcttatttttttgttgtcttcctctcctatggttaaaaaaagttgggaacaaccatggtcctatatcactacatcatcagtgtccatgcaagtttgacccatatatactcaagcaaccaatggctgaaccatgtgctaattaatctatgattatcacaagcaaacggtgcaattaggagttgtttaatactaataaataattaatcaatcaattatcatatatactcaagcaaccaatgcccaaatcacgaggtaattaatctataatcatcatcagaaccaaattgtgcattcaatcaaacaactactacctctgtcccatataaattgtaatttatttagcatatattaaattttgaaaagaaagactatgatgcatcttattaaatggtgcataggtaagaatggaagcgtagttaagggtaaaataaggagacatttaaatggaaagtgattaataagatcattaatactttatcatgacaattattttgaaacaaattttaaatatgggacagaggtagtataagaaaaaatcatcatcaattacttaagcaaaaaactaaaagaaattagataaataattacctgaattgcttggtgtgggggagtcgctgcttgagcttgctcttcttggaggaggcggccagctcgacctcggcggcggcgagcttgccgacgtcgatgtcgtagagcatggcggggtcggaggggagctcgaggcggcgcttccgccacgcggcgacgacgacggcggcgatctgcgtcagggggctccccaccagcttcttgaacctgtacctccgcgtcccggcgaggaacacgacgagccccgccgcgatggcggcggcgcacgcgccgtacccccacggccggccgaggttgtcctggacgtagacgagcacggtgacggcgagcagcgagccgaggctgatgaagaagaagaaccagttgaagaaccgcatcatctgcgacttctcgccggagtccgactcgtcgaactggtcggagccgaagccggagacgctcgacttgagcccgccggtgcccagcgccgtcaggtagagcgccaggtacagcacccccatctgcgcccccgtcgcgcgctcgcacgccgccgaccccgccgcgcacgccgccggcctcagccccggcgccgccgtcgagatcgtcaggatcgtcaccccctgcacgcacgaaattatttttattaatttttatacttattataattaattgaattatcatatgatgaaaaatatataagcaaaaaaaaaagttttcaatcttggcatgtgtagtacatggagtttgtttaatatttaaattttactaccacggaaaattactgacattttgtactgtaataattaattagtcatatgaaaaatatgtgagaagaaatgaaattcaatcttggcttgtgtagtattaattacatgatatgatggcagctgctggtgatggttagtccagatacttgatttatttaacaattgattaatactgttgttgttttggtgcatgttattttcacaagagaatctcccaaaaaaggtttgatccttttttttttactgctccactatgcatggtaaaaatccaaaaatggagaaaaatactggatattttctgctcatcgaattaaaataactaaccaaccatccatccatccatcctcaaaagataaaaagtaaaaaaaacttttcaagataaaaaaaaaagcagagtcagatttaaaaacaaaaaaaaaagcaccatctctcctgagttgccggagagctcagctcgctccggccatggcggccggctcagctcgcactggtggcacgaacgccaaagcagttcgcacgaacgtcaaagcagtgagcacgaacgtcaaatcaggggactgaccgaggcttggacggcggtgaagatggcgatggtgaggtagcggccgaggaaggagtcggcgacgaagccgccgaggaggcagagcatgaaggaggtgcccatgaagttggtgacgacgttggcggcctcggcgttgccggcgtgcatcgtcgccgtcaggtaggtgaccaggttcacggcgatccccagcgtcgtcagccgctcgttcagctccgccaccagtatcatcgccgccgcgccccacctccccgtccgcgacctcgccgccggccgcccccggtagtcccacgcgtcgcccagcacctcctccgccgccgcctgcgcattcgtctccggcaacatccccaccatcttctctctctctcttcttcttcttcctcgccgccggcgacaaacgcaggtgagagtgagagggaggaggagctcgtcggaggcgagtggtggtggtggtgaggttggaggggaggtggccatggctatatatacttcgccgagggagagaatctactatgctacccccaggtgggggcccacgtgtgggggtgggcctactggaccgtggtcgttaaattagatggtggtgatgattgattagtggtgagattaagcttgattaatcctcacttaccgttgggttgggtttttgtatcaacaaggggaagatagatagatagattatagatagatatatactccatacgtcctaagatagcaaagtcttatccagattagttgtcttaggatataatatattctgtcttaaaattatgatttttaggatggagtgagtagatggatagatagatagatagactgactagggatataaccttgaaaacaaatcatgcctggatcagggcactcactgcttcacttggttcagagtgaaattggacactgcttcacttagctcagagtgaaattggaggcaactatgaaaaataaggattatggatgaaacttggctttatggtaggatgggtttcacttgcttagcatgtgtttgatttagagataaggtgaaatgagttagacttatccttgttttttttatggtggtcccattatcagtttgccatgagggatggagtggttttgtcttttttaggtatgggaggttatggcccacatgtcaataatagagagtaaatgtgttggattgatatgctagattttaaggtgtgaagctaactcggatttcgggggaatattctcgttacggaatcaaccttatcccacctatcttcaaactaaacattttgaaaattggttcgatccaacctgacctactctacctattcaaccaaatacatacatgatagggttatagatggaattgagtttactgtagttatttaaggacataaatggatgaattaaataaaagtgaaatgttggttttgtaagaaatgctgataaataacttattttttaaaatatgcgttgtttaagtagcttgagaagtgacatatcataattaataatccttaagaggaaaagaatggccctaagttgtggcagtagttatatattttttggatagaaaaaatagttacatgtttttgtttatatggaatacacatactatctacaagtgtgtcttccttaattaacaattactaatgaaatgaatatcttgtgctagagcgtattcaccaataatacatagtagcaaaaaaaaatgttatagcaccttctttttttttatagtaatgttatagcaccttcttggtgaaaaagaatatgtattacatcaccttgaaaagttatgcaccctccagttattatattattatattttatattaataatgatgggataaaaaacgcataagcattcaattactattggtgacttctaaaatcataacagacatgctagatatattcttgggtttgaaagcacttcttttcccaagtacaattccgacgtatagatgcatacacatcacactcatgcccaacgtatatgttgttcagattcgttaatatatagaagtttttctagacggatggagtacgtctaaacgagattagagaggatgaaataggaagataacacacaaatgttattaagaacaaaacattgcaattacgatgcaattaaacatcatacacctcaagaagaaaaacaaaaaacaaaaggagtggtcttacgtgggagatcgaacgatcaatcatgtcacacacagtcacggacttggatcgatttgggtctcttctagacgctatcagaaaaaaactagaaatttcgttacatttacgttaattctccggtcataattgggacaagcggtagttaagttgttgtaatgtgaaggttctttgagataagacacctacaccattatttttctcctagttaagccaaaaagagtaagacaggaggatggggatttgcctgcgcgatgaggtggggcatgctttgtgtgcgggcgctgggcgtttggagtttgtcagtgatgctatctcagctgaagcaaaggcgtgtttggcagctttattagccattctggcgcaaggtgtttcggtggttgatattgagtctgattcggaattgttggtgtcggcaatcaagtcctcttcgcatgacttagctactggtgctacaatcttcactgagataaaaacggttctccaatttcagttttctagttttgatttctattttgcgccacggtcttataataatgttgcgcatgaacttgctcgacttggtgtgagttgggatccgggtcaatcttatgtgtgggttgaccccctcccaaggtttgtaagggccaaagtgattcgtgattccactgaatccaggtattaataaacaacccggtggtgaagttcaaaaaaaaaaaagagtaggttttaatttttcacatgtttttctaattatttttctggtgatgataatgatgcaaaaaagaggcaatatacaatcggaatgtactaaacaagagtcatcgatcaattggataggatcgaataatagtaaaccaatgttttttttttcttgtcaatgcatgtaattatcgaataaccatataaattcctttgttcctgtaggatcgtaaagggctttttccaccccaaaagctagccattgaggtgaggggctcccccacttatatcttaggtcatttgcccttccacaaccaatgtgggactattcaacaatccccccttcacacattggtgtccctcagcccttcaccgccccttcaccgtatccgggcccccaccggcccacggtccatcaggtatacgggccccgcaggcacccacggtccatcaggccttcacacgtgtcattgtaaaatcaaaggtgtttttgattattattctgtgatgaacgattgggcattggagattattggttttgttatttggaatttattcacgaagtggttttggagatgattggatttcacaggtgaatatatatgtgggaccggtcagaccgggcttgtgctgccggtcagaccggcgtgtaatgcgcggtcagaccggcgcagcctgcggtctgaccggccgacactgtgtcggtttcggtttcggattgtttatttggatatccgagtttattccatgattatgacttctagatggatactatacgtatgtaatactattgtttgctgctaatgagtcaagttggaaagggctgcaggaat

SEQ ID NO: 40314 - DNA, 8774 bp, Oryza sativa
ctagagtcgacctgcaggcatgcaagcttaattaattactcgctccgttttctaatagttacggttgttacttttgaacgatcattcgtcttatttaaattttttatataaatatataaggtataaatcatgctcaaaatacttttagacataaaataatttaaaagataaattataattagataactttttaataaaataaatcgttaaacgtgtgataaaagttaacggtgttaccttttataaaacggacgagggagtaacacatttttgcacaaccaaagccggacgagaacgagtgttgttgctaccagctgacgtcatgagaacgacaaattaaaattcgattaccgtgtgctagggccctgtgtgctagcacacatgttcaatcctaagggccggatacaacgactgttttggatatgctcgtacgcattcatgaaatatgctgctccctctttacatttagggctttttttcatgggactaatccactagtccttccatatattctagtttttttagtctctaagaatctaatctaaatataggtgactaaaagggactaaaagtgtatattgggactaaaatccattaatccctctttacttataagatctaaagcggcagcctttctcttctctctccctcagtccacatgactttagtctttttagtccctggattcaaatggggactacagtttttagtccaaggactaaagtatacagggactaaataatccaaacgggaccttaatttatgtatgatgatgtttagttcatttaaagagagtatatatgctctttggtcatagatatttaatgttaggataaagttttattaaacttgtgaaagattgatctctaattttatattagaataaattttgaaattccaataaatttatgatataacttcccgagccaaatctcaacatgtccataaaaagaatttaagcatctaatgcatcaaagtttaaaaggttgacagaatctttctctatgcgtcaaatatttataactaaaaagagtattagcgctttctaaccagactttgcttaatggttaaaccttttccagttggttaatttgaatttatatatacggatctatatttcaaagtgatttcaaataaaggattggctactattaaaaaaaagaggagactttggagggataagacatccctccaaagtccaaacattttttaagaagaaattgtgagcgtccacccttgaccctaccttgaaccctaaaccttaaattgttgagtcgctgtcggttgccttagttcattagaggcactgaagctagaggagaacgagctctcgcacgaattgtgaagcattccctaatgtaagaaaactacaagattatagctagcctccacctttttttttttgttaaatgtgatgtagcaattccgtctaaatgatgttggtggctgttaagttgcaactaagaatacaaatcacaagaaatcaacggtcaggattaatagtgatttttttaaaagaaaaaaaaacgtcctacagaagaatttaaggacggtcaacctaaagctttgacctttcttgttttgagaggagggttaaatttgggcttgtaacaggcctttcctaactagtcaggttaccaaattgggcttgggcctggccacgcactggtgatttacattagggcccgttcaataggtctttacctggcccattaaaggcccatgacagacgtgtcttcctatctgaaaagaagattgtttgtttttagaactgaaaagaagattgtcacttagcccaaaagttattgcttatcacccaacgttctaatacttaaataaaaaaatatatttaagatatccatgtcaataatgaaaatatccatgtgaatattaacatggcatcccctcggtctcttcattttctctttagataatggataaaccccgacatttgctctaacagaatctatagccattcttgctctccatcatataatgtataaaattaaagtttcagaaagaaaacacaacatacaatttcacctatgcctcaaattatatgtatactcaaattatcttttggtgtatccgaataatgtgttctctagccaaattataatacttggtcaaaactaatgaacatcttttttttcatctaggccataacacagttggtactagtttgtgtacttgtgagattgcaaatatagataggagtatatatgaatatataatcttggttgtctttgaatacacaaagcctagttaattagacacgtggcataaattgattggttatgtatgacaatacgagtccctgaacgactacaaatacctatgcgaaatctccaaaccgcgtcacattccaaccccaaccacgcctcggatcaaaataagaccagaaaaaaaaaaaccctcaaaaatccctgtagaaaaaagagtcgatgactcaaaaagagagtagagaagaagaagccgagagatcatgcgctgctcttgcatggtctgtctcctcctcttcttcctcctccacctctccgtctgccacgccaccagccgcaaccaccgccgcctcttcgccgccgctccggccgcttcgccgtcgacggcggcgctgtacggcgacgacgacattaccgccgccatggtaagcatgagtggagaagtgttcttggttaataaattaattagttggattcttgattttgattatcttcgtgtgcgtgtgcatgcagcacgtgtggaggtctccccggaggtacatgcgggcggcggcggaggagcagcggggatcgccggcgccggcgccgctgccggacggcgccctggggctgcagcccggcggcgtcgagggcgcggcggcggaggcgaggacgacggaggaagaggccgccggagccggagccgcgatggcgccgttcccggcggcggcggacgtcggcgggaaagatgatgacgattccggcggcggcgatggcgcggcggacgacgccggcgtcgactacgcgccgcccaagacgcatcctccgtctcacaattaaaacttagtcgatcgatcgtctcttgatacgaagaagaagctagacgtacgacgacgaattcgaagatcgatgcatgaggacgataagttccatgcatgtcgtaaagtatatattcgatcgtgtctcaattaattagctagctttatattttgcaagagttgtcgtaaacaatctctctctctctctctctctctgtgtgtgtgtgtgtttaatttgttgatcgtacgtgttgtgttcttcattgtgtggagtcctatactccatgagaaataatgaattttggcaaaccttaggaagaatgaaagcaaaaaggaaaaaaaatatatagatttttctcctacataatcattctatcccaaaacaaattaacttatgactgtttgtgtgccgataggttaacttattttgggacggagaagtaactaaggccgtgtttagttccaaagttttttttcaaacttccaacttttctacacacgcaaacttccaatttttccgtcacatcgttccaatttcaaccaaacttccaattttggtgtgaactaaacacagtcgaagtagtaattgggaaattggaaaaagtgtttttctaaatacaactaggatggggatgatactaatcttgcaggtctcatggatggatatgaagttgatgaattgactgaagttgatgatgattggccatgaaaggggctagctagctggagtagtaggatccaggagctaagccaagctaagctagggttttgaaaactagaagccttgggaatgttggagaagacaagcatagctaacctaagctagttttacccccttcgttgcgacatgcgtgtttgaatgagctatataaccctctggttagagcaggtacaatagcaggctataagccagttgcaaatatattttaaggagataaatcaggagagagaagaacagcgggctacagatttgtagccagctgtagcacggactccaagacgcagtgtgtctatgacaggtgggactagatattaatagtgtaggttgtaactattgtatgaatgagctattagattggctatatataaattggagccagtagttggctatactattaaacttgctcttagtggttacaatgcattcagagatgcatggcaagttaaagaagttgcagacttccatggactagctagctatagctagtatagtagcttcattccaattttccaattcaccattaagtatattcgtagttatctccactggtaatttttttcactaattactgtgaaatagagaggtgtaagctaatgtgaaagaaaacaagcaatgttgtggctttatataacactggtggagagatggtttgtagtcccggttggcaacccctttgtagtcccggatttccaaccgggactacgaatcccggttggtgttaccaaccgggactaaagatagcagcacagtcccggttggtcaccattttttttcttttttttattttcattgtttctttccaaatagttgctgcttcccaaatctccccaaatatcccaaaatcaaagtatcatccccaaatcaatgaatcattcacatcacaaattctcaaaaaactacaactcaaattcttaaagaaatacatcacagatccaaacatcaaatacatcacacatcatatacatcacagatccaaacatcacagatccaatgaatcacaagtttttagatccaaatgtatcaaaaatttgggaaaaaaaaaagaaaattgtgcttccgcagaggagagggcgccgccggccgccagctcccgccatcgccgcgctacctgccgctgcggcccgcggccgcgctccctgccgcccacggcccgccgccagcgccgccgccgcccgggcacgctctggtagaggaggaggaggagaggggaaggagaaaggggagaagagaagactctgtggcataatgccagatctgatctgaggttgttgtttatgagagctagggagtagagagagagaggggaaggggatggaacgataagatcgagactctgtgccgcgcacgggaggttatatttttagtcccggttgtttataccaaccgggactaaagataattagggcctgaattcgacccggtgactttttgaaccgggactaaagataccaaccgggactaaagatcaacatttttttaaccaggacttaaaaatcgtttttagtcccggtttttaatggaaccgggactattgtggaatttggtggaccgaccaaagatggtttctccaccagtgtaagcaattccaattaaaactcttgtttgtgaaggcatttttctgaagaatgtggtgtttactttattttttttccctaaactaacttacatactatcaatatatatattcagctttctttaatttccttggaaacgaaaagaaaaattaaggtgagttgcagagttagcaatgcatgctctgatgagaaaatctcaggcgctttgatgtgcagcaaacctgagaggtttagccaagctgataactttcctttagtcatgactcatgactgaggtagctaggagtgcttgtaatcttcaacggttttcttgcacatgtaagagcttcgatcagcttcagactgcagttcccccccctgtccctgcacttttacttgtacttgatcatagaagaaaaaaagcagagtggttattttgtactatgtcgttatatcaggacatagtaattagctctcggtgagagtaattatttcgagttcttttttggttaactgtgtttaggcgttgatagtacgtaggaaataaattgcaatgtggtttctcaattagaaggttctattagccagaagggttaagaagctttcctctccagctttccttgtcgtgtttaaggaaaacaaggaaaactcaggaaacttacatttgcggatacacggcaaactgattttatcacagttatatagattttatcacagttatatactatctccgtcgaaaaaaaaaagaacaatttcagctatcatctaaacatgataattcttgctatgcacatagacatgcataccactttcttttacaaaggtaatatatataacacatcctatctagaagactaaaacaatatataaggcatgctgtgaaccatgcaaaaacctctcacgggctgcatattagtaaaacggttataatcatacagttgagacgattttagacatgtagtttgcattacatgtttagtagtttatctccttcttcctcacatctcatgtgcacggtgacctctcgcatctctctcaatcacaacccattgccacccctcaaccatggcatcatcctttccctattagcattggcttcatctctttcacgccgatcttaccacccaccttcccttgtcatctattgcctcaatgaccttagtctcttgtctatagatgaccctctcttagggatatggtgccatggtggataggtttctgatggccttaaccagctcaatcttattgtcactacatctccatcaattttatccctcttaatccatccaatccacgatcctgctagacccaacgtttctataaactttggcccactagatccatacgagttgcagttaacgacacaatgatgaggtttacgtaaaacttgaactcatcaaccttgcacatatacaacctatacatagtcaccacaaacaactctagccaccggaactagatgagtcatggttgaggacgtgagcaccatggtaatattgtattggtgttatctctacagccatagatcgaactaatgttcagtccgtgtcatgctgcctcacctttgttagtaaggttaacaaatatgtttgtcttggactttcttatccctcaatttcgtttgaatcgataaaataaaaactgtattgctgtccaatatttgtatagggtaacattaattataccctcatgggtaatgccactatataaagtatatgctgtagagcacctattttttaagataataaaatcggattatatctctggcctctgcctcattgccaacaagtttcagaataaaaaaagggaaaaaaatgcaaatgtacaacatctctcttttttttaaacacctctttgtttccttcgttgaaagaaaaaaaaagatgtgtcctgttggaagaaaaatgcaaatgttaagacacagcactgcacaaaaagacaaaacggtccttccgcattgaccgtaccagacccacacaagctcctcgtgatctctgatctccaccgtccactccccatccaacggccgaaacccaaactcaccccaccgtagtcggtttccccaccttccgtgcaccgagttcaccaacaccctactccccaactcccgtacaccgcgcccacgggtccacgcgccccgcgcaccggctcacgatagcgcacccggcgcacgatacgtctataaatacgcccctaccccccttccccttccggaaccggatcctctaacgtaattcattctacgtcagagggacgttcaaccacggatcgtcgttccttgcgcatccgacggcaaccaccgtttcagtccgtccccgcctcagaccccacaagcgcgatgtctctgcttgctctccggcccattcgttgatagcggcagcggcgccgcgccggccagccacccggaagctcaggcagccgtgcgctgccgccggcggggaggtcggactggaacgcagtgctaccgccgtccgccggcgaggtcgagggcgaggactccgcaccgcctcggtgtctgctgttggtcccatcgcccagcaactgctgtttctcggaaccatcgccggcgaggttggattggaatcgatctgtagtctatcgaacttgcatcatcaggttgccttttctcatggaagaggcagctggttgaaattcttgctaaggcattcgtgctgtcattagcttgtcccagaaactaccaagtaacctgaagaaataaaatcagagctgaaaccagaactttgccaacagattcatatagaatgcggcatagcaagtctgcaattgcaataaaaaattaccaaaaaagatggtttttctccttgaagaagagatcaatcgagtgcagatgttaaccaaggaaagaaatctcatggcacgaactgaagagaagatgagtaatttttctgttctttttgttccccgtgtagctcaccgaggacggttccgagaaacaccgacagcaaacaccgaggcgggcggagtcctcgccctcgacctcgccggcggacggcggtagcactgcgttccagtccgtcctccccgccggcggcagcacacggctgcctgagctttcgggtggccgaccggcgcggcgccgctgcccctatcagcgaatgggccggagagcaagcagagacatcgcgcttgtggggtctaaaggcggggacggcctgaaacggtggttgccgtcagatgcgcaaggaacgacgatccgtggttgaacgttcctctgacgtagaatgaattacgtcagaggatccggttcctccccttcccctttcctcagacgaacccttcttcctctccgcgatttcccctcacctcgcggaggcggcgaggcgatctgcgcgcgatcccattcgattcgccccgaattagccgccaaaaacactcgctgctgctctgctcactgggggggtggagcccacgcgggtgggcgaggcccggtggtgctcgcggcgggtggggggagggggcg

SEQ ID NO: 40315 - DNA, 3313 bp, Oryza sativa
  unsure (1)..(3313): unsure at all n locations
tcaggtcgggggcggggggggggngggggggctgagtttgggtggatgggtgaacttgctagcttaagattgctgttgggcgagtttggcatcacaagttccaattgaacgtttaccaggagctcgaaatgtttcaaattgggaccattgtttggtttgagtcgctacttcgatgtttcagggggaatgaatttatcatttgtagcgtatgaacaaccatgtgtaacttcaaattttgtgcactacaattacaaggaaacggtgttctgtttttgttgtaacttgtaatataaggtgtgtagtgaagcaattaggattgaacctgctagcagtgtacttataatgcaagcaatcggtggaacatgtactgttgtcataagttgtgaggcatcgaatcgaatttgtactttgcagagtcattgttgtgcggttccgtgtacctgttgagttgggaagctctgatctttacaatgaagtttaaatttttcagtacgcccgaggtttagttattgtgttgataataacatggactagatggatttgatagtattgagtcatcaggtttaatggttctgcttcagcaatgtgttatgtgcttcattacaagattaccattgcatgtgatgtgtgtaaaaaaacataatttttggggtggtatttgatgtggtttctgtgttgctttgcatctttgtagaggcaaatgtcagtggtgcagatagagcatgcagaaaccatggaaagggggaagcccaagcctggtggcttgagtgaccctcggttggggactattgaccagaagatcaaatgtgagacatgcatggctgggatggcggagtgcccaggccactttggccaccttgagcttgctaagccaatgttccatatcggcttcatcaagactgtactctccataatgcgttgcgtctgcttcaattgttccaagatccttgcggatgaggtacatggaccccacttctcgggtttggctgttttgcaggactttgttatatgaaaaatatcttaacaaaggaggcaccattgattttatgctacacatgctaaactggaactgaaccctatttattctgattcctgactattcatggaaacacagctatacttgtaatttgccatttttaactctgttatgttttgcatgttttgtgtttgcaaactaaatctggtaatatccttttatgttacactcgtttaacatgtgaaaatacaatttttttttgcgacttacttttccccttctgttgtcctcttttttactgttaaggcaaaaaccggaagatgcctttgttttcaatgctggacatgctaaactggaatcatattgatataaaatgtttattcggactatacatgcaaacgtaaatcttattttatctttgtaccggatctagctcttacgttttccatcttttctcaactctgagtttatttatcaatgggtgaatgcttttgttgcaggatgataccaagttcaagcaggctcttaaaataaggaacccaaaaaatagactgaaaagaatatatgatgcttgcaagagcaaaaaagtttgcgcggggggtgatgacctcgatgttcaggagcagcaagatactgatgagccagtaaagaaaaggggtggctgtggtgctcagcagccaaatatcactgttgatggtatgaagatggttgcagagtttaaagcaccaaagaagaaaaacgatgatcaagagcaactccctgaaccagtggagcgaaagcaaatcctctcagctgagagggtatgcacacaatctttactcaggttcaatacattatttttaagaatatccatttaactatgtggttcctgtttattttgtacttaggtgctcaatgttcttaaacgtataagtgatgaggactgtcttctattgggtctgaaccctaaatttgcccgccctgatggatgattttgcaagtccttccaattcccccaccccctgtgaggccatctgtcatgatggatacctcttccagaagtgaggtgagttatatgccacacttttttttaaccttcctactggatgattttaagaatgatgcaccttcatgaactctctgctattctttacaggatgatttgactcatcaattagctatgataattcgacataatgagaacttgaggaggcaagagagaaatggggccccagctcacataataacagagtttgctcaattgttgcaatttcacattgcaacatactttgacaatgaacttcctggccagccaagggtgagcagattacagtcgttttgccattttacttgatgcaaataagttatcctgattatctttttgttggaattttcaggccacacagcgttctggaaggcctattaaatcaatttgcagcaggctgaaagcaaaggaaggccgcattagaggaaacttgatgggaaagcgtgttgatttctcagctcgtactgtcatcacaccagatccgaatattaacattgatgaattgggagtgccatggagtattgctttgaacttgacatacccagaaactgtcactccatataacatcgagaggtaaaaaaaaaaaacatctttactgttattgaggcatgatcacagttctttaatgatcacttacacctaaattcaatgatctcagattgaaagagcttgttgaatatgggcctcaccctccccctggcaagacaggtgcaaagtatattatcagggaagacggtcagaggcttgatcttcgttatgtgaagaaaagtagtgatcagcatctggagctgggatacaaggtgaataccaactttattgtagaatctgctttactgatgttcatatgacaatattgtcttctatattagtcccctcatttggtgttctatttcatcaggtggaaaggcacctcaatgatggggattttgttctcttcaaccggcagcccagtcttcacaaaatgtctatcatggggcatcgcattaaaatcatgccgtattcaacttttcgcctaaacctgtccgttacttcaccatacaatgcagattttgatggggatgaaatgaatatgcatgttccgcagtcatttgagaccagagctgaagttctagagttgatgatggttccaaaatgtattgtgtctcctcagtcgaataggcctgttatgggtattgtccaggacacgcttcttggctgtcgcaaaattactaaaagagatactcttattgaaaaggttagcaagtctgcacatgataccttaattagttcttttctgctcagttatgctcatcattccctttttttctccagga

SEQ ID NO: 40316 - DNA, 3748 bp, Oryza sativa
attcctgcagccccatgttatttaaaatccttgacaaattcacatatcctcttaggagtactattggccatcgtttcaaacctctaatgtaaaaaaaagtggtatcgtccacattttaaattactcaaattagtacaaactaattagtacaaaaataaattgtatattaacaatatgtcgtatgaacaaatttaaattctctgagatttccaaatttaactagtacttactgttatgctaaattaattagtacaaacaaatttaaatagcgaaactaatagctacttactattatgctaaattaattactacaaacaaatttgtacaaaatttgatttgttattatcaagtagtgcactaattgacttccttatttcatcgacatgttgactaaaaaaaatggaaaaggcaaacatatcctccactttttttaaaaaaaatgttaacataccctccaacatgttatttaaaatccttgacaaattcacatatcctgcaaaattgaaacaggctgtcagtgtgaaacaggctggtggaagatatactttgccattcttttctccttcttgagggtgtaactcttccttgattcccatctcgactaggtccatccttgattgcagaccatctttagtcttcttcggcatgtccaacaatgttccaactatgttgtcaaacacattcttctctagatgcatgacgtctatggtatgccgaacctccagatctttccagtacgggaggtacttaaaaaatatggaatgcttcttgaatgggggagggagtttatcatctggcttcgaactgtcatcttgcttcttactatcccctcccttcgtattcttctcgggcttcttccgatttgtcccctttgatggtttcttagtcatttttccaaactcacaaacaattttctctatcattgcacacacattttctcccgatgtaggttttggtgcaggatcagtctcttcagtaccatcgaactccgccttcatcttgcggtacttgtgatttgtacgtaggaaccgccggtgccgcatgtacacaagcttgttggaacccgggagatacctatagtacgttccattcaagcagatcacacatcctgttttacctttaatttgacctgaaactgaaaacattgctggataatcgttaatggtcacgaagatgatggccttcactgtgaagtattcccttaagtactcgtcccacactttcaatccctctttccataaatcagccatatcttccaacaatggttcaagaaatacgtctatatcaataccaggttgatggggtccctgtatgacgatacagagtagtacgtattttcgtttttgacaaagctaggtaggaagattatacatggtgagaagcactggccaagtactatgtgaactgctcatgtctccaaaaggattaactccatcagtactcagggcaaatctaatgttccgtgggtttttagcaaactctctatactgagcattaaagtttatctactgatgagcatctgccggatgtcgaatcatcccatccttcttgcgcccttcttcatgttagcgcattagttccacatctcgcgggtttgagtatatccgtttaatgcggtctttgacaggaaggtaccacatcacaagctgcgggatttttctctgtcgtcccttagttgcttctgagggttctaggccagtattgctattcgacttgtaccggcttgcaccgcatgttggatattcatctaaagaagcgtactctttcctgtatagtatgcagtgatttacgcacgcatgaatcttttccacaccaagtgaaagggggcatatgagtttctttgcttgatatgtgctggatggtagtgagttaggcctcggtagcattttctgcagaagttctaacagactgtcgaaactggtatcagaccatccatgtctcgcctttaacctcataagttcaagaactgactggagtgttgtgaactcactgtcacagcccttcgactcatcgtacaaaacttcctttgctgccttctgtaaagcttcaaagtaatttaaccctctagctgaccccatcagcacctcaggttctgcatgacgtaacatttcctctaggtcgattttgtcctcaacagaaccatcgtcatgcaccatgtcttcaacttgtgtcggaactacattttcatgcccgtccacttgttcttcaccatgacgtgtccatatttcgtgcttgtccataaatccacgagttactaagtgctccttcactttaaaagcatcgtcaaagtcccaggatatttcattcttacagtcagcacatgaacaaattatcttcctcatattgttcttctcagcgtgtgccttggcaataccaataaatttagccacttcgtttctatatggagacaaaaacctcggccaatgatacatccattcccgactttccatatctctaaaaaaaatatacgtaaaatatttgcacaattaataccaaatttgtagggtttattgaaaaaacttatcgctattcaaaactaattaactaaaggttaagtgtaaagtaataaaaaatcaaagtttatttcaattttttttacacagacatgccaaattagtacattaggaaaatctaaaaaaatcatatcatcggcatattacaaaatactataactattttttgattgcaccgaataaatagacatttaaaattttattctctctctatatatgacaagatctagatctagatctagaactaggtggtggatgtgatagcaaaaataaaaaaaagagaatttatgttaccatattaaaccactacaacaagaggcatcaagtattacacatacatctaacatcaacatatgaaaagaaataaaattaaaaaacatggagctcttccttcacaattttggatgcataaatccatcacaaattaaggtctaaaagcttaaaaaattgcatacctagtgtggaaatgagtagatctaagtaccgtagaaaattcccccgaagatttgaagttcaaaacctcccccctatatttaagtcactttaggagagagaaacgtcggggagaatgaacagggctcggggaggaaaaagactatataggggtatctttgcaggcgggccatataagcgtcgcctgcgaagatcgatcttcgcaggcgcctgcaaagatcaatcttcacaggcggaccgccccctccaccccaggtactttttttgccggcggggttttggctccaaattacatgcccgcctgcgaaaatcaatcccctacgatgccgaaaatgagttttctagtagtgttctctagccaaattataatacttggtcaaaactaatgaacatctttttttcatctaggccataacagttggtactagtttgtgtacttgtgagattgcaaatataggagtatatatgaatatatagtcttggttgtctttgaataaacaaagctttcgcgtaaaaaaaaaacacaaagcttgattaactagacacctggcataaattgattggttatgtatgacaatacgagtccctgagcgactacaaatacctatgcgaaatctccaaaccgcgtcacattccaaccccaaccacgcctcggatcaaaataagaccagaacaaaaaaaaaccctcaaaaatccttgtagaaaaaagagtcgaggactcagaaagggagtagagaaaaagaagccgagagatcatgcgctgctcttgcatggtctgtctc

SEQ ID NO: 40317 - DNA, 2676 bp, Oryza sativa
tcttgattttgattatcttcgtgtgcgtgtgcatgcagcacgtgtggaggtctccccggaggtacatgcgggcggcggtggaggagaagcggggatcgccggcgccggcgccgctgccggacggcgccctggggctgcagcccggcggcgtcgagggtgcggctgcggcggcgaggacgacggaggaagaggccgccggagccggagccgcgatggcgccgttcccggcggccgcggacgtcggcgggaaagatgatggtgattccggcgacggcggcggcagcgatggcgcagcggacgacgccggcgtcgactacgcgccgcccaagacgcatcctccgtctcacaactgaaatctagtcgatcgtctcttcatacgacgaattcgaagatcgatgcatgacgacgataagttcccccatgcaagcagcaataatgcatgtcgtaaagtatatattattcgatctttgtctcagttaattagctagcattatgtcctaatctgttttttctttctttctagttagatttctctttgttctttcgtacgttcttcatgaaatattttgcaagagttgccgtaaacaatctctctccctctatctgtttaatttgtgccatggttcaaaattccggaccgaaattttggaattttttttgttgtattggactcgatattatttgggctgaattttttaaagtttttcgattttttttatttggcaatattttgttcaaatttgaccaaatcccaatacaaacaccgaaaacgaaagattgaatcctgatttgttgatcgtatgcgtattgtgttcttcattgtgtggagtcatatactccatgagaaaaaatgaatttaggcaaaccttagtaagaatgaagagcaaaaaggaaaaaaaagtatataaaattttctctacatcccaaaataaattaacttttggtcgttcgtgtgctgagaagttagcttattttggggcggagaagtaactaagtagtaattgggaaattgggaaagtgtttttacaactaggattgggatgacaataatcttgcagaggtctctgggatggatgaagttgatgaattgactgagaagttgatgatgattggccatgaaaggggctagctagctagtaggatccaggagctaagccaagctaagctagggttttgaaaactagaagccttgggaatgttggagaagacaagcatagctaagctaagctagttttacccccttcattgcgacatgcgtgtttgaatgagctatacaacactactagaaaaagcatttttgcaggcggacaaaactaattttcgcaggcgggagagaggtccgcctgcaccacaatgactgcgaaaatcatccatctttgcagtcggggcaacggcccgcctgcgaaaatagaagaaacgaacaaaaaaaaaaacgccagcctacaccaggagccgccgccggcggcctcccccctccctcctctggccagatctgggagggaggggggaggggagccgccgccgccgcctagcctgggtcgtcgccgctccacgccgtcggcgccgccgccaacctcctcggccgcgccgcctcgcctcctcgccgctgccgccccttgccgccacatgccgccgggagctgccgccggggagagtacaagtgaggggaggggagaggaggagaggggaggggaggggccggtggtgaggagaggtgtggaggggaggactgaggacttagaaaaaattgccgcccgcgtgtatttatattaagtctattttcgcagtcggacttagaaaaatgattttcgcagtcgccccttaagtgctccgcctgcgaagcgccgcttaagtggtatatttcaccccgatttatatttcataggcagtcatttggctctaaggattatgtccgcctgcgaaaatgagaccccccacgtcaggaaaaatgctttttctagtagtgcaaccctctggttagtggttacaatgcattcagagatgcatggcaagttaaattcgttgcagacttccatggactagctagctatagctagtactatactagcttcattccaattttccaattcaccattatattcgtagttatctccactagtaatttttttttcacaaattactggtgaaacagagaggtgtgagagctagctgatgtgaaataaagcagacagcaaggctttatataagcaattccaaaactcttgtttgtgaaggcaattttctgaagaatgtggtatttactttatttttttccctaaactaacttacatactaccaatatatatattctgctttctttaattttcttgaaacaaaaagaaaaaaaaaggtgagttgcagagttagccatgcatgctctgatgagaaaatctcaggctctttgatgcgcaacaaacctgagaggtttagccaagctgataactttcctttagtcatgcccagtgttcaatatttcgttttcagcatttgtatgggagggtgccgatatactgaaatctcggaaattttggttcgaatttttgagcaaaatattgcaaagttcagaaaaaaaataaaaaacctttaaaatttcaattgaaataatatcgtatcgggaggaggggggggggttggttccggtacaaccgaattttgaacccgggtcatgactcatga

SEQ ID NO: 40318 - DNA, 8153 bp, Oryza sativa
gattcccttttatgtgcatggttccatgatggctgcagtacagcttcccaaggatgagattatgaatagttgttgtcacctaaaatggcactagcactttagcatgagacatacacaactttgttatgaagaacataaaaatcatagattccgttcaggtatcatcctacagaccttactccattggaagatttcaccgtcatcgaattccactgtcagaacaccaatcggatcgacttgaattgactgcccccaaaacttggatttgagattgctgtcgccccagaatttccagcccttgccttcacagtggcaggcaatcagcatggggtgatgactaacctagtgatgaaaatgacgaaaagcaatgtgttgcaattaaatgcttcacactatcaagatattaaattttagttcacagatagaaaaggaggcaagtgtcatgccttgtggaacttacattaattttcagtagatatcagttttgcattatatccttcacataaaattgaaatggaagataaaatatttcctttgcacagaaaaatacaataaagagttagataaccaaccttttctgcaaagaaacggacccctctttcagggaaatcggcttcataagtctctcctagcagcgggttgaatggtttgcaaggtcttgcgacagatgaagcatagccagagactgcaaatgcagctactttgagaattctcatgagactgtttccctaaattttagatttaacagacacgtgaaaaaaaagaactcgttataatagagagacatgccagttgatacatagagttaaaataatttccgaactcaactatgactattttcatacctacaccaaaccagctgatcgaaactacaatatgaacaatcaacaaaagtcttttatgtgtaaaattattaaagcaccacacttcttaaagagttttgtcgcttcagcaagactaacattgtatagcagagatcatttttgtagcacagaatgattgatctcaacacaaatctgcaaactacagacgtaatgcgcttgtttttgttttcttcatgatcacgtctagggattgacattgagctgaagtctaatattattgtaaatgatctctatactctcatcataaaacaagcaaatatcctggaaacgtagaaatacagaaccacatatgtaaaatgatcttaccatctttccgtattgataagcttgatccaaaaggtgtgaatattctaaatcttcaaagcccttttggagggatgagagtggttcattaaagtaaactggaaggcatactcgtgtcaaatccttgccgacactatctttaataattgaccaaaggctgatgcctctctctttctctgtaggctctggtagtttactccgccgtttgatttgtggtaataagtgactagaatcttccatttggatatccaaaagtccctcaccacaactggttgagcttaacattgctgaagatctgtcgtttggttcaatgaagtagtctgcagcatcaaagaaagtagactcatcttcacaagtcaagtcaccaccatcttgcttctcaaattcatcagattctgtagtgctgtattctgcatgacaagcaaacaactacaacattaacaaatgctaatgtcaatttaatgaatgaaagttatagccactgactagtaaacaacatcaggtttttccttctaatacaaggcagaactagtatactcaggcaactaaatgaatcataaacattcaaaaatgcccgatggagtggcgtgaagaaggataaaatcgccagaagactatctgtgcagctaatcatgtgcagaaatagctcagtacgttctatgaaaacataccgctaaaatttccatgtcgagaactggaaaagtcatttcttgtcaacgccccctgtattatacttgcatctttgccttcctgcacaaatatgtgtgtaatacgtaaaattcctgcaggaaaagagagcagagtaacctttcaaggagagtaactttgcagagttagaaaacaagtcccaaagaagatctatgtattgatcagcagcattttaagaactaataagaatatcaagataaatttccacgggcataagaggtttttgttagctgccgattccattccaagttaggcatgtgaaggtttgcactggtcctaaaaatagggcatccaataattaacgcatgcagttccttacctcaaaatggtgcctacaggatccaaacaagcttagctggtcctcgtagcacagcttcagttgtttgcgaaagctggagaactccgtaagcacaatctgctcacactcttgtataagactttcattcagtccctcttgctgcatccgattccgaagcctggcagtcgagaccgaaacatcgctttgcacaaaagttatccttccgctgagtgatcttagcgaataaaaactcctcgccaagatcaaggcctcgatccaggcaacacggtcttcttttgaatctgtcttcaaatgaagtgtctttgtgggggaaaatatgtagaatctcctatcatccgacttgctctcccgaaatgctgacaactacaacataatgtccagttagctttgctatgggagaccttgcacatgaaaatgcagagtgaactttccaacatgtaacgctatccatcagaaataaaatagagcacacacacgcagactaccatccatcgtgttaatcaacagtcaagctaaatgcttattgcagaccaagacaaataaaaataaagatccaaagaccattagtttggcattccaggaagaaaggcatgtgaatcacttccactcccttcaactttaattaaagggtgagggggaaaaggcaagcaaaaggtacatcacatctaacatcaaaatatggagagaaaaaacaacgacaacaaagatttcaagaaaaccaagaaaatacaatcaagatggtgaccactaccttggaccaagcaagtgaagtgggcaagtagagcagttcttggagatccacaaggcccctcctgattcactctaacttacacacaggtcctctatttcaacccctaacccccttactatcttgctctagtatatgtgaccactggaagcaaagcaattgtacatcctttaattgttggggacccatgagcaatggccttgaaaagactcagtgctagtacgactactgcgagttcaacagctagtaaaagacttgtggaaaagcaaccctctccctctggagcagtacaaatcaataatgcaataaaattcaaaaattaaaaaaaaaacattcgctgagcatattctgtaaccacccggatttgttcaacttaatgcacagtattaaccatgcttcattaaggattaattgtgtcacagttggaattaattatatcatctacatttttttaatacgacagcgagggacggataaacttcactgtcttcatcgttctttagagttgccacagaaccctgccatttgtaagaaattctacaggagagcttgaaattttggctaaatccactaaaagttgagggatttttgtgcaaaagatgtgtctggttgtgtgatagagaaaggtgcggccctttttttttttttgggaaatctcgtatcaggaagagaaaaataggaatcatttttgttcatttgtaccttaacctgatactgctaaatttaggcattgttctgtggcattggaccacgaatgagatgattggtcaatcaaaacctcaggtgtttaactgctccaatatgcccccccccccccattcatgtcatgaacaaagcagaaattaattcggaaattttgttccattccaagaacacacaccaagatcatgttgaacaaaataatcgtccaaatgacaaacaaaaaagggaaaaaaaacttcaagaattcgtgaggacaaaagaacatcacgtcatttcgatccagcaaaatgtgacgcaatctcccaactaaccattgcatagtaacgagatttcgacagagaatcttccagtctctttcgccaacgcaaacgaaggaacaattcacacactaacacaatgcaaaatgtgattgatgcttgatcgattcagattcggaaagaggaagaaagagaaaattcctcgcagacacagattcgcaaaccgagaaatgttggggcaaaaaaaaaaaaaaacatgatctgcgagatcgcaggagaggattgggttaccttgaggcagacgacgccgacgggcttgtccggacggcgcgcgccgccgatcctggcggaggcgccgccgatcagcctgacctcgccgccgccgccgccgccgccatcctcgtcggcggcagcggaggcgtccctacgaatcttggagtaggagagcaccccgtcgtggagcgagaaccaccgctcccgccacccgcggccgtagttggtccacttgtggagcaccccggccaccgccaccgccgcgccgcccgcctcgggctccggcgtcggcggcgcgtccggcgccggcagcgccgccgcggagaggcagcagaggccgtggtggttcaggtggtggtggacgcctccgcctccgccgccgctctgcgtcatccgcctccttgattcgacggcggcgacgagaacgaaaaaataaaaagaaaaagagaaaaaaataatgggaaaaaaatggatttcttttttctttttttgggttcgcgaagaggagcgaagcgaagggaagaggagacgcgagttggctttatttagcagcggttggttgctatttatgtgtgggccccacctccctcgcctattttatgccccctccattttttttcttataagtcgcaaaaaagcttggaggagggttgtttttttctttcccaaactttaatttggccatttcttgagttaatttgtatgttttccacggatttttctcctttttgtcctaaatgcatccaagcaactggctttttttcttcacctttcttctagatgtaatcttgtctacgaaatacggattatgtttcagttattataaatatggtttatctctcaacagtttcggcgcataactataataacgacagcgctacgacgatttaactaccgatggctttgtcagataatcataacataagacaaagccaaaagcatatctttttatatgaactaaaattgtgcaagaaatttcattattaaggtttaagttaaaacattatgttactatccatctaaatgaaaaaaaaaagaataggcaagctaatagattgagtggtcgactgaggtttttataaggttgtgctagcacatataattccttattcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtttgcaagacaagatagctaactggaaattaataatgttagaaattagtgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagctagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtattcttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctatagagcaacaaattaatacaagtcactttctaagcaatgtttgcttacaagataaactttctcgtcatccattaatttttttttaaaaaaaactactagtataatttatatattgacaattataattggtcaaaatcacggtgtgggggcccactcaacgttggcacgtgtgcttgtcccggtgtggcccgcgtgaccaaccagcctctcttctaggcttacgtggcagcacatatcgttgtcttcccaaccgacccgtcactgacaggtggcccaacaccatgggtcccacatggcatatgttaaaatataatttgtgagggataaaatgcctaaggctacacagattttccatttacaatgttattataatttcatacaactgaagttcatcaacttttctaaaagaaaacaatttacgacactttgttgtatgatattcacccttattttagaccgaatcatattcacttttttttgtactccctctgctccatattattataattaaggtgtcctagtttttgtcttaaagttacttttttctaacaaagactaaatttatagaaacatgcaccaacttctacaacatcaatttagttttattaaatcatcgtgaaatatgtctcagtagtgtatttatttgatattgttgatgttaaatatttctctatcctaaccaaagttagagaacttttaagttaggacaaaactaaaacacctaaaatatacaaggaagagatattataatggtaaattgactatttgagaaatatcttttgtatgtcaataaaaacttacaccctcttaaagagaatacaaacatatttgtctacattgcgagtccaagactaaacataaaaaataacacaaacgcatgatacaatcaatttctaacacataaaattcatgatacaagattatatcatcacacattttcatataatagatagagaaaacgatttgccacttttctttatctcattgaagtatgttaaggagacgtactcattaatgtgtgcatactacctagggaatgcgctcgtagtgatgtgtggtgtgttctctatgtaatcaagaaaaagaaagacaagcgtgaggtatatatattaagaaggcacactcgaggatatgtgttaaggaaatgcattcactgatatatatgtgtggtgtgcgtgcgtaatgccatgtgttcatacatgtgtcttccaagcactcgactaaaaccaaaataaattatgaggtcaaaagcgaggtgagcatagcaatattacaaatcccatggctggcgatgtgccacgtagcttaatatcttgttgatctgtggcccccacgcttggacgagaaaacccaacatcgccaggcgcacccaac

SEQ ID NO: 40319 - DNA, 4626 bp, Oryza sativa
tttctttttctttagtgaggagataatatacatattttcttaggtgttagtattaactagctagacatatgtgtataaaatggttatcaatgattgttttgtggatcagggttctctttaccacttgggaaggggttacgacatctcgacggtaagcttgattaccgtaataaatcgagaacaactgaaaaaaaataaatgtttatttcaactttttttaaaaaaaaacttagttgggttaccaggcgttatcacaagtcggattactgcggtaacaccagtaacgggtggcaagagaaacttagtgtggacagcattattgttcttgccagcataatgctttgtttataggctttcaattggagaaaaaaaatgtgactattttacatgggccttctttggattctccgagctattaaatagctctctggaatcttgttatttaggagtattaaacgtagattaccgacaaaaccgattccataacccctaggctattttgcgagacgaatctaacgaggtatattaatcccgagggctattaaatagccctccggatccaaacagggccatggacttggtatagtaaaaatgaatcattaagagcagactataagccagctgcaaacatattttaagaagataaataagaagagagaagagcagcgggctacatatttgtagccagctgtagtatggactccaagacgcagtatgtgtatgacaggtgagaccatatattaatagtgtagtgtctaactattgtatgaatgagctataagattggctatagatgaattagagctagtagttggctacactattaaacttgctctgatacggtactactgttaggcagaggtgagtggtcaagtaacgcttattttatttgttcttggatctgatcacagttgacttaatcaattaggggatggtacggatagctgctaatgtagctttgttaaaaaggaattaagtagacttaggttcacatgtcatgaaagaaaatgactagagaagccatgtcagttttgaataattgtccttcttaagatagcctaaaattgaatccgccgctaccgtaattttcttgatcgagttcaacttcagcctcatttaattttgatttcaaaacagtagctctcttgattctatcatcatgaaaaatctatttccttgaacacggtaatttcacagaattttcatatgaattactttagcttctccataaatcctgtaaaattcctttgtaccaaaagagaccttactatttttatataatagaacgaataccagtctttgcttcaaagaaattataaccacttattagttattacaagcaaatgttcttttagcatagatcaactaaacaattccagcaaacaagaaggcaaagaataccttactggtgctaagtggtgatggttcctattagtgatgaaaacggagcggatagtttccgtctgctctggagaaaaacgaatatggatacctttcggatcggataattctcagattgttcggatacggttacgaatatgaatattttctcctagatacggatatggatatggtatcggggtttccgttgaatacggataataattcggatatccggtgaacagtgctattcgaatatccgcagaagccgtgagacatacccaatttctttataaccctatgatgttcaatatacctttttagattttaatagtagttcatctcttaacactagtacacactattaatattatttaaatttttaaaaatatttataaattatactacattttatataaaatgagctaattatatatgttgatatttgtttctattagaagttgagttggttttcgtgttccaagaaaaaaatgtttcagtagtcatgtccaatcatattcgattcttattcgtatttgtttccgtattcgagctatccatatttgttttcttattcggcaaaaaatatgaagacaaatatggtatgagcattatccgctacgtttttatccctagttcctataaatgcaaatacaaatgtattcgagaagtctcaaacaccaaactaaaacattgtttttcctcacaaccaactcaaagaagagaaaaaaaaaaaccatcaagacattgttttgcttgctttcttgctgcacaaaacataggcacaccatcattcagcagtatctttaccacttgatgcaacctgagaccctcatgattttgtttgtttcagctgttgttctctagggtttcccaaaccgctggggctggggttaccgcgccccggcggtaagcacggttaccgcacggtaaccgcaaaaaaccgtacaaaaccgtgcaaaatttatcaaaaattcaaattattttttaaatttatttgaatttaaggaggttaccgcggtatttatattaccatacccccacggtaagcccggtaaccgcggtaaccgcgcggttaccggcggtaaggtaaaccctgttattctcctattgaaaaatcaaaggaaacaaagcatatgtgagaagataggagaagagaggtaaggtaacatggggcctgagttggggggacaatgcataggtgtatgtgttgggatgatatcaatcaaatcatgtcaccttcgatcgatgcaccagatgttccctcagcatccatcacggctgcatgggccttttagacccaagtgaaacaaagaatcatacattagagcatcatcgacatgattgtgtactactccttcagtacaagcaccacatgattttccttttaggaaagtaacataccacttgatattttttttctcggttacctggatgacacatatgtagacaccactatataagggtttttacagtgtggttaataatatctcagtccgagtgagccagatcggagatttgatgccacgtcaggctctctcgttgtcctgtgaagaacacggagccaagttgagccacacgtttttatcagaatttgcaggtctggcctatagttatgccccacaccactagagaaggaagaggaagtataggtacctcgtcgccatccctgtcctccatgccaaggggaggagggcaatgaggcgctatcctcgtggagcacttgggccgagccggtgacggcaatggcatggccgcagacgaggaggaggggtgcaagctcaatgggggtggcgatggcctcgatacgtccgcaacaacagcccgacggtggccgcctcaaaccctcgtcccatttgcagtatgttgtcatcgtcttgtggatctcgcccttgtcgtcgagtggtaaagaaggggaggaggggagaggggtgccaacggggagttgaggtgctaaatggagatttttttttcagtgagcgatggagatcagggatgggtcaatggagcttgctgggctgccgccggcaacctctcgcccacctcgatctgcactgaagaagcacgtcggctcgatggggaaggcggcagggtcgaagaagctcgccgactcatcctaccgtccctgaccaatgttgttgtgcttgtcgtcaacctccactcgcgtgtcagctaagcttttcaccagtccctcacgctaaactgccgagctcgtctatgcatcggttgggagaagtggagaggggaggcatcggttggggaaggagagggatagtaatctggacaggaggcctgtctagattcgtggtactatgaaatgtctaatcagatattaggcttctatattttgggacgagagagtacatgataaatcttaactatttggtggtttagttgtttaggcatagtcattctctcttttttttttgttttagaaacagaagacaaacacatgcgctcactacacgcacactcacccctataaacgcacacacgcacaccctatctctatgagcacctctaaaagactagactgacatatgttgagattcacgaagtcaccactaaagtctcgctatcgatgaatatgtcgcctaccattgaaaaaataattagctctaaatgtgaatacccgtattaagtctaagacttaaatccaagtgggttgattcgaccacagggaacctaaccagttgagtgacgctcacttcgcattcattctcatttaattgaaacaacgctaattaatcttattttctcaccgttcttgtctatcattttctagaaaaaaaatgacatataagttacttgattattgtttcacatgaataagattcattcgcaagaactaacaaccaaccaatttcacttagctttttgttcccaaaaaaatggaacatagagatgactccaagatattatagttgcatcacactcgtttaattttaatgggttgtgtactgttattctcttggttaacacaaaaatatcgagaaccatgatatgagcagggtgtacacattactcgaattaactagttaactgaactttctgacgcgttagcatctctatgtgcttaggaccaataacataggattattacagtacacatcaacgttgttcgttaccagtaattaatcacattgcacgaataaagaggtatacgctgacgtcaccaaccgtacaaaggcatgcttgcacgcgaggcttgcaaatgatgatgaattttgtttcattgtcacgatg

SEQ ID NO: 40320 - DNA, 10131 bp, Oryza sativa
tactcatgtttatcaaatattatatgcttgggcaattacctttgggaaggtaattgagatgcggcatgtggagacatgagcgccatattgccatgataatgatgacatgatttgtgaaagtaggaaagaaattaaacaacttgttttagactggggcggacggtggatttgggtggtatctgggaaaggctagtaccgtccccggtcaattaaggaccgagccatgaagttaagcatgaaacgaccccgtacaaccacacttctcgtatggggatagacctagcggagtaaatagctgagcggaggcagtatccatgcatagtggtttcttgatgtgtaaggcaggggctctacggtggggcaaccattggtaggaccgcgaggcgggtgtctacagtggtgtcaccatcggtaggactgccatgtgagaatctaaaacataattataacttaatgcatgtgtgagtcttcccttcccaggtgcgccagaactcctctcactgctagaaaccgtgtacgcctagagtgcatgaggatgtaacgttcatggagcgggtactgccaatgcgaggttatcgaaaagctttaccgtgacgcgtctcatgtgttgagacaaggctcatgtgttgggcagtcgcggagtgtgggtaaagtgtacatccactgcagtgtgagtaaaccaaatctattcgaatagccgtgctcgcggttattgagcaccgggacatgtattacacttggttttatgttcaatcccttgaagtatttatggacaattatgatcggcatgacaattatgttcaatggacaattttgaacataaaacacgtgctttaatcccttgaagtatcatgccattggctcgctccacctgtccattgctcatggggtgcgccacggaggcatagcaaatcttgattccaaagtcctcacaaaagtctttaaaaactccgccagtgaattgtgtgccattatcagtgatgatccgattgggcactccaaatctatgtacaatgttgatgaagaagtctcgagcattatctgctgtgattgtgacaaccggtttagcttcaatccacttggagaacttatcaatggccacgaagagatgcgtgtaaccgccgactgcctttttaaacgggccaaccatgtcgagcccccaaaccgcaaacggccaagacagcgggatagtttgcaactcttgagctggtagatgaatttgtctagcgaaaaattggcaaccttcgcacgtgcgcacaatcttgtcggcgtcggacacagcagtaggccagaaaaaaccctgccggtaagctttgccgacaatggtgcgtgcagcggcatggtttccgcatatcccagaatgtatgtctttcagcaattgtctcccttcctctaaagatacgcagcgttgcagaactcctgaagggcttttcttgtatagctcagattcatgcataacatagagtttgctccgccttgaaatccgctcggcttcatctttattttgagggagctcttgagaagttaagaatcgtatgaagggctctcgccagtcggcttcaaccatagctatgtcatgagtgtccgcatcttgagtagtatctttatgaggtacggtcggtgtataaaggtgttcgacgaaaacatctgagggcgccgtctcgcgcttggatccaagattggcaagtctgtcggcggcttcattgttgtgtcgaagaacgtgactgagctcgagtccatcgaacttgtcttccaatttgcgcacctcttgtcgatatgccatcatattgtcgtcaatgcaggaccactctttcatgacttggttgacgaccagctgtgaatcgcctcgaacaatcagacgctttatccctagggaaattgcaatccgtagtccatgaaggagggcctcatactcggcaacgttgtgggacgccgaaaaatgtatccaaagcacatagctcaatctttctccagtcggggaaatcaaaaccactcctgctccagtgcccgaaagtctttttgacccgtcaaaatgcatggtccagtgctccatgttctccgcaggggtatcctcctggcactcggtccattcggcgacaaaatcagctagcgcttgggacttgattgaaattcggggcttgaatgatatgtccaaagacatcaactccaaagcccacttagcaatacgtccgtttgcctcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttttggacatggccttcttcctcgcgctcaacgaccaagactgtgctcacaacctgggaggtggctgatacatacagcaacaacggctcctgcgggtgtggcgaggctaagactggtggctcggtgaggagtttcttgaaatcttcgaaggcctcctgtgcttcgggtccccactggaaattatctgttttcttcagcagcttaaagaagggcatcccccgctcgccaagtcttgaaacaaatcggctgagcgccgccatgcatccagtcagcttctgaacatctttctgggtacttggcggtttcatgttgaggatggcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttaacgactacatcatccacataggcttcaacgttgcggccgatctgcgttgagaagcatctttggatcatacgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttgggacaagacttgttgaggtcggtataatcgacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgatgggctttgcatcttctttgacatgtaaggagtgctcaatcacctctctaggaataccgggcatatccgatggtttccacgcaaagatatctttattattctgaagaaaggtgatgagcgcgctttcctatttacaatctaactcggcgcctattacagcagttttagtaggatcagagggatctaggggaatcttcttagtcttggcttcgctttctccactttttgaagtcttggtagcaggtatttctccttcgcttgccgtggctgcagccagtcggatatcctctcgggcagacgccatctcgcgggtttgagccatgtcgcaactctccttgtcgcatgtgacggcttgcttgatgtcactccgtagggatagcactcctcggggaccaggcatcttcatcatcatgtaagtgtagtgcgggacggccatgaacttggctaacgccgggcgtccgagtatggcatggtaagctgtctcgaaatcggcgacttcgaagctgatattctctgtgcgaaagttttcccgagtgccgaaagtgaccgggagggtgatctggccgagtggagttgcggataatcctggaatcactccgtgaaaaggcgcattgcttggttttagctcggagcgaggaatctgcatatcatccaaggtcttggcgaagaggatattgagtgcgctgccaccgtcaatgagggttctgcgaagcttgacattgcggaccactgggtctagtaccagggggtaccgccccgggtggaccactcggtcaggatgatccgagcggtcaaacttgattgcaatctctgaccatcgaagatactggggcatgtcgggctgaacagcattgatctcccgttcagtcaacttctgcttccgtttagactcataagccagggggccgccgaagatatggttgagctccttgcggtgatcttgaaaacctgccggggtgtcgccgtcgtccttcttcctcgacgtgctttgttcttcgtcggaattcttccgtgcagtcttggtgtattgatccgcgaattgcttgtagacgaagcaatctttggccacatggttggagttaggatggtgcgggcattgggagttcatgatcttgtcgaacgtgttgacgcgcgaacgctgtcgagaagagtggctggcggttgcaacaagttccgcaggcttacgcttgcggtccttatgattgttacttccacctcctcccgtagccggcgtatccttttttggcttccaactgggacccgactgctttgatgcggtgacggcgtcttcagctttggcgtactcgttggctttttcaaacatgagcttgactgtcctgggaggcttgcgcccaaacttgccgactagttcttcgtggcgaatccctttggtgaacgcggcgatgatgacgtcgtcggtgatgtcggagatcttgttacgttgttcagaaaaccgccggatgtaatctcgaagggattctccggacttctgaatgacgttgtagagatcatattgtgtgccgggacgctcgaaggtgccttggaagttggcgatgaagtggtcgcgtagttcggcccaagatccaattgtgccacggggcaatccatggagccaagatcgggcggaatccgctaaagccactggtaaatagttcgccatggccttgttgtctcctcctgctgcgcggattgcgagaccgtagacggtgagccacgattcggggttagtggtgccgtcatacttctctattccagtcggtttgaagccggctggccaatccactcgacgcaggtcgtctgtgaaggctgctactccgtcaaggtcgtcgtcgtggcggtccggcgagtgatggtagcctcgagccgctcggcgctgtatgattgtgtcgcgaagatcgatggggcggcgacgaggtggtgagcgaggccgttccactcggtgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacactttcggagttaactgggaccgaggccgcaatcatggtcttcgtctggttcaagatgttgacgacgtggtcggatcgattgagctcgttttggttgaggagggtgtcgagaagggtgatcgcggcaaccgcattctgttgaggggtacggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgaagtcgttgtagcgagaactaaattcgtcgtactccacgatgtcagtaggacgtgagtcggcggtgggagagctgttgtagtcatccagctgatccgtcgaaaccgtgccgagtggttggaggatgacgccaacttccctgaagctaggcgaaatcggtgttgaagccgacttctgcctaggcctacgggatgaagacgctgtcgtggtggagacggccgctaagtcgtcggggagcttcatcaggactggtgggtaagtcccatcatcttggtctggtgtcgttggagaagatgcgatctcggccgagtggtttgaagccgactcggttgagatggtcttgaagtagctttcagccgcgttcgggaatccaaacccgaccgaaatccggttctctcccgactggtctgattccgagtcgaggagagaaatcttgccaaagttgttggtgatgaagtcgaggctgccgaaccgaaacgtctgcccgggagggaagacgaggtcgtcgatgccggagacggaacccattgcgctgatcggcgaaaagcttgacgctacccctacctggcgcgccaactgtcgaaactagatttcggcaataataaaagggggtggctatcaagctagaaaagtgtatgggtttggagacaaaagatttatacaggttcaggccttcttataaaagaagtaataccctactcctgtccggggatgaatccgccgagtgtattattgattgtatgattttagagaaaattaacctccgcccctagaggcgcccggaccccccttatatatgggaaggagtccgggttacaaaagataatctatatccctaacggaatacaaatacagtcgtgaccgactaaatctcaaggtgtttccttgttgtacaagttaagaaacaaacccgagatacaaataagatattctatacatattcggtatcctatatccagcccaaatagtatcgccgtgtagatatgggatatccataatctccacagctagtctctaaattcttaacttgtgtgggatgggttgttgcatgatgaatttttatgctgatggagccacttcctgagaagggggaaagtgagcgtcctcagaaaaccataacgattcaatggtgggaagctatccttgggatcacaatggatggtggacagaaccgtcgttgtttaaatataaacactggtactaaaatttgatcagtcaatgctaggtcttaggtttgtgaaaagaattacaaaacttgctttgcgcaaaagaaccatagccatcctttgaaataccccctttcatatgcattgttgctgtggtggcttgctgagtacggttggtactcacccttgcaaatataaacttaatcagaagcgggagataaagctccggaggatccctatgcctactaccaggaggaagatgaagacgatggcgctcagtaggtcttagtacggtcgttgcctgtggcaatggcatgccgctgcctaaattccgctgccttatctaattctgcttttggttgtattccggaccgcttggtctaatgatttaagacagtgcctgagggcttatgatgtaataattagcactagactctcgtgtatgtgcatttggtatttcagctatgaactcgtgtgtccagactacttgatccagggaaatggtacggtttacaccaatgattcctgttataaaaacgggggtccacacaacttcggtcagaccgcgttccgtcgatttcgagggtaacttttatttccgctaaaagttttcggtttttgggtataccaaccattcaccccccctctggttggcttagttccctcaaaactcaaaagtgcaagagtcttgtgaatgtatctttctcgaaaaagggtatatataagtcttgtgaatgtatctttctagaaaagagtgaatatataggaagggaaccaatttacctacaagaacaatttagtttgtagcatagattatctgtggggtaacacacaattggaatcccttaaaggttaattttatgacaaagaatttaagtatactttttttttcataatattagtgctcgctgcaacaataaattttgaatttgatactcaaaacttgttttgtggcactggcaaaacttcaggtttggatccagaatctgttttcttcacacttgcgataaaacactcataaaagttcaatcacattccaataaggtcaattggttcactagtgcctttttttttctcaattcgacctagatttatatataattctaataagtacataacatagactatatccaaaatattctttcatcttgtagggttccctcctagagaactgtgcatgctgatccacttccagttaataaattcatgtgccaaataaattaaaagccaataagaaaaaacgaatcagccacattaacaattcagatggtacaatttccacctttgttcctcaatcatatttctaatttaaatggatacaaaacaatgttataagtacgtactgaatatgtcggtgagatttgaaaccaatttattgccaccggatattttaatactaacaagataaataattaatagagatatttgtgtttttttcgtgtaactcaaaaggatttggcataaagtgattttaatatgtagcccgcaatcccatattttggtgtgatctaagttacactacaaatatttggtgccctcttcctgggaatattttgtggttatagttgtcataactccataggtttacatgcaaagattggttacctcacccaccataccttttgacaaaatcatatataacatcaaaaccatattacgcttgcacgagtggagctaggaatctaagatatcaaaacggaataaaccatgtgagatgattacattggtttttttttattacagtggatcaaatggaagaaaaaaaacaagcgcgcctctttagccaattcatgattttaacaagatttctcattttaaactgtacttttcttcgaccgacaagattatttgaaaatacaaatcgtattaaccgaatacaaaatatgttatcagtggcacacattgaatgaagaaaagggaagaaaatgaaggggggaagagaattgaagtaaattgatgctcctattgggaagtcatccagcctatcaaatattgcagctgatcaacttgataatgatcatagccaggttattgctaggggaggcagaaatgccccccataaaagggcaactaaaatatggaattaattcaaagcatcatttgtattctttatctcactatctggcccacacaaaaaaacacctataataactaataagccagagctgagcaagaagagaaaaaacaacacaaataattgacaataattaagattagttattttaatctgatgtgattcttgataggctaagatgccgccggcgaggtcgacgcgtgccgccaccaccaccggccgccgccggccggccagcgacggttgcgtctccgatcagctcagcactgcagcagcatctgcatctatatctgaaccttatctctgaatttctcctccagctacaacagcatcagagcgaggaagaagaagacgtggagagctctcggagcgccacgtcggcggtgaccgtgctgacttgtcaccggctgattggccggcgaccggtgacctgtccggccggtagcccattgaggattcgatgcccattgaggaggaggctgtcagtgatcgtgttgtcatttttttcatttctctaatcttgtttccttttttttactttcgttcttttttctgaataaattctctgctcttcgcgtggtaaattaaactgcacgtgtagctttttttttcttttttggttcttgttttgatagaactgcacgtgtaggtgtagcttgtatttttcttttccgaatatattcatgtgtaacgttagtaagaagtggtactactagagaaatcgatattaataacggttgtgggtttatatgtgtgcatctactttctagcttagcaaagtcgacggtgcacaagcactgttgctgccaagggcaaatcctcttttgctatatgagttatataacccattagatgcaattactattacaaacaacatcatcaagtaaacaagctaatcacttctttctataaagttaaggccaaacgctcaaatctcgtgctttcacgtcatcatcaaattgtgaaccgttagatgaatgtattagattgcttctcagacgttg

SEQ ID NO: 40321 - DNA, 2138 bp, Oryza sativa
  unsure (1)..(2138): unsure at all n locations
agtgctaaaggtacgatcttttacataaaaagttcatgcgatatanaaagtttatattatgcaattatttgtatttaaaacatattacttttataaatattgttggtcaaagtagtatatcgaaactacgttgaagtctaaaaatacttatattttgggatggagggagtagtgccaacctaaaaaattataccgatcgatctaagaagggctgtcagagattcatccatatcaccaagagtaaacgttttattctcagtaaaatttttacttattgttgaatttgggagtaaaatttttaccattgatgacatggataaatatcaagcattcattttttttaatctaacgatagtttccactacatatgtgatttctactaaataatttttccgactataggagcctccactgaaccctcttgaaaccatacatccatggcaaaaggggctagagctttatctagtttgtccagtctcccatgatatttctttttgtattcgccaacgcaaccacttagggcgataaatataagtgtgtccatgtacaagagggcagagaattatagaatgtacaaattacaaaaatcaagttaatgttttcagccaacaatcagagctctcaaatctactcccttaatatttgtccatctccatttcacacaaaaaaaaatctggcctgttaaaatgactactcaaattgtggtatcaattcatgaaatggtcctgaaaaaatgttcctaaagaagtgaattcgtcatgaaaaagttcctttcttgcttggattcaaaggttgccaaattccctgttgcattcaactcatgaagaacattatcgatcatcaacttggagaaagatactaataatgtttgggtacgtgcatcacatcctcatagattttccgtatttttccgctacatattcctagtttgaacttatatatttgcggctatggttttaacatgaatggtgtcattttctccatagctgttggatttagattcgaactaatctcatcttcatgcattgggaactagtgtttgtgcctaaattgtgaagaaagtgagacagttctgaccctctctaggaattcaacgaaggaacattatatatcttgtgatctcccttttggtttaggttaggaccaccatgaatggatgcaagggagttgtgcatagctaatgaggctggaataacaagttagctagagtttgatcctggcacacaaatcaagtgttgcttctctccaagcaacaataagcagacatattcctttttcttcctccatagggttccatgattgtaattgtaccctacctcatctgtgagagtgataccaaaatctctctctcttccttgttttgtctacccattaatctcctgatcttgaagcttttaagggtttttttttaactcaggtaatagatattaggtttttccaccacggaccgttatgcattgcttgcaatgagggaatccacatatttctgcagcacttgaatggtttcaattaaattcttacaaaattgcatccaaattagcaaggttcaaacaatttggagatactctctccgtatttagatatatgatattgttggtttgtattacgtggaacttttgaaactttaataagtaataatcattcatagctctcaaaaatatttagtttgaaaacataaaaatcatatgggtacatttttcaatactataatattattttttttgtgagataatatcattatattctaacagtaaatagtggtcaaagttgcacacaagaccaaataaaattaacagtatcgtatatttaaataaagagaagtgcgtacagtgtctgtatatttaaatacggaggtagtacataccaattgatagattgttctccatctacttgagctacatagacagggacaagcaaagatagtactgtttgtgtttggtttaaaactctggtggtactgtttgtacatgtgttctctttcattcttgcctttagattctctgtgatgctactttaatttgataattcgtacgtttcatattataagactttctaccattgcccatattcatatatatggtaatgaatttagacatatatgcgtacctagatttattaacatacagggctgcaggaat

SEQ ID NO: 40322 - DNA, 1123 bp, Oryza sativa
tttgtaatatttatttacgctttttaattcgtagtttattttgaaatatttagttttgaattattaagagtcccatcgattgacctaataagctaaaataaaagccaaaatttatatttctggatttgattctaaagttgattttaaaagtaatttatttttagcattggcttttaagccactatgaacaaatatataaaagttttacctataaattaaattttattcttttattcctaaataaaccgttttgacttattaggtaatatgagcaaccgatgaggctctaaattatttttttaagttacttataagcaatgtgaatatgataggtaaaccttttatatatatttttaagttacttataaaccaaatgatatggctgatcagccagccgctgtcagcattccaaacgtgtctgtgttcttatcacagttttcccaactcctctctctcgttatccacgcgcacgcttttcaaactactaaatggtgtattttttagaaaaattttctatacaaaagttgttttaaaaaaatcatattgatttatttttttttaaaaaaatagctaatacttaattaatcacgactgcttcgtttttcgtaccagagagggagagttcccaaccagaaggtgcgaacacacccaaatcagtgccacgagatacacataatttttataaagataccgagaggataaaagcgtagtcacgagtataaaccaacgttttgacttgataaccatacgcacgcaatagtgcacgtatgatgatccaacgccatcaacctttttctattttttcccccctttctttccagataccgttacactacaccctggttgatgatactatattctactagttgtgtcatatgtcaccacatagctagtactattaatactgtgttggtaggctctatatttttattgtttgcaatcctggtacgctttgaagtgtattttagatattgtttttgaaagacttgaaagacattataaaaagaaataaatttggtgtcaaatcgttgagcaagagtaaacttatgagcatagaatagattatctctcaaataaaaataaaatcttgggtgtacggagtatatcgataccttccaaacta

SEQ ID NO: 40323 - DNA, 707 bp, Oryza sativa
ttcctgcagccctgaagcaaataaacaaagagaagtctgctctactggccctgccccgcgccgcgttcacgcttggtcctccgggcctgtgctcacacgtggtcctgggagtaggtgaaatgatccggtggcacagcacgggtagcacgagtgtctggcggtggagtggcctgcgcctggtcctgcgtctgcaccggcggtgcgcctcccagctgtgaggggccgatgacgtcctctgtcgagcctgaagcgaagtcgaagtcagtgatgtcgaagagtaaggcggaagccaccaagtggtccgacgaggtcccaacatggtccaatggtggaccctgactcgacgtgccggctgcctgtgacgaagtcccggtgtactgctcgacttgcaagcgttcgataaaatgttaggcaccttaccttacgactaaatatgtagtacgcttgtcatctcggtacaaaaacactcacggtgaactgaagcagccacctcttcgtaggtccggtgttgcggtggtgtgccaacggctggagcgggagatgtggtgcgcgctgtactggtgcgaaacatgctgttagatcgtccttccagtccacacccgtggtcactggcccaacagcgtctcccgcgagcggtagccccaacaagtacgatacgtcctgtaggataggggctacttcaccgcacagcaagtgaaaagtgtgcg

SEQ ID NO: 40324 - DNA, 1244 bp, Oryza sativa
atatgcgtgctgcatatatgcaaatatacatccacatcattaattttcttaattttcttgatactaattagagattatttttgtctcttcgcatgtactggtggagccaccgccaaattcgccgtggtttccatagaacacgtcggacgatgccgccgcagattagtgtcctcgactgcatggttggttggtcacaccaccgttgttgggcgtctacatcttcaccactggtctgcctttgtcgccgccgactggtatctccgcctacacggttggttggttacagcaccgttgttgggcttctacattctcaccgccggcctgtctccgtcgccgccgactggtgtatccgcctacaaggctagcctgttatgccgccgttgttgggcgtctacgacctcaccaccggcctgcctctgtcgccgccgactggtgtcctcgcttatatggttggttgatcacaccaccgttcatgggcgttcacgtcttcaccgaccggctcgccttcgtcgccgccgactggtgtctccgcatacacggctggcctattatgccgccgttggtgggcgtcttcgctttcaccgtcgaccgcctccgtcgccgccgactggtgtcctcgcctatacggttggttggtcacaccaccgttcatgagcgtctacgtcttcactgaccggcatgcctttgccgccgccgactggtgtctctgcctacacggctggcctattatgccgccgttggtgggcatcttcgctttcaccatcgactgccgactggtgtcctcgcctatacggttggttggtcacaccaccgttcatgggcgtttacgtcttcaccgaccggcttgcctttgccgccgccgactggtgtctctgcctacacggctggcctattatgccgccgttggtgggcatcttcgctttcaccgtcgaccgccttcgtcgtcgccgactggtgtcttcattgttattgatggatgactttattcctacattggctacctctgccatcaccaaggggaatattacaaagataagtcatcattaattttctttatatgatattttccttttcctctgcctcactacatcaactggtttgccgttgactagtgagtcggggactacatatattatatcatatttttcaacaattttcataatatttatcttgatggcgtgtgaaataatctgagtacaaaagtacctatcgagttatggagtacatcttcctatgctttccgt

SEQ ID NO: 40325 - DNA, 1321 bp, Oryza sativa
acgggcgcgcggcgcggtgacgggacggttgcacggcggtaggcgggcgtgcggcgcggcgacagcgtggcagcggcggcgcggggcgcaaggcggcggcacggggctcgaggcggcggcacggggcgcgaggccgacggtgacgatggcgacggcgatggcgcgcggcgcgtgatgacggcgacgcgacggcgacgcggcgcggcagcggctacgcgatggacgggctcggggcggctaggggcagaggtgggagaggagggggaaggttagggaccacatcgaacaccttaggcgcaatgacagtgacttttcctatttatcccgattttagtgtattttccatctaaatttgattccacaattcctaattttacatatatgcattttactcaatattcgtgttatcttaactaatgaattcaccctagattaatattactcatattttatttttatataatttatttgagttttaattagggttaattcttattccatcgcaatgaaatttaattgatccaaatatggtcgcgataatattttatttattactatccacacctaatctttatttttaatttatatttattttaccaatttgtttttaaggtttatttctaattaactattctttactcacgattaataatcttcgagatcaactccagataaaatagaccaataagatcggcatgatgcaattagtttaaaaaagtttttgaaaatccgtatttttagagttttggttttgtcggtcgaattttcagggtgttacacggcgtcagaccagtcacagaccggtcattcttgtccaccacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgtggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcccgacccctcccgaggggtcaggc

SEQ ID NO: 40326 - DNA, 723 bp, Oryza sativa
gggctcgttggatggaccgagtaacgcaaggtgctaagtattactcggaataaatcaaaagcatagagataaaataatttattttctgctcttaacaattgcaaaagtacccgagtagtaaactccgatccgtgaaactttgttccattaatgacgaactcatgtcactcatatgcatatttgggaagtgcctaggccgactcccggtgcttgggggctataactagtcgggcagagtgtttaaacgtaaggagtcatctgctcggggaaaccaaaattaacaagaggagaaatacatatttgtaaacattttaaaatacttgaattttcctcgagtattatatttacattagatactactcatcctatatgtttgttctgcagaatccagatccagatatgcataataggaattcatggctttaagcctatctcctacgcttcaggaatggatcagtcagaacatcaccatcggctcgccttcgccgccgctgactggtgccctcgcctatacggttggttggtcacaccaccgttgttgggcgtctacgtcttcaccgaccggctcgccttcgccaccaccgaccggtgtctctgcctgcacggctggcctattatgccaccgttgttgggcatctacgtcttcaccgaccggctgccttcgctaccaccgactggtgccctcgcctatacggttggttggtcacaccaccgttgttgggc

SEQ ID NO: 40327 - DNA, 1396 bp, Oryza sativa
atatgcatatataatatatgcatattatatttatatatgtttcaatacatatgtacatgcataatatatatgtatttatacatatatatgttatgcaaatgcatatgtgtgtgtatatatatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagctaaggacctatgaattgtgtttccgtcgtagtagaattcacccttgggatcaaggatttgttcgttgatgaatcccatgagttgttcttgaaccgccgcgataaattccttgtgtgtggtcaggttatctctcatgcgaataaactatatgaatgtatgaaattgattagtaattaaacaagaaatcgatacgtaatgaaattttgaatttatttgtatgtacatcgagctctcttgtggtgatgatttggtctacaagacagtggcaatactcgcacacgtaatagccgcacaagttagttccctgcttttgctttgcgcactacaaataaatgacaaacaacgagagatctaattaatatacacttgtatgcatttgaatcggagaaatataaatgtagagcatgtgtactcacaggaaatttgaacttccgcctaagtctttctctccatttgccgcggaccaaatgacggaactgataccaagccttacatggagtttaaagctatgattcgtagtagcaattaacataacaagattttcttaattaacagaggaacttatgacggtacctatctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttgatataggaagacagtaaaattaaactaactctgtgttgtacggcaacagtatgaacgtcttgtaatgctgcaccttcaggagatggacgagattgtcctctgtggcttgcagatattggtcgagcattgcgacgtttactttccgagggtcaatgaatccagtatcgaaaaccccccgccgtcgggccctttgaatctctattctacaacgataaaagggagtatattattttctatagtctacttatatacaaggacctaattaattaaaggagacgtagtaagaaatctaactgaacgatatacttacaaaatccagcaactcataatagagacgtcgagggcgtctagctggtatagttcgtagattcccttgaaa

SEQ ID NO: 40328 - DNA, 726 bp, Oryza sativa
tccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattatgtcacttgcctgggcgaattcctttgagggctagctctaccactccggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgcttcattcacctacgtttgttcgttcacgttcattcacctgcctataattgcatttcacgttcacgtttgttcacgttcgttcgctcgttcatgttatcgttcatgttcgttcgctcgttctcattcacgttcgttggctcgttcacgttcattcaccttgttctcgttcaagttcgttcgctcgttcacgttctcggtgtggcggcagcagagcggcggcggggcggcgcggcggcggcgtggcaccgcgcgcggcatcgggccggcgcgtggcgcggcggcgtggcgccgcgcgcggcatcggcttggcgcggtggcggcgtgcggcgcgcggcgcggtgccgtcgtggcgctacacccggtggcggcgcgttgcgcg

SEQ ID NO: 40329 - DNA, 14930 bp, Oryza sativa
  unsure (1)..(14930): unsure at all n locations
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcattaggcctcatttcgccttgttctgccgcatcttcttcctcaagccccagccaaataagagcaaaccatgcgtcgttgggggtgctggtttccaactcaggggaacactaagccaaaaatacttctccatgcccttcaagacctcaaataaaggctggcacgcaaactggttttatgttcaaaaccccgagcctattcttcccgagtactcctgtcttcctccagtttatcgggatacttggaactcactaccaatgggagatgaagctgcacaagcagtagaactgatggagaggatgataaagctgaaagagcagggccttcaaggagaacagatcacccgacactttatcaagtgtcggttagctccaatcaaagaaagatctcgcacagccttcgaatttgacggcaagcatgacccaaaccgtgaagatccagattctcttgacttcaagttcatgaaggaaaggatgtataagatcttctcaaacgccatcgttgtcagctactcacacttgctgccagtcataccgttcaatgcattcaatcctcctccaccggtacgtaatcatacacttcaacctttctcaaaatatgatcttgttttcttgttgaatcagttaacaatgaaggatattacacccaggaatttgctttgatgaagtcggatcccccaatcgctcaacgccgatctccccgccatcaaactgggcaagggagcagaggaccaagaattcggtctgaaactcaaccaagtgcttctgatccagtcagccaatcagattctcgaaagaggaagttggttctaagtgacgacgaagccgatgataccaccaggagacctggagaccgagagacaaccaagaaactaccaaaacaggctactccaaggaagaaaacatccagtcgccctgtgccaaagatcaggaagtcttctaagtgcaactcatataatgatctctcttgcattgatgcgcacccattgcggcaataatactgataatcaaatttgcaggaaaccgtctgatatagatccatctgggaaagactctgacccgactaacacagacacaagttcttccaaagaaaccgggccaactgctaggaatcatccgagtgacaatcagccggcaaccgataatgtagaatccggtgatcaacccccgactagaaaccagtcggccgaagccaaagccggagttaatcaagagcccccgactagaaaccagtcggacgtagggccaagccaagagatttcagaagtcgaaacccaagcagacagccctcgcggacaaaacgccagcaataaccagagatctggatctcctttaaaggcatccgaatccactcgtcctcgtccaggaattattacgggtaaacactttgtctgaaaccatgttgacccaaataactctgatcaattgtctaacctttgtcagtgaatacattaggaccaatgattggtgatgaagaagaaatccccgtatacgagcagccgaagattcgtgccctcccattctggtcaagtggtgggatgacaacttgcaacctcaaggaattgtaataaaccggcaaaaagaagacgaagaggtatgcctactgaaaaaggcactcaaccaagcgactcgcattgtaaatgtaagtcccttgacgcctgacctcagccatctcgtttgccgtctggcccgagcgctgataaaactgctccacagaggattcatcttaggaacgaggtgaaaaccgcaaccctagagagactagttccgcatcttggaaccctcgaggccaccaagagtcaactgcacgaggccagagaacttgccaagaagaatgaacatgatctgagggatcggattgctgagcttcaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaagcagatccaaactctggaaaatgacaaggttgagctggcaagacagagggattcggctttaaaggaggttgaaggtaccaataatcgacacttcaaaagccattatcttctatatactgattcattaatgtgaatctgttgatgtagaccgcaagatcaagtctcaagcacagtttgatgtcttagttgacaagatcaacaagcttgaaggagccagggataaagtcgctaatgctactactccactcatctaggccatgttcttcaataacgccggttcgagtacacttgatgctaccgaaatcttcgacaagctgagagtcgctccagatacttatttcaagaacatcaaagatgctggaagtatgggagcaagtctggcgttggcgatgaccaaatccctttatccaagggttgatatggatgccattgatggctttgcagacgggacgagcgaagaagctgctcttgacctcatcagtgatgcgcaaaaagctgctgacaagattgctgctgatgtagttgagagattccaagatgtcgaccttgggccgactgggtctgataagtctgacgatgaaaaaactgatactgattgatgtaacaatgattttgatgatcaatgacagtggaggctcaatttgtacaatactgatgaatttatgctatgcttggtgttccatacttagcttctgatttcttaaaagcctttgttaagccttattgagcctaaaacccgcaaaagctattaaaaaccttcagtccttattggctaagtcgaaagaccaaacagggcaatgataaatcaagtaagcaaattgaattgataaaaatcacactccattattatcatagtagctccctgactgaaaacttcaaggaaaaacttgaagttagcagtcaaagaggaaagatacaaacgaaatgcctaagcgtaaaatcgacgaaggtgttcaatattccaataattgttgatgagagtaccgtcttcgcgcttgagtcgataagaacccggccgagtgacttcagcaattatgaacggtccttcccataagggagataatttatgccgatcctgtgttgtttgaattttcctcagaaccaggtcgccgactaaaaaggctcgcaatcgaacatttcgattatgataacggcgcaacccttgcaatcgagtcgactgaattaaagctgcttctcgagcttcttctagtcgattgatgtcgtctactcggccttcttcataaccctcctcgttgaagttctgaaatcgtagtgattccaattccacttcactcggcaacattgcttctgcgccataaaccaaaaagaacggcaactggccggtagcccgactaggagtagtgtgtaaataccaaagtacggatggcagctgatctacccacttgccagtgtagggatgtagtcggtcaaaaactcgtgctttgatcccttgaagtatcatgccgttagcgcgttcgacttgtccgttactcatggggtgtgccacggaggcgtaacaaattttaatgccgaagtcttcacaaaagtctttaaatgctccgccagtgaattgagtgccattatcagtgatgatccaattaggtaccccaaaccgatgcacgatgttaatgaaaaaatctctagctttatctgctgtgatcgtgatgaccggtttagcctcaatccacttggagaatttgtcgatagtcacaaagagatgcgtgtaaccgccgactgcccttttaaacgggccgaccatgtcaagcccccagaccgcaaacggccaggacaacgggatggtttgcaactcttgggctggcagatgaatttgtctggcaaaaaattgacaaccttcgcatatccgtacaatcttgtcagcatcagacacagctgtaggccagaaaaaaccttgccggtaagctttgccgacaatggtccgtgcggcggcatgattaccacaaataccagaatgtatatccttcaacaattgtctcccttcttccaaagacacgcagcgctgcagtattcctgatggacttttcttgtacaactcagcctcatgaataatgtaaagtctgctgcgtctggaaatccgctcggcttcatttttgtcttgagggagttcttgtttagtcaaaaattttatgagaggttctctccagtcggtttcgatcatgcttacgccttgagtatccatggcttcaattgtttcttttttgggtacggttggttcgtaaagatgttctacgaacacatcagaaggggctgcttcccgttttgaaccaaatttggccagcctgttggctgcctcattgttatgtcggaggacatgggtgagctcgagtccgtcgaatttatctttcaacttgcgtacctcttgtcgataagcggtcatattatcatttaggtatgaccactctttcatgacttgattaacaaccaactgagagtctccacggacgattaattggcgaatgcctagagagatggcaatccttagtccatggagtagcgcctcgtattccgccatgttatgggacgcagaaaaatgtatccacaatacgtagctcaatcattctccagtcggggaaatcaagacgaccccagctccagtgtctataagcctcttcgacccatcaaaatgcatagtccaatgttccatcttttcctctggcatatcttcttggcactcggtccactcggcaaagaaatcagctaaagcttgtgacttgatcgaagttcgtggcttgaacgatatgtccaaagacatcaactctaaggcccacttcgcaatccgtccgtttgcttcgcggttatgaagtatatccccgagtggaaacgatgtgaccaccgtgaccgagtgactttgaaagtagtgagataatttcctgacggtaattaagacaccatataataacttttgaacctgaggatatcttgtcttggagtcggctaaaacctcgctaacgaaataaattggtcgttggactttttgaatatggccttcctcttcgcgctcgacaaccaggaccgtactcacaacctgggaggttgccgacacatataacagtagcggctcttgtggacgtggtgaggccaaaactggtggagtggtgagaagtttcttgaagtcttcaaaggctttttttgcttcgggtccccactgaaaattgtcagtcttcttcagcagcttgaagaagggcatcccccactcgccgagtcgtgaaatgaaccggctgagcgccgccatgcaaccagtcagtttttggacgtctttttgggagcttggcggtttcatgttgaggatggcgttgattttctccgggttggcctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggttgctcctgcgttcttcaatccaaatggcatggtgatgtagcagtaggccccaaagggcgtaataaacgaggtcttcaagcagtcggattcttttagtcggatctgatgatatcctgagtaacagtccaagaagctgagtaactcacagccggccgttgagtcaaccacctggtcaatgcgaggtaacccaaaagggtctttgggacaagatttgttgaggtcggtataatcgacacacatgcgccattgccccgtctttttccgaaccaggactgggttagccagccagtcgggatgaaggacttccttaatgaagcctgctgctaacagcttggttaactcctccttgatcgcatccttcctgtcctgtgcaaaacggcggagtcgttgcttgatgggtttggcgtcttccttaacatgtaaagagtgctcaatcacctctcttgggataccagacatatcggatggtttccacgcgaaaatatctttattattctgaagaaaggtgatgagcgcgctttcctatttacaatctaactcagcgcctattacagcagtcttatcaggatcggagggatctaagggaatctttttcgtcttggcatcactttcttcgttcttcgtcagcttggttgcaggcacttctccctcacttgccgtggtcgcagccagtcggatctcttcgcgggcgagagtagtctcgtgagtttgggccatctcgcaactttctttgtcacatgtgacggcctgcttgatgtcgctccgtagtgatatgactcctcgaggaccatgcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaattggaagagtgatctggctgagtggtgtagctgacaatcctgggataacaccgtggaagggtgcattacttggctttaattccatgcgaggaatctgcatatcgtccaaggtcttagcaaaaaggatgttgagtgcgctgccaccatcgatgagagtccgtcggagcttgacattgcgaaccactgggtctagtaccagggggtaccgccccgggtggaccactcggtcgggatgatccgagcggtcgaatttaattgctatctctgaccaccgaagatattggggcgtattaggctgaaccgcattgatctcccgttctgttagcttctattttctcttagactcataagctaggggtccgctgaagttgtgattaagttctttgcgatgatcttgaaaaccagtcggggcattgtcttcatcatctttcttctttgatgtgccttgatcttcgtttgaaggtttacgtgcgttcttgacgtattgctccgcgaactgtttgtagacgaagcaatctttggccacgtggttggaattgggatgatgcggacattgggagttcattatcttgtcgaaggtgttgacgcgggaacgttgtcgggaagatggagaggtggtcgccacaagttcttcgggcttacgcttgcgatcattgttgttgttacttccactccctcctgcggtcggcgtatccttctttggcttccaagtggtgcccgactgtttggacgcggtaatagcatcttcggctttggcatactcgttggctttttcgaacatctgcttaaccgtcctgggaggtttacgtccgaacttgccgactaggtcctcgtggcgaatgcctttagtgaaggcggcgatgatgacgtcgtcggtgatgtcggagatcttgttgcattgttcggagaagcgtcggatgtaatctcgaagggattctccagacttctgaacgatgttgtagagatcaaactgtgtgccggggcgttcaaaggtaccctggaagttggcgatgaagtgatcacgaagttccgcccatgatccgatcgtgccacggggtaggccgtgaagccaggatcgggcggaatccgctagggccacaggcaaatagtttgccatggccttgctgtctcctcctgctgcgcggattgcaagtccgtagacgatgagccaagactccggattagtggtgccgtcgtacttctcgattccagtcggcttaaaaccggctggccaatccactcgacgcaggtcattagtgaaggcagctactccatccacgtcgtcgtcatagcgatttggtgaatggcggtgacctcgtgctgcacggcgctggttgatcgtgtcgcgaaggtcgacgggacgctagtgaggtggagagcgaggccgttcgactcggcgctccctgtgacgtttgggaggcgagtgaacagatcgtttgttgtgacccctgctcctgcgactagatattgtgccgatgatgctgaggcttggctaatgataatcatgagatcggaggtgagggactcggctaccagtcggggtacgggtgcttgcagagttggctggaaccgaggcagcgatcatggtcttcgtctggttcaagatgttgacaacatgatcggcttggttgagtgcatcttccttgaggagggtgtcgaggagagtgattgctgcaaccgcgttctgctggggggtgcgaaagaccgctgttccatcgacgtcttgttgcccaatgagctctcttgctcggcgcccagattccaaggcgcgctgtcgtcgatcttcagcctcctttgcaatccgttcgcgatcctgttgctcacgctgtagtcgttctcgctcttgtcgctgtcgctcttcctctagtcggcgacgttcagcttcttgccgtgcgcgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaagtcatcgtagtcgaggatcttggttggtcgagaactgacgccgggggagctgaggtagccatccaactcttccgtcgagactgtcccaagaggttggagtataacgccaacctccctagatctagatcggatcagggccgaagctggagctcgcctagatcttcgagtgggagatgtcttgactgtgaagacagcggccaaatcatcaggaagtttcatcaggattgggggataggacccgtcatcttgatctgatcgcggaagagtagattggatctcgtccgagtggtttgaagccgactcgggagagatgatcttggagtaggcctcgggcgagttcggaataccgaatggcacggggacctggtctctccccgactggtttgaatccgagtcaaggagagagatcttgccgaagtcattggtgatgaagttgaagctgccgaaccggaacgcctgcccggggggaaggcgaagtcgtcgatgccagaaacgaaacccatcgcacttagtcggcgagaatttgacgctacccctacctggcgcgccaacggtcgaaacaagatttcggcaataataaaagggggtggctatcaagcttggaaagtggatgggtttggagacgaaggatttttatacaggttcaggccttcttattcaagaagtaataccctactcctgtccggggatgattccgccgagtgtgttattgattgtataaactggaaaaaagaatcgccccaagaggaacccggacccctccttatataggggaagggatccgtattacaaagtacagtccatatcctaacggaatatgggattacagataaaatacaatcgtaaccgactaggatcccgggtattttcttgacatacaagtttagaatctaacccgagtcctcataaagatattctatctatatttggtaccgtatatccagctggaatataaccgccatgtagatatggggtaaccataatctccacagtcggtttgttaagcacacttaatttttcgtacacaactataagtttagattggacaattttgtgcaccggttcgatctgcgtccctttccccggatttatatccttggtaggagaacaaaccctaataatcaaggcagtggatggcctaatcatcttgcagactaacaggttccttctgacatataagaactggctcagcccttgattagttcccaactttttcttcaaacttctaacttttccatcacgtcaaaactttcctacacacataaactttcaacttttttcttcaaactttcaattttggcatggaactaaacacaccctcactggaaaaagattctaatcactcgagcaaatttcattatttactgtattccaactaaataattattatgaaaaaaataaaaaaaaaagataaggtagataccaaacagacataccagttctaatttaatttgtacaagttgtaaaaaacaactattaaactctaaatagtatttttatattcacaatcaattttccaattgagtgattttaggtacaagtcctagacttatcacgagcgctcacatttacaactaattattttttcagtggtaagtgatgtatctgttgatagcgaggcgcttatggtgatttcgtaaatcttaatatatgctggtccagtcttccgaagttgataataagggtaggatgtacgtgtatgcgttgggatcagtatacgcgcattttgagtgtctgcatttgcaccaagtttgaaaaaaaaagagtttgcctaggctcacagcacaggacacatgcattcctatctgtatgtgatcccgtggtgcctgatctgattgcgacgctggagaaagggacagcatgctaacttattaagcatgcacgtcagcacgtgtaacaaacgccgttgataaaatagatgtggtggtgttcacccaatattatatatggtttgattgactaaaagtaagtttaatagtatagcctactgctagtagtttcaaatcatctatagccaatgtaatagataattcatacaatagttgcttactatatacaattagtacatggtcccacttgtcatacacacattacgtcttgaagtccgtgctgcagttggctatagatttgtagcccgctactattctctctcattttttctctcattaaaatatgtttacagctggttaatagcctgctattgtacacactctaagagaactaaaagtaaaataataggcaaatatgaatggtgtggtgttgtgggagcatgcagcatgctaccacctattacaatttaaaatcctgatgtacctaataatgttatgtatatgtgaacgtaattttaatataattttattgaggctagggaatttgttgttgatctctgtctctaaggacgtgcgagatattcgtggttgcaaaacaaagtggtggtcaatctatactattgcatcaatttaaaactcgtaaagtattattattgataaagatatagatctaaatatatatatatatatatattacatgatgtcgtcagtcttgtcaactgctgtgtgaatcacctattagagggtaaggtattgtagaactgctgtttgtagctgtattgtgatgacgtgggaataaattttaaactctccgtctcattgttgtttacatgtcgtctaaatagttacgacaaaatttaacaaaattaacatggtaaattaatatgatatatatcactctacagatatacaattcaaaatttaacttctataagttgtaacaaaaagagctaatgaaactatagcaagttaatgtgtattcacaatttaaacttgtatatttgttgaatgatatatcacatgcatatttattctttttcttaacttgaatacgttgaatttaaatatgtacgtacgtttgttgagtaatgtatcacatatcagtgagatcttacctaataatataggcgccgttgttttgccttaattagccagatctaatccactgttcatctgatgtagcagacatgacatagcataaattgcacatgatcggacactatctttgcctgcttgctttgctacaatacagcctgcctgagcagtgtatcacactgtcgtctgtcgtcgtcgtgccgctgatcaatttggccaaagcaatggcgatggcgagcgcgaacgtcctcctcctccccgaggccggctccggccacctcatgtcgctgatcgaggccggcaagcggctgctcgctcacggcggccggggcgacggcgagggccccgcggtgaccgtcaccgtgctggtcgtccgcccggcgacgtccgagtcggccgccgaggtcgacgcgcacgtcgggcgcgtcgaggcatccgggctcggcgtccggttccaccgcctccccgccgtcgagccgccgccgatgggctgcgccgccggcaacgtgcaggagttcaagtcgcggtacatgcagctgcaggcgccccacgtgagggctgcggcggcggagctgggcgccgcggcgctcgtcgtcgacttcttcgccaccggcgtgctcgacgcggcccgcgaggccggcgtcccgacgtacgtgtacttcacgtccaccgccgcgttgctcgcgctgatgctgcggctgccggcgctggaggaggaggtccccgtcgacttcgaggagttcgacggcacggtcgacgtccccgggttgccgccggtgcccgctggttcccttcccgcgttcatgggacgcaaggagagcccgaacttcaagtggttcctctaccacggccgccgcttcatggacgccgacggcatcatcatcaacacagtggccgagcttgagccggccctcctcgccgcgatcgccgacggccgttgcgtgccgggacgaacggcgccgccgctgtacccgatcggcccggtgctcgacctcgaggacaagccgtcgtcgaacgctcgctgcgtccggtggctcgacgcgcagccgccggcgtcggtgctgttcctctgcttcgggagcatgggctggttcgacgccgcgaaggcgcgcgaggtcgccgcggggctcgagcgcagcggccaccgcttcctgtgggcgctgcgtggcccgcccgccgccggcacggtgcacccgacggacgcgagcctcgacgagctcctcccggagtggttcctggagaggaccaaggggagggggctcgtgtggccgacgtgggcgccgcagaaggagatcctcgcccacgccgccatcggcagcttcgtgacgcactgcgggtggaactcgacgctggagagcctgtggcacggcgtgccgctggtgccgtggccgctgtacgcggagcagcgcctgaacgcgttcgagctggtgcgcgacatgggcgtggccgtgccgctcggggtggacgggaagcggcgggacagcttcgtggaggcggcggagctggagcgcgcggtgaggtcgctgatggacgacgcgtcggaggtggggaggaaggtgagggagaaggcggcggagatgaaggccgtgtgccggaacgccgtggcgccgggcggcggctcgtcgtacgccgcgttgcagaggctgctcggggcaattcgcggcggcttctcgactatgacccagtgacgtgcagccgcggcgtgcgtgcggctggtttgagtgtgagtgtgagtgttcgtcgtcactaccgctaaatttttatttgatggatccaacggtcagggtgcagtcctcgatcggccgccttgaactaatttgccagctttgatctgattttggctgttatgttacactgtaatcagtagccgaaaatgtctgccagttcatggtgagcggatcgcattagctcactgtgaattcttttttttgctttacactgttttctgttgaacaagacacgacaaaacattgtaatgttggaattagttgtaccaaaatttggacttgataaatataagttgtactccctccgtcccaaaataaatgtagttttgcactattcacgtttaacgtttgaccgttcgtcttatttaaaaattttttaagattagtatttttattgctattagatgataaaacataatagtactttatgtgtgactaaatatttttaaatttttcaaaaattttttaaataagacggacggttaaatgttgggcacggatattcacggctacccttattttaggacggaggtagtatatgcctgctgaattctttcttattttattcgcacgaactgtaatgtactaattggggttgccaagattgatgcatcggattgaacgaccctgaccacaaaatctaaagcaaaatatggtcctgtcttgtcccgacgggtcctcaaatccctgtcgagggaatgtaagatcgaggtcactgcatccgtccaaagcgcaactaattttgggtgtcacatctgtttgatcggacgttggaagaagttttcggatacgaatgaaaaaactaatcgtgccaatcccagtgtggtgagttccgggacatgggtcatctcgacaaacaaatccaatatggcacatccactcactcacccacccacgatcccttcgtgggtcgacccatcctgtctgttcttgctcttctcattgttcgcgaagcagcaatgatgtgaagtcagacaattcataattataatagatcaatacagcaaaaaaaaatcatcacagattagccatacgaaacgatatttatcgtgtgtactacgcgtataagctgtggaatcttgtatatagtggtttgatggatatatgggtcgagccagcggatcaacatgggtcgattaggttgacccacgatgtttttgcttcatgttttgtggatgcaataagtacaccagaggtccctcaatttaacagcgagatttttttagtccatcaaccacaaaaccagaaatgttcacccctaaactcactcaaaccgttcgaaaaagatcccatgccagtatttgcgcccggttttgctgacgtggcatcctagtcagcaataaaaataaaaataataaatatgtggggcccacatgtaagtgagagaaaatggtgtagaccccacatctctccttcttttctttttctcttctcttctctccttctctcgagca

SEQ ID NO: 40330 - DNA, 16675 bp, Oryza sativa
taagccccaattggccaatcccctacaccgttgtctcctttctgccccgccagtgtccacaacctctcgtagcaagcccgaaacacctccggcggcggcatggcgtcaaactactcctccaggttgtccggctccaccgtgtcggcctgcgacaaccgcgtatctatgccggcggggccgcgcggctggaaccggttgtaccagatgccaaagaggaagacgtagagctacgccgtgggcacgaccagctccggttaccagacgaggatgaggtagaggacgtggacaagaacggtggtggaacggtgtggacccccgtttttataacaggaatcaatcgtgtaaacagtaccatttccctggatcaagtagtctggtacacacgaattcatagctgaaataccaaatgcacatacacgagagtctagtacgaattattacatcataagcccgcaggcacagtcttaaatcatcagaccgagcggtccggaatacattcaaaaaacagaagtaggtaaggcagtggagttaaggcagcggcacgccattgccacaggcaacgaccgtaattaagacctactgagcgccatcgtcttcatcaccctcctggtaataggcatagggatcctccgaagcttcatctccggcctctgattaagtttatatttgcaagggtgagtaccaactgtactcagcaagccaccacagcaacaatgcatatgacaggggtattcaaaggatggctatggttcttttgcgcaaagcaagttttgtaattctttccacaaacctaagacctagcacagactgatcaacttttagtaccagtgttcatatcaaacaatgacggttttgtccaccatccattgtgatcccaaggatagcttcccgccattgagtcatcatggttttctgaggacgtccacattcccgcctctcaggaagtggctccatcagtatagaaatcatcatgcaatatcccatcccacacaagttaagaatttagagtctagccaagtgtaatacatgtcccggtgctcagtaactacgggcacggctattcgaatagatttggtttactcacactgcagtggatgtacactttacccgtactccgcgactgcccaacacatgagcctcgtcccaacacatgagacgcgccacggcaaagcttttcgataacctcgcattggcagtacccgctccatgaactttacatcctcatgcactctaggcgtacatggtttctagcagtgagaggagttctggcgcacccgggaagggaagactcacacatgcattaagttataattatgtttagattctcacatggcagtcctaccgatggcgacaccactgtagacacccgcctcgcagtcctaccaatggctgccccaccgtagagcccctacctcacacatcaagaaaccactatgtatggatactgcctccgctcagctatctattccgctaggtctatacccatacgagaagtgcggttgtacgggggtcgtttcatgcttaacttcatggctcggtccttaattgaccggggacggtactagccttttccggataccacccaaatcctccatccgccccagtcgaaaacagttgtttaattttatttctcctttcataaatcatgtcatcaacatcatggcaatgtggcgctcatgtctccacatgccgcatctcaattaccttcccaaaggtaattggccaagcatatagcattcgataaatatgagtatgcatgattctagagtagcatctctaagcatttgttatagttgaccaaggactcatacgtaatcatggttacaagggaataagggtaaacaataatcaaggtatggcatattcacaaataggatgttcatcattgcatgcattcttatttgtaaataaaaataatttcgcaattgggatcaacatgttcaagggatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaatgcgaaagtcgattcttttatattaactttactattcacgaactagggcatacccaatttcgatttatacatcctaaactatttttgcgggtataaatattttgttatcataagtttttaatttaatctacccgagtattatatccatataataggttagaaatttctatcgcgagctaaatatcggccggaatccaaaaattatcttataatattatacgatttaatttagtctatgactaaacgattaaatataatatacgtctaaaattcctattaattaaatccgagtacctactgtgaattgatcacctatagagattaccaaaacaatctataattatattaaattttttcaattctacgactataattgatctataattaaattctaattattttaaattttctaacttccctaatctccctctaatttctatttatttatttattttcttttctttttctctcctcttttctttcttttcttttcccttctttcttttctctccctttttcttttctttctttctctcctttttctttctttcttcttttctctctttctctccctcccggcttcttctccctcctctctctctcggctctctggcgacggcgactgagcaaggggaggaggtggccgcttaccgacgatggcggcggcggtgatgacggcgcgacgacggcgcacggcgcggtggcacgaaggcggcggtgcggcggcgcgagggcggcgcgagggcggcggcgcggcggcacgaaggcggtggctcggtggtgagggaagaggggagaaagagggagatggagtgggggaaatggagagggggtgtggagtatttataggggagagggggaagaaagagaggaggaggggtggccggcctgacacgacggcggcgcgggggctcggggcggcgcgcggggctcggggcggcacggggctcggcgcgcggtgatgggacggcgcggcgcggcgcgggactcagcgcacggcgatgggatggcgacggcgacagcggcgcgggctcgaggcggcgatggaacacgcgcggcgatgggatgagcggtgacggggcgcgtgggcgcgcggggtggcgggatggcggcgcggcggctcggggcgcgaggcacgcgcggtaggggagatgggacgggcgcgcggcggggcaggggcgcggggcgtgaggcgacgacgcgacggcgatggcgcgcggcagcaggcggcgatggcgacgtcggcgcggctcggggcggctaggggcaggcgacggaggaggggcagggctacggaaccacatcgagcaccttccgcgcaatgaacagtgctagttttcattttatccttatttaacctattctctatataaatcttattcattaattccaaatttttacgcaaatgaagtttacataacatttgtgttatttcaaccaaaagattcactctagattaacattacccatattttatttttatctaattttcttgaatttaattaattcttatttcatcgtactaaaatttaattattgctaatacggtcgcgataatattttatttatttccaacctcacctaatctttattttaatttatattttaattatttatttagccaatttgatttttagggtttattcctagttagttattcattattcgcgattaataaattccgagatcaaaatccaatgaaattggcgaataaaatcggcatgatacaatttatttaaaaagtttttgaaggtccgtatttttagagttttgcttttactggtcaaattttcagggtgttacaaacgggctgcgccaccgctgcacgccgtcgagccaccgcgcgagcccgacggcccaggtgagcacccccatgatgcggaaccagttcgccttggcgcgatgcacgctccacgtgtgcccgtcgacgtcgagcatgtggcgcaccacctcccgccctagcggcagctcagaccgctccagccacgcggcgatgatgcgcacggcggcagcacagagcgcctccgagctcgccatcgcgtcgggccgtctctctccccctctcccaccgccgccgccactctctgccaccagccgtctcacgcaccgacgcgcctactcgagaaaaggagagaagagaagagaaaaagaaaagaaaggagagatgtggggcctacaccattttctctcacttatatgtgggccccacatatttttttatattttttgctgactggatgccacgtcagtaaaacaaggcgcaaatattgcgatggaacctcctttgaacggtttgagtgagtttaggggtgaacatttctagttttgtggttgagggacctcaaaaaatctcgctgttaagttgagggacctccggtgaacttattcctttgtggattgggtcactgggtagatatcgacctagcctacttcttagaagcggtgaatggtgtggcaacatataacgaccactcgaccagtagggatgggcgtggtagggccaacccgctggactcattgacccatccaacaaaattggcttcaatgggtaaatgggctggcccaaaatagaaaagttggctccaatggttaaggggtccaacacatgctaccttcatcggcctccacaccggggcaacgtatcctatgcacacatctaacctcgtgcactcatgcactcggctgttatatacccatcgatcctgatctaacggatacgatctaggtgactaggtgaggtgtttttttcagaaaagcgcccgcatactccatacaaatttgcagatgaccccttaccttctttactcttctccgtgctcattcctaatcgatccccatccccaaaccttctccctctccatgtggcaggaagtcgacgcgcgcaaaaatcataaagaacaaaattgtattggtcctttttacaaataagttcatttgaacaattcaaattttgaattttcaaaatttgacaacttcgaacaaaaattagggttaataaattatttcaaatggaaaagtcgcccaaaccaaaattgtagaactcatcgagatgaatttttattttggtcatttctccatctgactatgtgaacaatttgaagtttgaaattcaaagtttaagaacttcaaataaagttttttattagtgaacgacttcaactgaaaaagttatcaataaaaaagttgtataatctatctagatctataatttttattttggtcatttattcatccgataaaacgattttaatattgttcacaaattttacatatctcccacatggtttcaaaaattataagacagaagtgtaaattttgtgaacaatattactatcacttactcggatgaagaaatgacaaaaataaaagttatagatattgatgagttatacaactttgttgttgatgactttttcagttgaaatcatttagaatttgaaaatattgtttgaagttttcataatttgaaattcaaattcaaattattgaaacaaagtcatatagcagaatgaccaaaacagaagttgtagatattgatgatttatacaactttgttgttgatgactttttcagttgaaattatttagtatttgaaaatgttatttgaagttgtcataatttaaaattcaaattttatataggtcaatcaaactcagatggagaaataatcaaaataaaattggcagatctcaataagttatacaactttgtttttgataactttttcacataagttcatttagtatgataaaattcaattcgaagttttaatattttgaaattaattgagagaagggaagcaatatagacttctcggctgggctggtggtccgaaaagggaggaggggaaggggaagccggcccgaggagggagagaggggctgcgggctgagggagggagagaataacacttgggccgaaaaaggcccaaggatagaaagagattttaatttgttttccatttattttaataggttaaatgaactttgtgatgtaaaaattagttattgagctccaaaaattctaggaaaatttcagagaataatttagaccatgtagaatattacaaaaatatttccgaccatgatttttaaagtaaaattttagtttcctcattaattcacttgattaaattgctttaactcttaatatatttttctagaaatgcaatatataaatctacgttttctttgtcccccttatgacaaattattattcgtcataatgttccattgaaatactttatgacgatttctagttggtattaacaacgaacatcttttttttttgtcactaagccaccccatctcatacaaatcatcataaaatggaatatgctaataaagaatagctctgatgtcacgaggaatttgtcacagaaggtcatatttcttgtagtggccatcggccatcctcacgtctagggcaggccgcatcactggcgttttggcgcctgtagtgtgttcatataatcatgcaactagctagacattgaactgggcggaactcaagcagcatcagagcacagctgggctataggcaacggtggggtagcgcccaggtcaggccgcagccgctttgatgccgtccttcaccaccggcacggtcgtactgctgcttgctgcgcgcgtggttcatcgccagctatagatcgaatctatgttgtggtggtcgccgcgatggcaagcctcctgctgaccgcattcgatgcactcggagcatttctccattattttcgttaaaaaaaagttctccattcaagtatttgtgctttgtgttaactgattgcaaaattgtccgtgattgcaaaggcactgaaaattgaataacgatttgtgtccatttcttaatttctctcgttagtttgcttgattggacatcacctaccttattcttggcatgacagcctccatgccatgtttttttcctcaggcagtgtgtagttccatgttaaaattaaaagtttgaagaaattggaacgatgtgacataaatgttagaagtttgtgtgtgttgaaaagttcgatgtgacggaaaagttgaaagtttgaagaaaaaagttgaaatctaaacagggcctcaaataggcgctgccgctgcttgcacgtcaggctctacacaccggcgaagagagaccagttagccgcgacaggaaacggtaggcacgtcagtgggggcgattcttccttccgcacggagaagttgaaggtttgggaatggggatcaatctggggagtacagagaagaggaaagaaagcaaacggtcagatgtaaatttgtatagatgatgcgggtggttttctgaaaaaacacgtctgcttagaccgtattcgtctgatcaggatcgaagggcctataacagccgagtgcatgtgtcgaaacatgaattcggcaataataaaagggggtagcgcacgagacctaaaagtggatggatacggagacaaggatttagacaggttcaggccctctcaatgagaggtaataccctactcttgtttggggatttgaatccaccaggtatagtatagatctgacgatctagttgtgtcatgccccctagagggcctcctgcccaccttatataggatggggggcaggattacaagatagaaaccttaaccaatacggtatcggtttcttaaatctactttacaatatcatcaaaccaggacttcaggccgttccgtaatatacaaggaaacataatacccaagtcatgatccattacatattctatagatataaactatcccctatatccagtcggataaccatgccgtgtaggtatggggtacccataatctccacagtagcccctgagaccttcacagtcgaaaagataatcttctctcgaactagattactccaaaaccgagtgcttcaatcatctttgccatgatttcccgagtacttttaccaaatctgaagactgtggagggctgaaaaataaagtcaggtgcatcgactggatacacctaataggtgtagcccccgactatgtggttagctgaacaaactaagcatatagtcaaggaataaataatccaaccaatgagtggttttgataattgtaatcaaccaagtgacttgatatcaatacatagcatatgcgatgtgaatccccaaataacatgatccaagtgatataccaactgctttgtaaaaattgatgcgagcaacctaaacttgactacatcattgaaaatacacatagcaaaacagctataaaaaagcttgaatgatgtgaataaagaaatttccaaagtattgggcatacgccatgcgcacactgctttaacagatgtgcttaagtccctaaaagacacatggtttcaccacacccgaaaatatacggcatatgtggtgtaacatccgagtaaataaactcaaaaaggattcaccaaccgcctggaaaatgaccataatatataatcagcctaagccataatattggtcaataaaagtgcacacttgtggcaagaaaacaacgatattgtatccaatcaattgcttaaaaaccccaaacaacaccttgacttctataaaaaagtcagcggggcagctatataaagctttactgtttgacaccttttaagatgcattgtaccaactcctaaaaagttgagtaactgcggtataaaaggattttaaggtattgggcacttgatcacgcgcacttttgcctaagaaaaaatatgcctaagtccctaaaagaacgtggcaggccacacctaaaaatatgggctgcagacatattaggcctaggctaaaaaatataccttcgacaccctttaaaggatgacgcatgtaacatgctcccgagtaataaatcttccgggtgatatagaccaagtgtagttcatattaatagcttctgatctgagtgattgtccctcatgggatactccaaaatagatataaaaattgaatcccgactggcgcaagtattcggttgataacccttacggggaataatgattggtccaatcgttgagcataagagatcgactcatgaccatgaatccatgttaaatgtatccggaacaagtccaaattgaagatataatcctcgcgcttgagttgatgagcccctgagcatatagcttgtcattctgtcgtagtcaaaattgtacattggctatagctgatgcagtcgacataatggccagatgactaacatggagatgatatcacccatcaaagctgacgaagatgttggtggtggtaaaaacaatgacaccaatcaaaggtgatgaagtcacatagccatggaggcgaggaaaccagtcagcggcaggcagatcaactaacaatgaagatgaaggcacccagcaatagcgacagagttttgtagccatggtgacgaaataatcagtcggagacagacgagacagctggtgaagaagacgaagacgcccatcagtaaaggcataataagccagccatgaaagcgaagacaccatgggcggcggcggaggcaagccggtggtgaaaacatagactctcttcaatggcaatggcaaaatccatcaatcatgaagatgaagaaaatagtcggcgacggcaaacgcaatcgactgtaatgacaattagcagcaacagacatgatcgactatgatgacgaagttgcccatcgatagcagtagattaggctatgttgaagaggcttgacaggatgttgatgaagatgacgatgtcggcgatccagtcaatagcggtgtagcagccgatgataatgatgaagacgatcatcagcgtttgcgtagtaggtcaaccatgaaggtgaaataataagtaggcgatgacataatcatccattagcaacaacggggatgtcaaggccgatgaagcaaaggtgctggtgatgatgtcagtgacaataatccatcaaactgttgagaagatatcaaagctcgagtagtttccttgatgcgagcatgtgcataaagaagattaatgcaacgcttcttgatttacgaagatgactgcagaacttagtgttataactgttgtagatgcttcacttggaggaaagtagatgctgttgtccaactcgtctaaactgagctgattggttgataactctgaactcccggacatgtaaattaaatctcaaacttgatacttgagaaatttgaagtagatcgtggcgatgatgtagaagccaaaattgttggtgaaataattagagttgatgaagtagaaagcttgctcggaagcgaagacgaagataatgactcattggctggttaattgattgcttcatgttgacataacatctgtcgtattttgagtcttgtatttgtgtagcccccgactctttggttagttcggaaacaactgaacatagagtcgagaactgtagcttgtcgtcatcgagtagccatcacttgagtgaagatacatgttgaagatgtccgagtagaattcttgaaaattggagaaccacttgtagtagattagcatgacgtcaaatttcgcgacgcgtgccgagatgtcgaggcccatgtagacgtcgtggttggtgaagtagcaaaacttgcaaagtagcggcaatagagtttgccaatgctgaagataataaaggtgaagtcgctccactatgatgaaaaagttgcattgccgtgatgaagtgaacacgagtcggcagcaacagaagcaaaccggtagcgaaaacgcgcaattgtgaagataaaagctccagtcggcggtggcataaccagtcggcaacagaagacgatgatgtccatcagtagtggtagcggtataaaccagacgtagaggcgagggcactagtcaacagcagacgagacgatcggcggtgaagacgataaggccaacaactagtggcagaatcatgcagccaaggaagtgaagaaaccagtcggcagcagacgtagacaaattgagttgaaggtgataacgcctattagcggtggcggcgacgtggccggctgtgaagacgatatcaccagttggcgtcatacaaggcggcgagccggtcggtgaagacatagacgcccaacaacggtggtgtgaccaaccaaccatataggcgagggcaccagtcggaggcggtgaaggcagccggtggcggcgaaggcaaccggtcggtgaagacgtagacgcccaacaacggcggcataataggctagccgtgcaggcggagacaccagtcggcggcggcgaaggctagccggtcggtgaagacgaggatgcgcaacaacggcggcataataggccagccgtgcaagcggagacaccagtcggcggcggcgaaggcgagccggtcggtgaagacatagatgcccaacaacggcggcataataggccagccgtgcaggtggagacacaagtcggcggcggcgaaggcgagccggtcggtgaagacgtagacgcccaacaacggtggtgtgaccaaccaaccgtataggcgagggcaccagtcggtggtagcgaaggcagccggtcggtgaagacgtagatgcccaacaacggtggcataacaggctagccttgtaggcagatacaccagtcggcggcgacgaagacaagccggcggtgagaatgtagaagcccaacaacggtgctgtaaccaaccaaccgtgtaggcggagataccagtcggcggcgacaaaggcagaccagtggtgaagatgtagacgcccaacaacggtggtgtgaccaaccaaccatgcagtcgaggacactaatctgcggcggcatcgtccgacgtgttctatggaaaccacggcgaatttggcggtggctccaccagtacatgcgaagagacaaaaataatctctaattagtatcaagaaaattaagaaaattaatgatgtggatgtatatttgcatatatgcagcacgcatatgttatttcactggccgattgatctcctgtagcatgaacattagacgcatccatattccacacaagcagatcattggaccaatctcctgccatgcgtgcgtataggtcacaggtccgagtccggaacgaatccaagtcagagagaatcagactcgggaaacgtggtgcatgcaaaataataaatcacagatcgaactgagattgagattagtagtagaaacaaataaaaagtgcagatgattatggatattaatcgatgcatgtatgtatgcatgctgtctgccttcttgcttctttatatgctgtgaaaccatcaggagcctgcggcaattggagtatttcacgtgtggattccactgtgtgtctcctatacatagccgacggcttgcttgatagtcttgcagcacgatgagtcgtgcagaggcggtcggcagatctcatcgacctccagtgcatgtatgcgaatatgatattggagggtaaatcaatatatgattagaaatcaatctaatataaaatattgaaacgacaaaccagggatcgattagaatcatagttctaattgagattgtcctcgaccaaaaaagatgtcggcgattcctgagattgtttctattgcacttgttgacggaaaactcgacgataccctacctggcgcgccaactgtcgaaacatgaattcggcaataataaaagggggtagcgcacgagacctaaaagtagatggatgcggagacaaggatttagacaggttcaggccctctcaatgagaggtaataccctactcctgtttagggatttgaatccgccgggtgtagtatagatctgacgatctagttgtgtcatgccccctagagggcctcgtgcccaccttatataggatggggggcaggattacaagatagaaatcttaaccaatacggtatcggtttcttaaatctactttacaatatcatcaaaccaggactttaggccgttccgtaatatacaaggaaacgtaatacccaagtcataatccgttacatattccatagacaaaaactatcccctatatcctatcggataaccattccgtgtgggtattgggtatccataatctctacagcatgagtgcaggaggtttggtgtatgcataggatatgttgtcccacaccggcagcacctcatgcatcctctcagctcctccctcaacttatgcacagagatttgactaggaagtcgacactggcggtgatcttggtaggtagatgtctaaccgtagacatcttattttgttacaagcactgctacacgtattaaatttttcttaataaatttgtactaataatcgtctcaaccgtttgatcaaggaagcagttgttcaatttgaagagttgagaccacctgatgtttctgaaaaatcatgtgcagtactactgaaaatgatttacattcgttctgaacctttgaagctattgctgctcgctacgactatcaggacagttctgtttgatgattcatttttgtgagttttgaagctattgtagttgttatgtgccactgatgtatctggtggcataaaaaaagtcatctcaatgtgttgccgttaacagcgagtaattaattgtcttcaaacatgaaatcaacaggtttttctttagttaagtgactttcattttttagataatggattttcattaatccggcctctatatccacgaaggatatacaccgccaaaaggatacaagagtacttagactcacatctcaacaaggaggagacacacaaccaaaaaagaaaagaaaaccaaacgacctcagcacatcctacttctctgcctcccgccatattctcctgaaacagccagatttgatgagtggaagtctactggtcgctgccgccgctagtgcgccattgatgcaaatctccatttgtgccatcttcatcagtttcaggtaagctaacgtcatgcaccgcttataagcccactctaaaccgtcgtcattcgtggtatagtcggaactagccaactagacacaaaccgacgggatcggcttctacttcaccggattcctaggcatctactatctaaagtgctcagaccgccaccgtctcgagccaccgcaacccctagtgccgcctgcgtcgacgggggccgccgtagcccatagtgccaccggcgccgccggaagccgccgtcgtcctctgtcgcagcccctagggctgccggcgccgatgagagccgccgcagcccctagggccaccaacgccaacgggagccgccgccatcctctgccgcaacctctagggccgccggcgccgacgggagccgccgccgtcctccgccgcatcctctagggcaaccaacgccgacgggaaccgccgccgccgcagtgccgacaggagccgccgacgtcctctgccgtagccctaaggccgcctccaccgatgggagccgtcgggccgccgccaacctccgccgtcctccgccgcccccaccgccgtccaaagagactccgtcaccgatgccttgccacctccccgccgccgccgtcctagccgccggtcagctctcgcgacaggctagatctgggagctggggggagaggaagtgactttcatttggtctgatatgttttgtgttttccaaaatcaaaactctagcagaatttgatcttccttctaatgggtcgacctgcgctacccaataagatctagtgtgatgacccgttggcactgttgcagcctaggctggttgcatgggatgagtccggatcaccccgccacggaccacgcccatttatccctaacgactagtggtctggttcggccaatggcttggtgtgccaaggatgaagagagtgattggtggcacagtagtataactttgaacacaatgctgtatggtgatcgggagacaaccatagttatgttattgagaccggaccggtaatcaaaccggtgaggctcttggttcaatggttcactggttcaaccgcgtgaataggtggtctaacccggttcaatacttatcaaatatattaatcattctattaaaacacaagtggcaaggtggcctggttgttgagagagttaactctctcccatgcgtcctgggttcgaattccacccaaggacattttttccacacctacacgcacgcttccccttcgtatcccacgcaaccggttcaagcttaattgtgttgtactttcttcattctaaaatataagagaatttgggtggtaatttaggtgggtatgagctgtccagattcatgattctaggatatgttatatccacctaaaattttttatattttgagatggagggagtactaaagtgggactttgggtttgcctttaacattaatttatatatccacttatgttggtcttgacgagctttgtttgtaatggactgtgttgcatagctttgctctataatttcatggtttgatagggacccacaggtacaattgttcctataacctcatccattagcccgaagaatgaaaaattggcgctacccctagacctgtattgtgaagtcctcacaccttgggtgaaaattaccactctatgtatccaaattgtagctaaggcgaactgttattttcaaccaaaaataaatggcaagattatttactacttccttcgttttatagtataactaaaaatatattagtattttcaatacaaaataaacatattatcaaaatatattcaatgctaaatttaatgaaactaatttggtgttatagatgttacaatttttttctagagtaaattacattggtggtacacaaacttattaggtggctgtaatttaatacatgaacttgtaaaatgctcgttttgatacatgaacttatctaatccgtacgaactaggcccaaaatggcttggcaaggttaattttacctagctgatgttaattagaatgtggcatgcatacgtacagtgagtatgcataaaacatgctatatttataaatttgttctctactttatcttgaattttgtatgtttctaacccatgtatcattgctcgatattttgtatctttctctacaatcaccatatatctttctatctttttattgaacaagtttatgtctaagtagtaacattctcatatatatgtttaagtagcaaccttctcatatatatatgtttacgtagtattctaatcagcacctaaattaacaaaattagtcatgtaatgtccttttgaccttagttcgcacgtaaaagattagttcatctactaaaatgagcattttataagttcatacactagattgcacctacctgacaagtttacgtaccgccaatgcaatttactcttttttctataaggtaggtcaaacataaaaaggttaaacaacttattaatatgaagcggagggagcatttccctctatgtagaaaaaaaattcttggagtatccaaaagttttcatatgtgaaaaattgtgtctgctgaactattgagtacaactgacaactacatctgaccaaccaactactctagcctctctgtagtcctttggcccccctccttgtcatccaacttccatgcccccactatttctttagcgatccgtgaatgcgtgatccatgacgttttggcgtgaaacacgacctcatcctggaaaatcctccggttcattttccaccaaatttccaaattgataacgaatgaagattgatctggctcca

SEQ ID NO: 40331 - DNA, 1244 bp, Oryza sativa
gcactttactccataattaattacgttggtagttggttatgggcttgtggcttacaactttcagaagcttagaatatgctgggctgcatcatgatttctggccccaattagtattaagccactagcttaaccgggagaagatccaggccactttgccctaatgcccaacagatctccagaggctggcggcccatatagtttagttagtcaaagggtagcccaacaaaaaaatttctcttttccataaaaaaagactaacaaatctttgatttttcctagaagacttttgtaatttcaacggggaaaaatgaagaaagtgagaaaaactgaccctgaatttcaaaggggagaaatttcacgagaataaactagcaggactcgtggaagcacgcgtatcgtcgcgactcgcgactagccgagctagcttccttagctgccacagactagccagctagctgatgatatgatccccgattgtgcgtggaattccagggacaatgataaaaacggccaagaaaacaacgattttaatttgggggtaagatattgatggatgatgcgagtctacacatcggtctcaaggattatttattgacatgagagactaagggccagtttagtttgtcgctgaaattaaccttatcaaaatttattatttggtacactttggcgttatcaaattttgacaacgttagatatattcagtttgtatctttacaaaagaaaaatggtagtgtttgtatgagaagaagctttcaaaaatgctaaattattagtaatctggcaatgacaaaaatatatttagtttgttaccctactaaaataatactcctaccaaaactaaaattggtaggattaaaagtgaacaaatcgtatttgggagatgctcatgagagcacgcatgcgtgtaaagacctattgctaatttgttaatttgccggcttgacggtattcctaaatcttaagcactaagaaatgctgtatgattaatccagtgcatgaccattattcgtcagttggattcgggactctgccaaaccggaagctaaatatagctttcttggctgcaccctgcacattgttcactaattcaattaatctatcccatgaacaatcaagttttcttctcttctgaggccgagtttagttttaaaatttttcttcaaacttttaacttttccatcacatcgaaacttttctacatacacaaacttacaacttttccgttcacatcatttcaattt

SEQ ID NO: 40332 - DNA, 7027 bp, Oryza sativa
ctgaaacgattgacttacaagccgtaataggttattagtaaaaaatattttgcaaataaaacttttacatgtgtattcttagcaatttaaaagtaaatacagaaaaataaaattacaataaaaacctatgaaacaacacataattaagtttttaaaattaaatcttagttacgtttataagctgaagggtaaacgatgagactgatacctcggtttatattaacttgatcattccaaagactcaatgatcaatagcacaagcagagtttatattaacctgatcatttgaaagaacttaatgatcaatagcacaagcatgcaaaaagttgcattgttgcaacaaatataattcatgcgtgtcggtattgggcaggtaactaaatgaagtcaagagaatgaccgggtagatgatactcccaccgttctaaaatataggacacaactgctttttaaagtggtttcataatataagagtaagtttaatagcatagccaactgctaactcaaattcatctatagctaacctaatagctcatttatacaatagttacatactacaatatcaatatctggtcccatttatcatacacacagtgtgtcttggagtccgtgctacaactggctacaaatctgtagcccgctgctcttctctcttcttatttatctccttaaaatatgtttgcagctggtttatagcatgctattgtacatgctctaaggcgtgtatgcatgcatgcaattaattagcacgttctctcccctaaatcattattattttaaatcctatactcgtaagattttcaattctattggttgcatgtattgtattaattggagtgattcatgacaacgatgagatattaattatttcttggtctttgggttaaaggtggttgtgccttaggtcattcccaacctaagacactagatatagtttccataaactccacgtcatcaagaaactagtactagacactactcttctaatgcaaacaccactattccatacttaaatttaatgtcacttatctcacatgatgtcctggatgttgtgtagaaaccatgtctcatgcaagacatgatttccttctctttcctcatttattcgtttgccacattatttttcatcctatgtggtagcttatttaatgctatggacattatcctagtcattgggttaggaatggtcttagagcaggtacaatagcaggctattagccagctgtaaacatattttaataagataaaggatgagagagaaaatcagcgggctacagatctgtagctagctgcaacgcggactccaagacgcagtgtgtttatgacaggtgggaccatatattaatagaatagtaagcaactatcgtatgaattgactattagattagttatagataaattggagttagtagtgggctgtactattaaacttgctcttatactctagatatgtaccaaaagaaaattccacatttaagggacgtgggccacgtggcaatataaacaaattgaagcgacctaattaattaatgcgtgctcatcaactcatgtgcgcatgggcagctggtaagctcgagcgacgaaaatgccaatatccaccagctgccacacactggtggagaaaccatctttcgtcggtcggccgaattccacaatagtcccggatacaataaaaaccgggactaaagatcggttaaaaagggtaacgggcatatttgataaccgggactaaagatcatctttaatcccggttcaaatgctgtcaaggcctgtcaggcccccccaggatctttagtcccggttggtaacaccaaccgggactaaagatcataacttagtcccggttggtaagaccaaccgggactatagatctcggggatctttaagccccggttggtaacaccaaccgggactaaagtcccacccctatatatatgtcttcttcctcctccagctgcccgagcaagctccaaaatttcttcaaaaaagaggggaggtcataccaaaatttccagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagggagaaaatttgtgtggggaagaaagaatatatagaaatttagttgatttgctaaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgtcattattgtaagaataattatttttatactattttttttcgactcatgtagatggatcggcaatggatgtacgctgaccggcggtccaaagagtttattgacggcgtgcactattttttgagagtggccgaagctaacaggcaaagggggttttatttgttgtccatgcaataagtgtaagaatcagaaggagtattctgcatctaggactattcatttccacttgtttaagtcggggttcatgccaagctataactgttggacatcccacggagagcaaggtgttgaaatggaagaagatgaagtggaagacgacaatattccggacttttctcagtacgttggatttgaaggaaatcaaacgggcgaggaggaaagggatgctgatgttaacgatgttgcggatgatcttggtcagattttgcaggacgccaaagagaactgcgaaagtgaaaaggggacccataaattagacaagatgttagaggaccatagaacttcgttgttcccaggttgcgagcaggggtacaaaaagttggataccactctggagttcttgcaatggaaggcaaaaaatggggttagtgacaaggcatttggcgatttattgaaactcgtcaagaacattcttccggagggaaacaaattgcccgagacaacgtacgagactaggaagatagtctgcccgctaggactggaagttcagaagattcacgcatgtccgaatgattgtatcctgtatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccacgggtaaggtgtttgttcaggaacaaggggaatgctagaatgatgtgatggcatgctgaagagcgtcaacaggacgggatgctgagacaccccgccgatggttcgcagtggcgaaacatcgacagaaaatttaaagaatttggaaaggacgcacgaaacatacagtttggtttgagtacggatagcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgatgtgtacctaagaccactggtcgaagatcttaagctgttgtggaagatggaaggtgtccccgtgtgggacgaggacaaacaggagtagtttaacaacgagcgctgctgttcgtaaccatcaacgattggcctgcacttagcaacctatccggacagtccaacaaggggtacaaggcttgcacttactgtatggatgaaacaaaaagtacgtatcttaagcactgtaggaaggttgtatacatgggtcatcgtcgattccttgcagcaaaccacccaatacggaagaaaggcaagcactttgaacataaggctgaccaccgtatgaagcctaaacatcgcaacgggaaaacagtgtttgctatggttaaagatcttaatgtagtgttcggaaaggggcctggaagccagcctatagagagcgaagatggtcacgcagcgatgcggaaaaagaactctatattttgggagttaccctattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacacggcgaccttcacccggaaccaaaggagaaaggaagccattacttgagtccagccagctacactcttagtaaggcagagaaggaaagtatgtttgaatgcttggagagcataaaggtactgtctggatactccatgaatatcaagcgaataataagcacaaagggagaagaagttcacaaacctaaagtctcatgactgtcaagtgttgatgacacaactgctaccagttgtaataaggggtatccttccagacaatgtccaggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcggacgtgcaaggggatacaaggaggggtttgtggctatttgcatcaaggcggttgtaaaacattttattgagcaaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacactaaggtttcacccccacccctcaaaaggcagtgggcggtcccctcttgcgccgcggtgaatccggcaactggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgctatcggtgcgactcgcaaaaccatgcacccacagcccaccattcagtcgcattttagttggataattacgaccataaaacatggccagatgtctcgagcacgcggctcaacaagatactagaatgtctaaaactgcaattatcccatcgactgagctagtggtaattaagcatggctaagcatatagttctagctaggtcatcaaagtaacaccagctaggcgatttattacccacggctgacaaaggacagatatcaagtaaacatggcacaagcgagcagataggtaaaccctgatcccgtgtaattagcaaaacatgcatatttatttgcaaacggtaaaacatttataaattgggaacaacatgctcaaggggaatgtgtgacttgccttgcttcttcactttgatcttccgaactcttttcctcgcgaccgcggacttccgaaacgacggattctacacgctggcacgcaaaatgaggaaaaactctaataaaaaccaaggaaacagtatataaaaactaaacaaacatgtagagctcaattttagatgaattttgcaagttgaatggctcaattcggagtccgaatgaattagatatgaattttagaagttttgagccatttaaataaatttctataattaaactcgatttattgcgcaattattatttatttttacaaaggaaatggacctcgctgacgtcatcaagggggaggggcggcgccggcaagtgggcccaccggtcagcggcacaagggcgccggtccaccatggaccgggaccaccgaggcggtccaccgccggtccacgggaaccgacggcccggatcggcccaaagccgatcggacggccacgaggcggcgcggctagggcacgggcacggcacagccggcctggtcgagcgatagcgcgcggcggcgtgcagccagacgaccgccggcgacagcggcgtgtcgcggcagcgggcacggggagcggcggaggaggaaaaaaaaggagaagggacggtggggattctcaccgaggacggcgacggcgagacgaccacagggaggcggctggcggcggaaaggatggcggcgactggcacgagaggcggcgggaacggcattccggcgacacccgaccatggcggagacgcggccgagggccggcggggccctcgagatgacgaagccggaggaggtggcggcacaagtcggcgtcgaccggagaggcggcgtgacgcggctggactcggcggtggcggcgga

SEQ ID NO: 40333 - DNA, 5746 bp, Oryza sativa
aggaaaaacagacttgcgccaaaaggggaggcaagccgggccgcgggaggggaaggagagaggattttgggccgagcccgaaagggaggaaggggaagtttattttgttttctttttatttaaattagtttaatgaactttgtgactttaaaattatttcttgaactccgaaaattcacggaaaaatccggagagtattttagggcacaaagaatattgcaaaatattcccggccaatgatttttaattctcccattatttcacttgattaaattgatttaacttttatttaatttctagaaaatgcattatttaatgatttttaatcccgaacgaaaatcggggcgttacacctgtgtacctacacaacatgtttcctttcgagaggtacatgggcgttctgaagaagtatgttcgtaaccgtgctcgtccagaggcaagcatcgccaagggttatggagcagaggaggtcatcgaattttgcgtagaatttatcgaagatcttcgcccaatcggggtacctgaatcacgccatgaagggagactacggggaaagggaactcttggaacgaaagcaataatgacggtagacaacaatttattccgtaaagcccatttcacagttctgcaacaatcttcattggtagctccttacatcgaggagcacttggctctagttcgcgccaggaatatcggtaagtccgatgcatggattacacggcatcacattgatactttccccgcgtggctacgacaacatctcatgggtaacgagtcgatcaaccaacaacttgccttcctggcgagtggaccgtctgggtcgattgcgacatttcagggatatgagatcaatgggtacacattctacacgagagcccaagacatgaagagcacgaaccaaaacagcgttgttcgtgtcgatgccatgggacacgatggaacaactggcacgtattacggtgccatcgaggacatatgggaacttaactatggtcctctcaaggtccctctgttccggtgccaatgggttaggttgactagtggaggcgtaatgattgatgacagtgggatgactacggttgaccttaacaaggttggatactcggacgaaccttttgtccttgccaacgatgtaacgcaagtctctttcgtgaaggacatgtctagcaaaggaacgaagggcagagggcctgacgagcctaagcgtcatgtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaaggagggaacaatagtgaggagaaagtacgtgcggtcaaccatcaccgctgtcacatccggattttcgtttcaggatttataaattatctaataaattattaatagaatttatattaaatgttctttaatttacaagtgaagttaaatgtgagaaataaaaatttcctaaatttaaagcatggatggatttaattttcattaaattctccatgattaattatactctctgcaattttctcggatttttcggagctcaattcctaaatgatacaaagaacagttcagtaattatttaatcattaatgatctaattataattatgttaagtgcttttcttgtttaaaaatccttaatttataaattgttgtctaaaagggaattattagaaatgatcttaaaagcctagaagagaagatctaattttaattaataaatcccaatataaaatggggccagataaaatttcattaagtactttgcttaattctataattcctagatttttctgggatttatttgagctaaggaagtatttttaataaacagaattgaatttcatgaataatttaaattgaaaaaggtttttaaaaatcctcttttggctttgggccgaaagtcggcccaaaaccctctctctctcctccccggcccaagccggcctgcaaccgagccgccgctctcctctctcccgctgacaggtgggccccacctgtcagggtcgtcgtcaacctcgcgccggccgccgccagaaccctagcgccgcgccgccgtcgtctccttccaaattcggccgcgtctttccgtctccggccgaatcgatagaggggaaatgatccccgcaatccactctatcttttcccttttggaatcgtcggctaatttcgtttggaaatcgccggatttgagatcgaatcggattcgattttcttccccgaaccctagactttccttcgccgtcgccggtcgccgtgggccttcgccgccgccttccaacccctatataaggacccccaagcccgccgctacccgtcgccaccctcgccttagtctctcgcaaccgatcgagctctagcgccgtgccgcctcgcgccgccgttgtcgccgccgctccagccgtgcgccgccgtcgctccagtcgtcgccgtcgctcggggaggtcgccatcgtggtcgcccctccgccgttgctgtcgaccgccagaacaccgccgtcgtcgtcaagccgaaggtcgccgccgcttcttcctcgacgccgtcgccgtccgttgatcttccgtcgccgctttggtcaccggtgagttcaccgtgccgtccgctacccgtaggtgccctccgttcgcgctgtcgtgccgtcgttcgccggcgagcatgtgctgcccgagccgtcgccggtgatgacgtcatcgccgacgtcatcgtcgccgtgtctcgtggaccaccgtggtctggatcgatcttggccgtccgttttggatagggtcgatctcggccgttcgtttctgtgagccgccgccgtgcacccggtccaccgtgaacccgagccgctgacgcaataatcctcttttccttttcaaaaataattcattattgcgtcataattcaattaaaatctaaataattgatttaatctgatttaatctttgaaaattcataactaattcatcttagctcggatttagttggttcaagtctctaaatttttctaaaattgagatctacatgttaaaaatatccacatgtactgtttatgcttgtttttgtactgtttatttggtttttattagtctttttcttcgttttgcgtgttagcttgtcgtttccgttgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggggtgaatctattcctttgttatagcctgtttgcattgattactttattccttgataccttgggttatcataacttgactagttgagctttatatattggttcagctagatattagatatgattgcttagccatgcttagaaacattagcacactattgggataacttatgattcaatattgtttaatgatggcttaatgatagttcacgatggtcaatcgtgattggttaattaattaaattgccaactaaaacttgacaatggtgggttgtgagcacatggttttgagagtcgtgctcatgacaattaaggaccggttcacgattttcggttgtgaaacattaaccgtgccaaccacaagccagcgtgggcaacagctttaccttttgtatagcatggttcattgcggagcaccggactgagaagtggcggagataagcccacgggggtcgctggggagtccatgccttatttataagggggtgactatgatcaaggaacggtgcactgtggtggattgtgttgtgcgaggggtaatgtcacagctcctttccgaggtaccgtggtggtattgaggcgcatggtgacatgttgtggggctgtgtcttgtgggtacagtggtacacctctggccagagtaaaactattcgaatagccgtgcccgcggtcatgggcgggtctaacaatgtctttcgtgattagtctcacacttctcaccataataaatgatgatataattggtaataatttgtttagctcctggtttggagatagatctgtgcagccgggtatggttgttcaggatggttgggcctgtgcagcatgggtgtactgttcagtgttgattaatattgatgattaattactctattgttttataattctcaaatgtttgctaaatgctgcttttgcaaatgagccctatattatgccatcctttggtatccatgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagccgaagcttcgctagaccgtaattccactgctgttttcttttcttttgtaagtatgtaacgttattattatgatggatttgaatattaaattgtcagtttgtgtacctcggctgattcctggacgaggattttatgcacaaataagttcgaaaattactagtgaatttccgggcgtgacaaccgccgatgtattgccgcaattattgtgtacacgatgtaaactattttggatgtattgattatccatataaatcaattgatgtatggcatatgttaattacgcacgattattagaggttttaacaactttaaatcatgtatatgctagttatatgcgatacttacaatttttaaaagttttaaatcacgtaggtggcaatttcatatgttaattagagtttttaacatttaatttactatcattcatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttaacaattaatttaatataattccaatgctaagtatatatgatgattacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattgtcattaatctttgtactttaaataattgtaatgcattatcttctattttagaaacacatatgcaatggaaaataatattcagtgcgcttatcagtagtcccggttcttaaccctaaccgggtttaaaaagaatttgaaaatagcgggaaaagatctttagtcccggttgttctcatcaaccgggactaaagatctacgggtatatatattcccgatgcgtgccctcgtcttctccaccaacacttagaagtttttgcccgatcgatctctctcggtttctccttcgccgccactgcctagggcatccccgcgccgacgccgccgccgtatctcgccgtcgtctcgcgctcgtcgtcgtcgccggcggctccaccacctccgtcgccgccgcatctctggggtgagagccgccgccgcctccctctcgatctctctct

SEQ ID NO: 40334 - DNA, 2525 bp, Oryza sativa
ttgtaattagacttagcatgtaagattatgtagggttctaatatacgacagttacacttagcatacatggctattttagtcttagcatataatattatttgagttttaatataagattattatatttgtaattagacagtatataattattgactagctagggtcctataatatacgtcacctagatttagcatatatcatcactatttgagttttagtataagattattagatttgtaattagacttagcatgtaagattgtgtagagttctaatatatgacagttacacttagcatacatgactattttagtcttagcatataagattatttgagttttaatataagattattatatttgtaattagacttagtatataattattgactagctagggtcctataatatacgtcacctagtcttagcatatatcatcactatttgagttttagtataagattattagatttgtaattagacttagcttctaagattgtgtagggttctaatatacgacagttacacttagcatacatgactgttcgtttagtcttagcatataagattatttgagttttaatataagattgttaaaacataaatgtctcatgacttagcaaatgtttcctgtatgaacagatggctgatcgtgatgaggaaaagatattgtacgatacaatcgcggagggaagcagccagtactggaacgaagaagaggggaacgaggatccaaaccagtatttgaacgaggaagggaacgtggagagggatgcggaggagaaccaggaggggcacgtggaaagggatgtggaggggaaccaggaggaggaggctagtggaagtcaaccctccgttggacagaagagggcacgcgggcaacgaggtgccaagaagaagcttgagggtcggcacatcataacggaattgagaaaatggacgacctagtgccccggcagaagccgccaagaactatgtacgtcacagcggttgggttgtgcgggataacgtgcctgtcagtacggtgtactggcgaagaacaagggcacgcggagatcatgaaagctttgtcccagattcgaagaaagagatgctgtggaccacaatgctcgagacattcacccttcccgcgggtacagaggacaaagtgaaaaggtggactctgaagacaatggcagaaatatatcctgaagggcaagacacagaacttcgacacattcccaaagctaagggatctctgggacgagttcgttgcatataagacaggtgtacaagggcaggcgatgatggaaagaatcaaagaacatgccgccaagaagaagtaccatcaccacttggggtcaggcggctatagcgtcgcgatgccgaagtgggaggagatggaggctagcttgcttgagaggggtatcgaaccggccaccgctaattggctggaacgatcgaagttcttgtactatgctcatggtggaacgctcaacccagctgatggctcactggtcttcggtgatcagatcgagaggctgcgcgtcgactaacagacgcagtggaagcctcttctcagggcacgttccgaccggacagagagagggacgagctgtcactcgccctgcagactctagagcatccaggacgaacacaagggaaaggggtgattccttggaagattgggttcaaggaggacatccacacgtacaggagtcggatgaggcgcaagagagataccaaggcgaaaattgcagatctagagttcagggtatcgagctacgagcgcagcatgcaaaaggaggtgacaaggaaggttgatgaacgcatggccgcacatcggtcccatgatccccagccgaccattcctcctgcaatggtgagcccatcaggaaaccgtagcagctgcgcctcaacggggcaagtaggatcatagagcatggacgccatgcaaacccaggacgaatccacctgccccgttgatgacatcactcaacggacaccatgtgagctgcatattcctttcaagaacttatcaataaaggtaagctcgtagtttatatattttagatttgcctattccgctagttgctgcttatatatgttgattactaataaataatctctcaccacatgaaggtggcgtcgggcatggccatcccaatggacccttcaggtacttaccactgcaggccgattccagcaggatactccaaggtcgaagttgagttggtcgaaggcgcgtacgaggacctcgagctggattaccctggaggagacggtgagacgcatctacgagacacaagccatgccattattctatggcgcaggcagtacatcatcctccctgggcgacaagcggcgtctcgtgcaccatctcctccggctccgccatctcctcctcaggatcctgcactgtctcctcctcatgctctagcaccgtctctacctcaggctcctgcaccgactcctcctcagactcctgcactgactcctcctcgggctcctacaccgactcctccacaagctcctcttccggcacct

SEQ ID NO: 40335 - DNA, 2037 bp, Oryza sativa
ccgggactaaagatagcgatctttagtcccggattggtagtcccggtttggaaaccgggactaaagggggttacaaaccgggactacaaagggtttcaacacattaactattcattctttgcataggagtactcattatttcactacctacacccataaaaggcacaaattaagcaaggcagcgttgaacaaagcagattaatatatgcgaagtagtaagcgaggtcaatggatgttgaggaaaaggtcagcgttcctaatttcacactaactttattgtgtcgttcaatagagctcggcggaactggtagccgcggttacgttgatttctaacataaccacaccatgccaaaaaaaaaaaagtttataaatagaactaaaacgtacgacttacataaaccataagtgaattaaacgaaatcaacatgactgcgagcgaatctacagtgatgaggtcaggtgacttggacaaaaagccgtatatatgatgcgggttcaaatatgatcagtactgctccctccgtttctaaatatttgacggcaaccattaactttttaaaatatatttgactattcatcttattcaaaaattttaagtaattattaattatttttttatcatttgatttattattaaatatacttattgtatacatatagttttacatatttaataaaacgaacggttaaacatgagctaaaaagtagaaacggagggaatactagttatgacaccaataaatacatatggcaaagatggtgtatcattagttttcggtatccaccactgttgcttgatagcaaaaatgctcaagtacttgcctctcatcggatcgacctatccgagaatattatcacgaattattaacactacatctttaaaaaaaagatatgttttctcattaagaaaatattttatgaagcctattttaatatggatgaattaagatacgagtgaaaagtttcctacagaaagaagaaagaaggttacatcggaagaaagcttataccagaagatatcttatcgcgaaggaagaaagcttataccagaagatatcttatcgcttaaaagaaacttacgtcgtgcaagaaagtaagcttgttgtggaagccatttcgcgagaaaagcaactttatggtgcaaaccaacttacatcgcaagctagcttacgatggaagtctttgatttcctccgcctataaataggaccccgaggtcgaaggcgatgacaactactctctccaacacctatcttccatctttagcttgtactcaaattcaaaagaaataaagtttctactcgtccatactttatgtgttccatagcttctatgtttatctccttttgtgttcatcagtagaatagcttggttccttaacacaacttacctagaccataagtaaattaaacgaaatcagcatgacagccaaacatgaggggatctacagtgtggtgaggtcaggtgacctggacaaaacccacatatagtatggtgcaagttcaaacatgattagtaattcagtactactagttatgacaccactaaatacattatgacaacgatgatgtattattagtttctgttatccaccactactgttgccgccaggtactccctccatcccatagggtatttgaatggatgggaccttgtccaaattttttttttgctagaatgtgtctcattcgtctaaaatctattttaggatgaaagaagtagcaaaaatgctcaaagtattcgtctcttatcggatcaacctgtccgagattgttgtcacgaattatttactctgcatctttaaaaaaatacgctctctcaaaaagaaaacattaccgcacttgtgttctactcccttcgtcccataatataagggattttgactttttatttacattgtttgaccattcgtcttattcaaaaaattaaatcaaatataaaaaacgaaaagttgtgcttaaattactttggataataaagtaagttaaaaaataaataataattctaaattttttttaaataagacgagcgattaaac

SEQ ID NO: 40336 - DNA, 24702 bp, Oryza sativa
tacatatacactcctccgcgtcgcaccaccacatccacaaccagttgcgccacaggcgcgcgagccaccaccgcaggcgagagattgtcgtcgtcgtcgtccgttgctccggccgtgacgacgacggcgtcatggcgtccacggatccgctgctcggcggcaaggaggaggaggagggtggaggtgaggtgaggagggcgcggcggtggtgggtggggcgggtggtgaacacggaggaggcgtgggcgcagacgcggttcgcggtgccgatggtgctcaccaacatgtcctactacgccatcccgctggtgtccgtcatgttctccggccacctcggcgacgtccacctcgccggcgccacgctcggcaactcgtgggccaccgtcaccggctacgccttcgtcgtacgtacccctctctctctctctctctctctctctctcaaccacacactacgctgccctgcactagtagtatatgcgcgcgcgtccaccggcggatccgccgcccacgccgccggcgatccacacgcccacatgcgcgcgcgaccatgcatcatcgtcctcacctccacacgcgcatcgataactccattaactatacgcataataaattattaatgctactttcatccgataagaattttgaagcaagcatgggtattaaaaataggtagaaataataaaaggaaggttgtgattgctaaagaggagaaaataggtgaagagaatggttttgattgattcacaggagatggccggtggaaaaatagctttattttaaaataaattattgtgcaaaaaaataactatattttaaaacggaggtagtatatatatatatatatatgtatgtatatatatatatatatatatatatacatacatacatatatatatatatagtactatcggatcaccgtgcacaatttacataaagaacgtcctgaacatttcgccaacgcgtcgcgctgcctacgtgtttctttcccagcgaatgccgtgccgttccattgccgtttttatctgtggcgatgatcatcatatgcactactagtatattgcagttgtagcattggcatatgaattataacaaagtaagatctacgtataagtgactcaactactcacttacaagcgactcaactacagctgtgtttagttcagcgcaaagttttgattttggttgaaattaaagatgatgtgactaaaaaattatgtgtgtatgacaggttaatgtgatggaaaaggattaaagtttggatcaaactttagatctaaacacataaacacacagcctacaaaactatacaaagtcaaagttcaatttccacagtactagtagattgcaaccacgtacctagctagctactagcagtactagtggtaacaacgatatgcgaatggcaaacaggggtcacatggatgtattcaaagctcgtgcaagatacatcgtttgaccttaatttgaatgggattgcacacttccactagagagaatccattatatgccactgactttgtcacacatctacaatttaccatcgactttgtcacattctacaatataccatcgatttttgcttaacttctacgatttaccatcgccgtccgattagcctccgttagtactgtacaattttgtccaaatgaccgaaatacccctaaaacaaaaacttccaaaatttggataaaaaattcaaaatatcatattataaacataagattgtaaacatccaaaatttggccaacaacttaaaatcttatatttcagaatttttatccaaattttgaatgtttttgtcccaggggtattttggtcattttggcaaatttgtacagtactaacggagactaaccagacggcgatggtaaattatagaagttaagcaaaagtcgatggcatattgtagaacatgataaagtcagtggcaaatcatagacatgtgacaaagtcagtggcatataatggattctctcttaatccagacgacaactagcttgccatcattttatatcatttgttccattcttttgctatgtcaaaaggaaattttggatctttgttagccctacaccaatcaaacagaactatatagtacatcggatgtgaaatgccatcattaaccaagagctatatatagaaacatttaagtgggctaccctagtactgaaatgcacgctttgagcgaagttaggtgaagtgttattacaaaataaactagagatgtgaagcgtagtttagactgctttataacttgtgaagctaaatttttgtgaagctaaatttaatggttgaaactgtataaacatgctctgaagttgaggaggagaaatagtatacggctacgcgaaacggctctctctctccgccccacatatcaatcgatcggtttgcctgatggtgccaaaaccgttgctttctacgactcccagattgtccaagctcgcgattagctagatgagccatgcaatcgatagctagcgctctatcgtgtcttctggaggattaactgataaatcacccggtaggcgccgcccgtggattggaaccacccgtttctcagaaaaaattcaccgcacgtcgttaattgatcgctgcgacttgcacgacacaacgcttgattggttgtctcgttgtgtagaagaaactgcacggagaatgcgatcatttcaacgtgcgtcatggcgcgaaattaaaaaaaaaacaacagatgttgccacgggttccatgtatatatactgacgaaccggtcgtcggtcgatctccactagccagctagctagctacacacagaaatccacagaaaaaaccgttctccatagtagtagtgctgttttttgtttaaagaaagcaaaaatttgggtggttgaaaattgaaatggccttgaattctcgctccggtttggtggtgtcacgcgctggaactggtagtattactggaaccggtcagggcactccgtctcacgtcatcgaccagaaatcgatcgatcgatcgagtcgcctgtggaatggtcaaagttactcctacaagtcaggcgaatcaccgtcttcacagatttccggagtctagaacaacccgtttccggagtcagagctcgctagtgataattttttgctcaactccgtacaggtttttttcctgttgttctctgaattctatagctagtccctgctatactattcaccgagcgatgatttcgtcagccaccggagacagtaccaattcagtactgctatttaattactcgctcacatgcctatagtacagataacaaaagctgcgtacgtgatgaatggttagcacgatgccatcaatggcagtaggtaggatgatgaatggtccgatggacgatcgagtgaagacgatgagcagtggtggacacgtccgatggatggatggatggatggatggatggatggatgtaaagagacgggccaggccccaatccagcgtgagacagaaaggccatttttttcagcaacctttgctgtctccttgatgatctctatagcgattgcccctctgaacgaattgaagagcgattgcctttttgaacgaatcaaagagctttgcacgattgcatgtgcgcaagcattgctatcgttattatattcagcgaacgactcatcacgtttggtggactacgagcagctacggctctgtttatgaagcttatgataatctttaacttgttctagaatctccagcagctatcagaagccgttctaaataatattcaaattttgggaatttagagttgtatatattattgtagatcatacaggaaatggttttttcgatttttgcaatttagcttctaaccatccgcttctcgaaatattaagatcccaggtaggcctacatcacgtatccgggggccatttatgattgatttgtttaccgcaagggatggcgtttgttgttctttcatttggtatgggacaaatcatggtcgctacaccgaattaaataggaccactagtatcatatatccatggagtatttcaattttcatcaacttctcccgctgcattaattgtgcccctttattttgtgattgctgtcgatctcacgacagttcgcccaggtttgttgcttatatatgattatatctcttgcaatctcactttcatatacataaaatcaatttataggtcgcggtacaaagaagtccacatcatttaatcataggattcatttgaaatgcaggatcaaagagaaaacaaatgaataagaaaagcatacaattctgattgaaattcaacttcaaaaagaattgtaaaaaaataaagtgaaaaaaaaacaagaataattgtttgattagaaaaaaaatatgaatcgaataaaagagatagactcatagaaaacttatatgaattgatgtatttcttagaaattttataggatttaatagtttttaatttaatacttctcaaagggcataccgaaaaaaaatcatataaaatttgaatcttaccaaattcatacgtttttccggagtatcaatgttgcattgcatctgcgagaatatttgaagttcttacaaaatgatgggtaaattgaaatttgaaaatgtgggtgtgtttgattcagacgggcatgagcggggccctggagacgctgtgcgggcaggcgtacggcgcgcggatgtaccgcatgctgggcctctacctgcagtcgtcgctgctcatgtcggcggcggtgtccgtcctcgtctccgcactctggtgcttcaccgagcccctcctcctcctcctccggcaggacccggcggtgtccgccgccgcgtcggcgttcgtgcgcgcgcaggtcccggggctcttcgccttctccttcctccagtgcctcctccggtacctgcagacgcagtccgtcgtcgcgccgctcgtcgcctgctccctggcgccgttcctgctccacgtcgcgctggcgcacctcctcgtcaacgcgctcggcctcggcctcgccggcgccggcgccgccgtgtccatcaccttctgggcctcctgcctcatgctcctcgcctacgtgctccggtccgagaggttcgccgagacgtggaacggcttctccgccgaggcgttcaggttcgtcgtccccaccatcaagctcgccacgccctccgccgtcatggtctggtaagcaagcactgacacacaagctcaacgccgggttgatcaaactaaagcttaattagctagatgtaatgagattcttttttttttcactatatgaagcttggagtactgggcgtttgagctactggtactgatcgccggattgctcccgaatccgacagtgagcacctcgctgatcgccatgtggtaagttcgtcgttgcgctgtcccttccatgaatcgatcgcaaaggaagaaactgatctgattaatgcatgattgtgttcagctcgagcacggaggccatcgcctacatgatcacgtacgggttcagcgccgctgtgaggtacgttacttacatacgcacgctacctgttcgatcgccggccattgttcgtcgccgtcgtttctgaccgaacgttgcacgcgccacgcgcgacgcgacacgcgcagcacgcgggtgtcgaacgagatcggggccgggaacgtggagggggcgaagaacgcggtggcggtgacgctgaagctgtcggtgttcctggcggcggcgttcgtgctgctcctcggcttcggccacggcctctgggcggggctcttcagcggcagcgccatcatcgcggcggagttcgccgccgtggcgccgctgatgatggcctccatcctgctcgactccgcgcagggggtcctctccggcgtcgccaggggctgcggctggcagcacctcgccgccgtgaccaacctcgtcgccttctacgtcatcggcatgccgctctccatcttcttcgccttcaagctcaagtggtacaccaaggtagtacattacttatacttacaatctcacattaatccttttcatttctgcttcacaaagattacatgcatgtgacatttgatttgtgttgcattgcttgtagggattatggatgggtttgatctgcgggctgacatgccagacctgcacgctgatggtgatcaccgcacgaaccaaatggtccaagatcgtggacgcgatgcaggagaagaaggccagctacgtcgcgtagtttaactagtctttggctatactgtagattatcgatcggattggatatgtgtatgtatacacgatgagcatttgaagcaacatctgcggttagcatgtctgcaacacgcgcgacgccggctgttgcgttcgtgcagtgcgtgcgcctgcgacgtttcgcggggttttggacgcgacgacaatgcgcgcgaactgcttgttcaaatacagtttcttcagccatctggaagctggaagcctggaatagacaaacaccttagagcaagtataatagtaggctataagccaactataagcttaaggagaatttgaaaaatggagagagttggctctcatgcaagagctagctattcacatattttaagatagatacataggtgagagatagagagaggaggagaaaaaaaagaggtaaccttatagcccatttactatatatgttaactctaagataagctataaactcattgttggctctattattaaacttgctcttacagtactattttcaaatggtgagcaccatatattaattgtgaaaacacacacacacaccgatgtacacgatgatggaaatttactcctctcaagtttgattgaatcttgtctgaagttttatataaaccaaactaactttagataaaagccctcccactaccataaaacctacttccttcgttctacaatgtaaaactttctaggatgaggacatatcatgtgaaaacaatgtaagtgttgaaaaattatgaaaatcatatataaaagttccgtaaattcatgaaaaatattaaagataggtgtagtgaaatacattctcaccaaatctcaactccaaactcaattttgtttaagaggaaaaaaaagagacaaattttgggtgaatagtgtcatattactattctcctaaaatttgtcttttgtcctaaataaaattaagtttggacttaagatttggtaataatgtatttcatgtttacacttatctctagtattttttttatgaatttataaaacttttaggtatgatttttacgagtttctaacacttagcttgttttcaccagatatgtccccttctaggattacccaaattaatatagatgttaatgaatctagacacatatagaaaacatatacattgatcaatggatgaatctaggtaagtctaaaaagtattacgatatgaaacgaagggagtatcaaatataccatcttactagtgctggttagggaaaaaactagcactggtagcggtttttggtccctcaaacccacacgacactcggaggataagaaaaaccacacatgagaccatatcgataccagttcattaaataaaccaataaaatgtgtgggacgttgatgttggaacatgtataaaaaagagctgatattgatgggtgattaagctgagctgatcgagcaagctctagattggtttcgatatatttaagtctagacactctctcttgtgtgcgctcagaatcgatcccttcgtctcccttcccctttctctcatggccacctcccttttcctctctcacttcctctccctctttgtcccgccaccgcgagattgattacagtggctgatcggtaggcagcggcaacttccgtcatctttcccaacgcggctgtcctatagagctcggaagccgctggatctgcccatcatgagctcgggtatggctggatccgatcagtgtggctcaatggaaacttccctccccctctcccagccaccttgagctttcgaatgcgacgacaaaatagaacaacagctatggtctattctcaaatataagcatttatatgatttattttttccatgatataaatatttctgagcactaattctaatatgtaggaatttaggcatttttcagccaattagatacttagaaaatgaatctagctatctaagaaactcaagattttttaatatgaccattgatgaggttatcgaaagggaattattaccttaacataatatttactaaataacctaaaaatgcttatatttaaaaataggtggagtggtacattttgcggttaagcttttctttttactagtaatcgtgcacgtgcatcaatgcacgtttttcataaaatatattataggagtacattggaagtttggaaactatatctaccaaaaataatttattcaaccaaaatttataaaatatatctcatgtgtaactgtaaaaaaaatataaccaacattatcggtacttgtaaacatgggcatgactgtttgttttgtacaaattttgataggagggaacaaaatagaaccgaagccaaaggctatacagtagccgcctttttctctacagctagctgctccactgcttgatctcgtaaaaaaaagaatttgtcgacaattcgctaaattgaccatccctctttcttgaagtttctattgtttcgttccgtccaaattccccaacagacaagcaagaagagggtcctgagccctttgctttgcatcttttctgataaagtcttgtgacaccaccattccaatactgaacaggctgaaggagggctagctgaagaaacttcagtcaagcacaggctaataaatatagatgtgtaagacatgcttcagacaaacttcagtcaaggaggtaatgcatcactgcaagttgaattaaattaaaaatcaaatatgatagtttcactcactagatgttacaactcacgagaatacaagatttcggaaaacaaaacaactaataaatatagatgtgtaagacatactcccttcgttccaaaaagaatcaacctagaaggggccacatacatcaacctaggaggagtcttaagttgaattttaggaagtaggaagtaaaatctagatatttttcccgagcgtgcaacaaaataacttaaatatggaggctctctattaccctcgatagaaaggcgaagttataaaactcgttggagatgctctcttggctggattttttttcttagaaagacagatttgtcaattttcccagtcagacaaatgtagcagcgtcaactaattaaggagctgatgaaccttcttccagagaatggagtgtcacgggctgttatgtttctcttgtcactgtaatctgagtaccagctactatgcgtctgtgcgttgttctcgaacgaactagtggtcttatcggtaaagttaaaatttatattttcaagttgattttaaaatatttttaacatagtagttttattttcagaattggcttttaagtcccttaaaacatgcatatacaagttttatctataaattaatttttattttctaataaactgttttggtttataagggaatatgagtaaccgacgaggacataaacagcttatcccgatctcaaaattttagcagaataatgatcaacaagcagaaataattcagatagatagcgacgtgtaaagatgcaccaaccacatagaaatctctgtttcgttgcgtttgcctcggcgtaggttagggagcagaattggctgtcagctggtgccttatcgttgattggaaaagatatggaagttggaacaagccaacaaactgtatatgtcatcattttagggcaagcccaaaagcattttctagccgcaccatcgagaaagcattctagccgctcgatttcgagctggcattttctcttctggtcgtacaaattttcttccctaaattttacttgttttcagtcttttttaacaaaaagaaaatattttaagcctactgtttgagagcgtactatgcagcaacaaatattacaaaaaaattataactagagatagtattctatgatgtaattttcagaaattcacaccgactttcaagtaagttcaacaaaacatacttgaaatatatgttgctccgtgatttggatccccgtggactacgggagagaaccagggaattggaatctaatttcttaaacaggttgtttgggtgccattggagttggaatcatctaaacaatatcggcttccaagacgaaaatagtacatatccacattttatattagagtaaatttcacaaaactatacgtctatacgttttgtggtctatgttacagaaaactacacacactttgatacttggcacttaagtacatatatttcgatatttcggtagtgtagttttacaaaaccacactatcaataaataaattcaccgtgagatgatgtggctgttccacctaaacgaggacgtggcatcctatgctattaattttgcatgacctcctatgcttgtcagcgccggcgcggacggccgttccatatttccgcccatcgacgaccaccgagcaatatcgtgtagttctcaccgccttcggcttgcatctcgtcgtcatgtcagccacaagccagcgcctttcctctcactgctatcccctcgccgccgcgccacgaggctcctcgctaggcctcatcatctctcccggcggcccctcaccatcctctggtcatctctctccaatacatgctatgctcgagatgtggagttagcaggcaactcgctggctacatgcctctttgagtactgcggctgtgcggccccttgtgtctcattccagtactatggtggctctgccattctgctactaacaggtatggtttggttctttttttttttgtccaaggaatcaatcaggtgcccattttatagtgagttttaatgagcaagttccaactgaaatttcacataggtatgtagttttttgcctcactgttgattgattttgttaaaaaaaacagttaattcatcaaatatggaggtttctaatgcctctgaaatgaaagtagtacaaaacatgggagctataaggggaggacagggaattagtattctcagtcagtccactattgtacttaatttcaagtagataaattacgcttcagtggaaaggatcactcagtctgaagtttgtggctataaccccttgagttaattgattgttccattcagcttgtagtactggaacttgacaagagaagcacaatagtttggcgtagtactggaacttgacaagagaagcacaatagtttggctgtagacagtagtaggtggcttctttcatgtctgtaggaaagtgctcctaaaccaagcacaaccttcagttgtggtaagcacaatacagaccttaactcatggaactttgaaatgaaataaaaatggtataatgctccattagacatgttcacacatctagtttgatcaacaagtattcttaataaccagctcaacaaatagtgcaagaacaatagactcaaaacaaccatatagaaaggtgatcactgaccagaaaacaagtcacataataaaatccttggtaacatatcgcgctgggattggaaggcacatatgtgcgtatatttagttgcagcagttttagtgggccatgcgcatagaagtccagcttgtcccacgatgccacgtcctcgttataggtggaacaaccacatcatctcacgtgtgaattcattcattgatagtgtagttttgtgaagctacactatcaaaatatatatatttaagtgccaaatgtcaaagtgtgtgtagttttctacaacttggaccacaaaacgtgtagttttgtgaaatttactctttatattaaaaaaggatgtctttttttttcacgtactcttgtgacttaggccctgtttagttaccacgcaaaaactttccaccccgtcacatcgaatgtttggacacatgcatggagtattaaatatagacaaacataactaattacacagattgcgtgtaaattgcgagacaaatctgttacgaccaaatttggtaagatatgaaccaggttcggcattagaatcaaagcggattcggcaaagagttaggctcgaaaaacatagtttgcatcggctgcgaagacatcggctgagatggatcggacagagtacagccgatacggtcgattctgatgaagacagttgtaaaactgcttctagaatcaatcaacatgctacacaaagattgccacgacggagataagctcttagataggcaattgtatctattagttagttaggatatttcgaatagtttccttagagatatgtttggacaaaagtctgtcgtaaagacctatgtgtatcttagagtttgttagagataagagtcgtgtccggcgaggacatattatgtatctcgggtataaatatgacccgaacccaatgtaaacaacaacacacaattcaataacactttcgcgcatcgccaccctttttacttttgttctatttcgacgagttattgttttcgggttgagctgcatcgtttcgattttcaactagaggtaaacttgtcatgacggtttgcgttctcgagattagtacttccatctttatggtattctaatcttgtttatgtaattcgtcgagttatcgtatatactttataatctctgttaattgtgcttgttggtgacatgggaccgggggtatcttgactagaggtttggggcagctgcagtcacccacgtggcctgaccccctcgggggggggggggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggtaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtatgtttttctaagccctcgtcctctttcgtgtgcgccaagcttctcccgctcagcccattggccgaacgggcagtggcgcacaatctctctccgagcactagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggagatggcagcacgccccagggcgcgctccaggctgcgggcgcactcctgcgtcacccgcccgtcatccctgatccagagactccaacccgacgttggctagatgacgtggccaatttggtcatgacggcgcagcagcgcttaggcgccggctggcggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggcgcaatgatcgccgtgctgcccatgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgactaggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccaaggcacatatccgcgcccaggtgaagaagcggacttgcacgcggtacagcgaggggacgatgagtctcttcgctcgtacattcagcggttttgtcaagtccgcaacaccataccgtgcatcccagcacacgcggtgatctacgcgttcaggggggcgtgcgccacaaccgcatgctcgagaagatcgcctccaaggagccccagaccaccgcggagctttttcagctcgcggaccgtgtggctcgcaaggaggaggcctggacctggaactcctcctgttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcctagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgtgtgctcacgcttctcgccggagcctcaaggccatgaagcgagagcttctggccgtggcccctacccatgaggtgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggccgtcccagccgatcatcggtgtgacgccggggcacacttggccgctaggccatatcaacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcctatctccagatgaagatgccgggccccggtggccccatcaccgtccatggcgacctcaaagtcgcgcttgcttgcatggagcagcgcgcggaccacctcgccgcggcatccaagcccgcgggtggtgacgagaggctcagcacctccgtcccagccgccccgaggcagcggatgatcacgtgcgacgaggtcccgatcaagcaggttgccctgggcgatggcccgtccaagaccacacgaatcggtggtcttctggacgacaaataggaagacgcgctcgtctccttcctacgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgagaagtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctagttatcatcagattcgcatggctagggaggatgaggaaaaaactgcattcattacccgcataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaggagaccttactctcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctagacggaggaggctgaacgggccctcactcagttgaaggcgtacctcagttctcccccagtcctggtcgccccggagccagatgagccgttgctactctacctggcggcaactccgcaggtggtcagcgcggcgttggtcgtggagcgcgacgaggacgaccctcgctccgcgcatccccaccctgtgtcgactcgacccgggagagagcagggaggagaggcccccgagccgaatggtggcccgaggcccccaacgaccggaactggccctctgcccgcttgtccgacggtgccaggcgcccctgatccccaggatggccccggggccactgcgggaaggccgcgcctgtcgccctctgaccccgaggtcgtcggcacagaagccgagtgcgccccgtgcggcctctcggacgaagagcaccctgtatcgactcgacccgggagagagcagggaggagaggcccccgagccgaacggcggcccgaggcccccgacgaccggagctggccctctgcccgcttgtccgacggtgccaggagcccccgacccccaggatggccccggggccactgcgggaaggccgcgcctgtcgccttccgaccccgaggtcgtcgacacagaagccgagtgcgccccgcgcggcctctcggacgaaaagcgccctggagatgcggcccctggcgaagaggatcggccccgacaaaaggtgcaacggcccgtctactttgttagtgaggccctccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggcgccggtgcgggggtcacgttgacctcgccgagcggagatgtccttaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggggcgctcccagctcccttagattgattgcttagatcgctgagatccaggcgtacctcgcagataagactctacctgaggaccacgaagggagtgaacgcgtacagtgcatctccaagcgctacgtgctggtggaagggaccctctatcggcacgcggctaacggagtcctcctgaagtgcattcttcgggaacaaggcgtcgagcttcttgccgatatccatgaaggcgagtgcggagcccactctgcctcacgcaccttggttggcaaggcctttcgccagggtttctattggccgacgactctcaacgatgcggtcgacctggtccggcggtgcagggcgtgccagttccacgccaagcaaacccatcagccggcccaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcgataagcactccgcacttaaattcatcaggggtatcactgctcggtttggggtgcctaaccgtatcattacggataacggcacccagttcactagtgagctcttcggtgactactgcgaagacatgggcattaagctctgcttcgcctctcccgcccaccccagaagcaatggccaagtggagcgcgccaacgcagaaatcctcaagggcctcaaaaccaagaccttcaacatcctcaagaagcacggcgactcgtggattgaggagctgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcactaccagcagagcctgcggcgctaccatcagcgtcacgtccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgtctaacccgtggaacatcgaacaccttcgtcacttctacccctagtgggggtcaggtgttaggtctcgggctcgggccaaccccgcaccccccctcgggcgtgcagggttggccgggggctaccacatatgcatatacttatcttttttctcttccgtatttcaataaaagctttttcgatttcctaaggactgtgtctgtgccattgtttccttttgaagagttttggcttgaattagcacgctcgtgctcgaccctgccctcggtggctcgggccagcggaaatcgccaaacggggcccagaaccgagccgtgccccggggcgtggtgaactccgggggggaatcggcaaaggcccacaatcgggtccccataaccctcggtcaccacgctcccagcctggccagtctcgacacgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaagggggcccgaaggcctcggaagaagaaaggaaaaactatttaagattggcgggggcctgggggctcatttcgaggctcccgggtcgccggcctcgtggtcgctgtcgtccacaccaccgtcgccgccctcctcgtcggagtcgagggcgaacgcgagccgaggggccgtaccctcgaagctgtggacgatgtggtcggcggcgtcccggacctgcgcgcgcgcgtcgtcctcggttccgggagggaactcgtccaacgctgcccacggggagaagtccgggtccctggcctggtagcttgccagtacaagctccactgcccccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccgacgcggtctagacgggagacggcgtcccgaagcatgccgggccctacctcgcccgccaagcggagggcctcgacctccccggcggacgagtccagtgcgccctgcagatcagcgatggtgtgttcggcagctgcgaggcgggcggctagatcgccgtcgcccgcggccgcctcgccgctgcgcgccctcgcgtccagctccttcgcccgcgcctcgagctcagcggcccgctgatccagtgcggccctcttggcgcgggcgccttccagattacggcgcgcctgctcctcccgcgctgcctcgcggagggacaggctgtccgccagccgctgcgccgcggcctcggcctcctcgagagatcgctcccgctcggtgagcgcatcctcgcggaggcggagtgcggactcctcttcggcgcaggcggcctcgtgcgccgccagcgttgcctcctggatagcgacggcggtctcgcggtccgccaggtccttctccctcgcgcgggcacgctcttccagcgccgtggcgcgagcctcaagggtcacttcgcgccgccgggacgccgcctcgttctccgtcgcccgccgttcccgagcagtggtggcgtcaaggactccccgggcggcgtcgagtttcttctctagctccgccacccggctccgtattgaaggcggagatcgtcccgcgcctcgttgagcacggcggtggcgatgagggcaatctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccatcgtgttcgcggcggccagggcctgcaggaggggctctgtgttcagtggagcggcgtaaggcagaggggagagccgcctcggtgtgggcgctatgcggctcggcccgccaatcgacgtgccggactcaggggcgtcccccgaggctggctcgtcctgaacgtcgcccgaagggtcgggtccgagcggtgcgcccgcggcctcgtcgtgggtggactcggaagtcgtcgtcgcctcgggcggagtcgggtcgggggcttggcaggccgcctggcgtgcgcgcgtcgcctctgcctcccgggctgacttcccggcccggtggagtctggcctcctcccgagtggcctcctcagcctggcgaacccggacggcttcctgggcagcctcctcagcttcccggaggcggtccgcggcttctcgccggacagcttcccgcctccgggcctccgcggtcgctgtctcctcggcctcagaccggccggacttggaatggcgaggggggcgcgacggaatctcgctgaaagcggaagaaaaaccagaagacaaaaagaaacgggtaagtgaaaactcgccttgggagaatgaatacggccgcagtgggcgcggggacgaacctgcgaggaggtcggctaaacgaccaccttgggggggagatgaggtttccccggcatggttcggtcacccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagacgcacgaccccctcccggggtagattgttcccccctgcggctcccgcccgcgccatcgtggcctcgaggagcccgctcccctgacgccccgaccggctgcatgatggtcaggatgttggcgcgctctggatcgctgcagagggggaggacaccttgggggatgagggatgcctccacggagctgagattcagcacccgttggaccaccatctcgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggcgcgctttgtcggcgagaggggtgtagaaccagtcgctcttccagtcgtcccacttcttgcgaaggacgcaggaaatgtagcggttcagcaccggcccccgcggctggaagtagcaaccactgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaagtcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccagacgaaacgaaccggctcgtcccggttcgcgcgctacttaagtaatgtagtggtcttgaaggaagccgctcattattgtcggtcggttttttccttgacgatgtgcgcgatttgcgaccgctgggtttctgccacctgtggagaccggccccacctgtcaccaggtctaaggagtggcgtcatgcccgagcgcttccctcgggggggggggcgatcgccctggcgtaacgccgggggctactgtcggtgacatgggaccgggggtatcttgactagaggtttggggcagctgcagtcacccacgtggcctgaccccctcgggaggggtcgggcccgagggtgatgtggccgcccctccctctgtcttcccgaggggtcg

SEQ ID NO: 40337 - DNA, 4134 bp, Oryza sativa
atcccccctcccccattctctccactccatctcccccttggtctcccctctcccctctccattgcgccgccgttcccgtgccgctgcgccgccgttcccgtgccgccgcgccgccgttcccgtgccgccgcgccgccgttcccgtgccgccgcgccgccgttcccgtgccgccgcgccgccgttcccgcgccgccgtgccgtcgctcctgtgccaccgtgccgccgcttctgtgccgccgtacgccaccgtcgccaccgccgtcgtcgccgctgctgccgtcgctgagccgccctccttccccctcgcgtccaccgccgccaccgctcgggtaggagggagagccgagagaaagagaggaagaagaaaagaaaccgagggagggagaagccaaggaagagagaaaggagccgggagggagagaagaaagggaaaaagaaagagaggagagaaagaaaagaaaaggaaaagagagaaaaagagaaaaagaaaagggaaaagagaagagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataggaaatcaattcgcggtagtaatttagatgtaattaataactaaacaaatagttgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaacgaaataattatacccgcaaagtagtttaaatcgaaattgggtttgccgtagtttgcacatagtaaagttaataaaaaggaatcgactttcgcattcgactttcatttggatttatttggatttttatttgaattctaaccgaattcaaatcaatttttgcacgtaacaatagagcccgagggagttgcggatccaagcgaaggccaagacccgcaagactttgagcaaggcaagtcatcactattccttgaacatgttgatcctaattgcaaaattgttttgtttacaaataaaattgcatgcaatgatgaacatcctacttgtgattatgccatgccttgattattgctaacccttaaatctttgtaaccatgtttacgtatgagtccctagtcaactatgacaattgcttagaaatgctactctagaatcatgcatactcatatttatcaaatgctatatgcttggggcaattacctttgggaaggtaattgagatgcggcatgtggagacataagcgccacattgccattatgttgatgacatgatttgtgaaaggagaaataaaatttaacaattgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacctctgagtgaggcaggtgcgctacattgggacagccgttgaggtagggccgagaggcgtgccctccatcggtgtcgccattggtaggactgccatgagtgtgtaagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattatacttagctagactctaaattctttaacttgtgtgggatgggatattgcatgatgatttttatgctgatggagccacttcctgagaggcgggaatgtggacgtcctcagaaaaccataacgattcaatggcgggaagctatccttgggatcacaatggatggtggacagaaccgtcattgtttaatatgaacactggtattaaaacgtgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgctgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgattcctgttataaaaacgggggtctacacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcagtgctatataacttgcaattggctgatttttactgttggaaagtagccgatagagttaaatctcgttattaatttagattatattgtatatctactatctcttagagattttcatcatcttgcctagatcttatacttatctttatgcttaatgctgcatcggttgggttcgatctattaagtaatatccataattataaatatctagtttgttttatgattgtcaatagagatagtgtcggagttccagccgatcttacctgatttagctatttatatctcatatgcttgattgttatgctaaatctgccttttatattaaaatcttattgcattaaagtatattaggcttcttgtttgatatttttttgcttgttttgatatcttagtataaagtggtatcagagtattagccgatacacgctagatctatttggtcagctatgctataaacatctatataatctttgcttcaatgtatgtttcgacttaagtgatttatactgtctctgcatgacgaccgatctatcccaatcacttagtttaaacatatatcgaaggaaagattacatgtcattaatatctacagacgatcgagtagatttagttttatcttattcatttattactgccgatcgattcca

SEQ ID NO: 40338 - DNA, 1309 bp, Oryza sativa
tcagggagcgcgtcgcgtccgcaggggccgcctcctcctccggatcgtggggcgatgaggtgaggacaccgaggcgcgattgggaggtttcctccccacaccatttctgtcgcgggggtttaggcgaattcggtcccgacggggtagtgcaattgaagagaagaggccggggggagttggggagagatatatgctttgctctgcgctaaatttggtactccatgggtttaatttcgtagagggcttattttggtgccttgtttccttgcagtacaaacaattcgatggaaacagataactagtgttgaatttggaaaggtactgcaaaaccaaaatcggcgtctaggtttacaagtcaaattaggctattctgttcttggtaggcaccttgaattggatatgctggcatcccaactgactgtacgtttgtacctacatagacaccaggtgtagttggagtaagagtctactaggcgtctataagcccttgggaatatgaagaaggggcactcgaacagctcgcacttcaagtggtttctttcatttctaacttggttgttatctgatcatgcccttgagcttgtctgtttatcacttttatctacaactacgaattctacttgtatgtctgcagttgagcttattactcattatctctatctttatgtgcttctgcagcatgcattcttcaagagggatgagaatgagataagtccgtactcatggaatatcacagggacatataaaggtaacttctgggtcatagttacacttacacactcgatgttctacctgcttctttagctgaacatttgtatcactacagcatgtgctatagtgatatgttgtctttcgcttgccatacattttattgccgctgcatgtgtttggatgatctactgttgtaggtattccaggaattaagtatgtgctatttgctcttggaatattatttgaaacatgggaactgccctctattccctggagttcagtactgtacctgcattttaggtgctggaatgatttaattttagtgctaccaatttttctttcgaagattataagttaatgatatgctattcaaaccatatgatataatttgatcatgccttatcttctttgcacttacttcttttgtttcatgatattccttgtgcctaatattaattcactgctgttgcttgcttgtcataatgcttagagctttcttggatcttaggttaggacgttcagccccaaattgaaatgtttgatactttgattttcctgctgtgtatctagttagtaacaggagtcttttaacaatttg

SEQ ID NO: 40339 - DNA, 2206 bp, Oryza sativa
ttcctgcagccctgaagcccagcttctctcagaatttccaacacttccaaagtctaaacagttcagattagtacaaagattctaagactaattagttacaaaatctagaaaataaactagaaatcagaagatgagtaaaccagttttttttaaaaaaaaatctaacaaaatgattactcatcagctgattctcggaatttttggctcgtagagtaactaagccctaaacaaactcccaccaaaactgcacctatgctttgatcttgttcacaccagtagcttcagcacagttgttttatttctgaaaattcaccatttcacaaacaccaaatggatcgtaacacgaagatcacaatggagaggaactgaggaaggtcttgttggctgtggaggacaacagctcttgaacggcgaaccagtaaccaccaaatgcggaggtattgcttttcaagaccagccatcaaaaaactggaaaccagtctgcctcggaaaccacacattgtacagattgtacactgtacaagttcactcgtcttcacgtatgaaattatggatacggcctggcgaatacgaaatgtaaatgtgtcttattcacctaagaccaagtctaatagtatagcccactattaactccaatttatctatagccaatctaatagacaattcatacaatagttgtttatcatactattaatatatggtcccacctgtcatacacacattgcgtcttagagtccgtgctgcagctggctacatatctgtagctcgctcatcttctctctcatcttttatctcattaaaatatgtttatagctggctaatagcctgctattatacctgctctaattcagctcgtgttcatcacaacttcccagctcatagacgtgacaactgatggactgagatggcctataacctgcccgggtcaaatattttgcttagaggtaaagatcattgcaaattgcagctgtgctcagaactaaattaactatgagtctgaacggaggatgtacacttgagtaattaacaagatccaattaacaattaacaagctgtagacaggctaatttctgaacctggtccttctgcttatctgctcccatcattgaaggctcacttaggtagatttttggaacaatatcactccatatcatattcagatatcatattcagtagagtgtagaccatgtcccttttctgactagtacaagatacctgcggggatcacttgcaaggccgggcaagcaagcaagagaaaagatgcagggacaagcacagcttcagattgacatttcctgcaaaaaaatcagcaatttgtgttactttgcatggcaacggcaagcccttttgtgtgcatgggggaatccttggaaacgaccttcatctttactacatctctttcagaggttggttgtcaattacacctctcactttcagctttatattggatcccctaaaatatagtttgatagatgataacagttaacaaaaatatattccactgtcagagatttgtgctaatcatttagtagctgtaatttaagtagtgaacctaacgattctttacaccacttatagccattccaatcttttaccatttgtttttttgatggatacaactgtaaaggggggaaaaatctcaagaatgcaaggtcacgcttacgagtaggagagcacaacaaagtggaaaagacgttcaaaagggttaagatgaatgctgaagagaccccatccaagcatgatccacccaacagttaaaagaacagcactaacaaagacacacacttttctgatcaagaaacgaacaaaaagggagatgtataaataaaaaaaaacaagtgataatccattaattgttcaaggtgtcaatgataccatctcacgagctgatgagcttagtagttggtatacacccgtgagtgtgtggctgacagctaggagtagagtatatatatgttgggctgaatgatgctgtttgttgaactgtgacagtactagtacaaatatactccctccgtttaagaaaaaactcaatttaaaagataatgtgaccctcttaaaataataaatttgaactactctttatctagattatattaggagggatcatatcttctcctatattaagtttttttttatacggagggagtatacaggagagtaccaatgtaagtggatttggttatgcactagacgtagtacacat

SEQ ID NO: 40340 - DNA, 1753 bp, Oryza sativa
tcaaggtgtcaatgataccatctcacgagctgatgagcttagtagttggtatacacccgtgagtgtgtggctgacagctaggagtagagtatatatatgttgggctgaatgatgctgtttgttgaactgtgacagtactagtacaaatatactccctccgtttaagaaaaaactcaatttaaaagataatgtgaccctcttaaaataataaatttgaactactctttatctagattatattaggagggatcatatcttctcctatattaagtttttttttatacggagggagtatacaggagagtaccaatgtaagtggatttggttatgcactagacgtagtacacataagtaggtgtaggagaaagaagataccatttggaatttgttctagaaggttaatttggttttattattggttgcgacgttgccgtccgaggagatcgttttctattgtttagaggtgaagtctacctttttcatgtattcgacacgcgtaatttctttttctacgagatggcatgcaatttttactttaactccctttatcgtgaatatgtggatttaatttaaaatttggtggagtggtacatgatattatactcaggttgtagaccttttcccgtattttctgtattatactccctccgttttaaatatttgacgccgttgactattttaaatatgtttgatcatttgtcttattaaaaaaatttaagtaattattttttttctatcatttgattcattgttaaatatacttatatgtatatatatagttttatatatttcacaaaagtttttgaataagacgaacgatcaaacatgtgctaaaaaatctacggtgttaaatatttagaaacggaaggagtatttgagagccacgaggaggatatgggccaagcatgaaaaaaggccaacttagtcttggctctcagttcagtttgcattccagcttgtagcctgtaggcccaaatatagcccaatgaattattttcgaggtagaataactggctagatgagaccattgcagtgcagtaatattgtcaaatcaactaatcacaaggacaaaattcactaaattattatttattccatggacaaaaaattacatagactctgcacaaatatctatcatgacttaatcacatctcaaaaccctaaactctgagtactatatttatcgaaaactccttagactaaacttaagacgacgacaaccggcacatgcggtgagtggtgacggactaaggtgacacacctgccaagaataaaatcaaaaggacattttagtataacatctcaaatttttaacagatcgcacaaaattcagagagtttcaaattcaaatatgaatttacctgaagatctatgaagatgggggactagcaggcgctggagcagcggaaggcatcaatggcggcactgatggcgctgtcaaatcaaacacgtcaccagattaatcagattaatctcttcaaacaaacaatgcattagaaataataaacatgctttacgatagggtttaattagggtgtaatttgattagcaagaacttactgttgcacatggagaacgtctgaagtgggaccgtggcgccgcaggtgttggggagcgtcatcatcttcatcatgtcgacggggagcgggaggaactgctcaggtcgccattgatgccgtggcacaagcagatgggcgccgtgctcaccagcgacttgaacccctcgcaacaggtgcccggcggcgtctgcgcg

SEQ ID NO: 40341 - DNA, 12985 bp, Oryza sativa
  unsure (1)..(12985): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttattttagtcagggaaaaaggaaaggtacacttgatgatgtctcaacagttcatgatgagcactgcataatcatcaggctcaactgtagctcatggtctcatcccagggagatgattagtgtaatacaggcaacattctcattctcattctcattctcattctccaatccaaaaatattcttttgcactcacccaacccacccactgatataatccatcattccattcaactacacacctaatcgcagtaaattgttactccctccgtcccattttaagtacaaccatgagttttcgtattcaactttgatcgtccgtcttatttatttattttttatgattagtattattattattattattatatgataaatagtactttatatttgacttatatttttaaaaaaattaaacaaaacagacgatcaaagttgggtacgaaaaatcacttataatgggacggatggagtaattgggtttacataagaaaacaagctggatttgtatgcaaattgcagggaatacatgcctgcaagattccaatggaagaagaaagcatcaagtcaggaggggtaactagaggacagatcaaaggagatggtagtaacatgcacgcatcaccaaccagtctacactacacgcatctaccttcactcacagagtaacagtgccatacacacgggtgcagtagtacgtgtacaaaaacaaaacaaaacaaaaacatttgtcacatagttgcatcatcaactccatctttaatacttcccaactcaccagcattgttatcagctgcaactctgaactccaagaagatgcattgctgcattacataggtaggcagtttgtgtgtgcattgctgttgctgcagagatgggagaagctgcagaggaaggagcagtggatggaagctgccatggtgaagcagcagcagaagctctcgaggtgctcaggtccatggcaatggcgtcctcctcgctgacatgctccatcccacagttcccggcgaaatggcagtctatcaaggacaagctccggcagctctgctccggcctggattccctgtgcggcagcgtcggcttcggcgtcgacgtcggcggcgatgaggagaggcatggcgtgctggtgcagcttgtggcgtcggcttcggcgacggtgaggagcatccaagccatggcgtcgcagtgcggcgatggcacgtacaagggtgggaggctccggctgaggagtgatttggacaacctgagctccaagctggaggcgcacatgaagcagctcagggagatggcttcctccgggatgccgtcgccgtcgcaggccatcgtcgcggtgaggccaagcgccgacgccggcgccggcgagaagatgttctacatgcgggatctcttctccagggtcaggattggcggctctgtccagaggagccagtcgctggccaccatcggggagctcctggcggaggacgaggtgtgcgtcaagatcgtcgccgtcgacatcgacgacggcgtcgccttgctcaccggcttcctcgagtcgagcgacgcgcgcctccaggaggaggccgccggcgccgtcgccatggtggccagcttcgactcctacagagggatgctcgtcaaggcaggcgtcatcgcgccgctcgtccagctgctggacgacgcggccgccaccgccgccgtcgccgccggcggcggcgccaccgcggtcgccaaggagagggcggcgcaggcgctgcgcgagctgacggagaactcggacaacgtgtgggccgtgtgcgcgcacggcggcctcaccacgctgctccacgcctgcggcgacgccggcagcggcggcaagctggtggcctcgtcgttcgccgtgctgcgcaacctgagccgggtggaggaggtgaaggtgttcatggcggagcagggcgtggtcaccgagctggtgaagctgtcccagaagaaggaggaggcgcgcaagctcggcgccgtcgagctcctccacgccatggcgctcgacgacgccgacgtccgggaagaggccgtgagcatgggcgtgatccagtcgctgctccagctgatataccctgacctgccatactcctacaaggcaagggaggtcgcccttgcagccatctggttcttctgcttctcctccgtgaactccattgatgacctcatcagctcagatgttcttggctggcttctcttctacctcaacaatggcgattacgccgttcttgagtgcacactgaaaattctgcggcatttgtccgaggtttctgaggagtacaacaggatgatgggcagagcaggttatctcagtgcactgtcaagcttgcttggagcaaaatcatgtcgggttcgcgaaatggcagctcaagtgctctctagcttgctgttgcttcatccgaatcgcgtgattttcatccaagacggcgacaatttgaacaggttgctgcagttgcttgatccagctgagggaaaattggtggcaaaggacttgatcctttctgccatattgtccctggcagataccaacagtggaaggaagaagatcatatcatcagagcatttcagcagcctgaaggaattagctgatactggggactttgatgcaaagaaggttgttaagaagctaggaactaacagattccaaacaattttcagcaagatatggagtgtttaagttattttgacttcttttttttccttcagttcctttactgaatacacccttgatttagcattagtttatttgatttgttgtctatagtttttgcttgtcttgtaatatctatattcataattatgatttctctatgttgtacatttccacttctgtgaaattcaagtatcaatataatgccttcagacttctgtcatgatcaaaaccaagggactatatactagggtttacattatcgtcaataaccgcggttaccggccttaccgtgggggtacggtaatagaaaaaccacggtaacctcctcaaattcaaataatttttttaaaaaatgaatttttgataatttttgcacagttttgtacggtttttcacggttaccgtgcggtaaccgtgcttaccgccagggctgtggcgcggtaaccccggccccagcggtttgggaaaccctgctatatactgctactcttctgcagtttcgtttctgaatatagattagcaacaccgatttttactggccaacatttagcaaggcaggttcatcaaactgtttggcttctgatgaaagagcaatctcgattctcatctcatcagtctcaatttgcagggacacccaaagagtatcacttttattcctttgtgaagcaaggacaccaaaagtacttgaaaacagaaaatacttattttccataccatgtattctgagccgtcaactagacaactagacaactccagcaaatatcctgtactacattgtagataggccaaatacagcttcggcatctgaccatttgttaagactagcaggactgcaggaccaagtgtgtgttaacctgttaggaagtagccaaactaacagattaacccattcttattactttactggtaggagaaaaaaacagagagatagaacaggcaactgacaagtaaacacaggcacacagccatactgaaggtctgaagccaaacatgaggagtaacatttataacactgatatctctttcatactagcaaacaatgatcagcatttagtgagacaaagaacaggttgtcctatccaccaatttgcttgtttccttctcctatctttcgatacaggcgttcatcccgtgatacttttaagattagcacgtgaatctccagcaacgactgatccaggcttctgtttgtgggccaaaattcaccagattggcttgaattttgagtctgtaaatttactcacaatctgacaaccaatctgatttgtgatagactgatagtttacatgccccaagactgaaaatgcagtggtttggactcattgtcccatattagcatgcttatttatgcattttatcacccttatcatccctgggcagctaaattttgaacttactatactggagccaaacaaatttatgaggaaaaaatagaggtgtcagtttgtcactggatagttgtttcttgctgtcccaacacacaaggaagcagctaaagacaaaatgtagggaaatcagtaagccacttattgacttaaccacaccatgaatcctgtacttactcgaagtctcaaaccaaagagcacacttacaattccaaaacaagaaaccatagaatggactcatcactactactatctcttttcacacattgactagcataggaaggccttgacaaaagaaacaaaaaaaaaagaaagaaagaggaaccagaccatgagatatgaatgtaacagtagccggaccatttatgcaacacgcccctgcaaaaagaaaagcctcactcgaatgctagctcaagataagcaggcaccttgaacactcaagaagaagacggagctgagctgatggaaggaacggatcaaaccatggtggttcatctcaagcttctgcgaccgcctcgggtgcttcgacgtcgagcgcccgcccgtcctcggctgcagccgtgaagaacgagcgcttcccgaccaattcggcaacccgcttggcgcatccggaatcgcgagggctctcgtcaggaggcggcatggtcctgatctttgggagcatttcagcaaccttggatatcgtttgaggagagagtggatcattggaaggctcgatgaccttcgctctgatttcctcattctggttcgcatcccctgatgatcctgggagagactgcttgcgtcgcctctcctgtgctccactgcttccaagggaagcgccaggagtgaggctgtagcggctcgggatgaccctcatcttggagctccccgccatcctcttggcagtggcggcggcggcggcgctgccgctctgacttgacgacgcacctttgggcttgagctcatccaccaccttgttgcctccccttgtgtcagtagccttgccattggattgcctcctgggcctggggctcgggctcctcgccttcgctcgacttgctgctgttccttgcctcgagtccagtgtctgccttgtattgctcgacggccatggcttggcggggacggcgaattgcttggagggtcgggtttcttctcgaatggcgttgagcttggtggtgaacggcttggctcgcgccgccgctggtgccttgctgccgacgccgtggtggatctccaacggcccgaggctgacgcccctgcgacgctgcaccggaggctccttgattggcttcaggatccgcgccgtgccagcgcgttgctgttgctgatgctgcgccgccgcgggcaccctagggttcgccgcggcgatctccatgggcccgaggctgagccccctgccccgcgtcgccggaggcttcttggtgcgcagcggatgcttctcacgattgacgatggagatcacatccaggggcccgaggctgaggcccctcggccggggcctcaccttcgcgaccatctcccccatcggagcgtcgtcgcggttgggctccggctgcttggagacgcggagatggtggagccgggacgagaggcgcaggatctccgcctcgatgtggccgatctcggcctcgacgtcgtagccggcggcgacatcaacaacctcggggcggtgattctccttgtcgcccttgcggacggccgcgacggcggggctttgggggagccaagccgatctggaacacgaggagtcgtcgaaggcggcgttgttccagacgtggaccagcgggatgagcgggtcctcctccatcgcctccgccgacgaacccccttcgcctcctcctcctgcaacaacaacggcggtggccgcagagatcagagaccaggcgcaaatcaatcgacgaacaaacaaacaaacaaacaaacaaaatcgaaccgaatcgtcagcgagagcaaatcgacgagcacgcacctggatcgaatcgatcgattgatcaatcggtcggttgattcgagcggattccttcccctttgcgcgattagcgcggagcttggatcggattaggtggtgagaacttttgaaatttgtgggaaggggaggatgatgcgaggagggggcgagaggaagagggtttaagagccaggtcagattcgaccgttgggacttggggagcggagggggagcgcgccgcttatatatttacaagtggatttttctttcttagaaaaaaggaaaaggaaaatacatgagcagacactgcggatggagacatggtgtgtggtggggttaacaagaccgaaagacgttgtaggaagtgcgcatccaccaaactccgctccttgtcttctctccatcgaaccatcctgaaattcattttccttttgccagttttcgtctcatttttcgggggacatgtgtgcacactatactactcctttcaaaaaaaaaaaacagtatatgctttttgtgtgtactacgctagttactactacctccgcctcaaaataagtgcagccgtggatattcgtgcccaacgtttaaccgtccgtcttatttgaaaattttgtgaaaaatttgaaaatatttagttacacataaagtactatttatgttttatcatctaatagcaataaaaatactaatcataaaaaaattttaaataagacgaacagtcaaacgttgaacgtgaatagtgtaaaactacacttattttgggacggagggagtaccagtagagtatggtttctttatacttacgtttttaacgttgtttaatcgaggcatcgagtgttcctcccatacaaattagagccgtagattgcacgaatgcgcaaaccccacaaacagaaaacagagggaacaggaatgtattggagggcgtttgctttctgagttcagaaagttgccgccaaattacaaacttgtgtgagttttgaaatttgaaaggggaaagatcaaacttattcatttgttcttcgcacgtcacgtcatatagggcctgtttggcacaggctggagcttagacaaacagtttcagctccaccaaaattgggagtggagctgggtagagctctctcacaaaataaactagagttatggagttgggtttagtcagctccataactccactccagacccaactcctggagctaaatttaggagttggagctgtaccaaacaggcccatagtcgctaatgcaaaatggtacttttgcttgggctgatggacttgccaatttgccatcagcccatcagcagcccatgcgtggtggcggccttcggggcatgacatgaaagccccttgtcttcaactcaatgggccgcggaaacaagcccattgagaacatagtatgacggaactcgaggaaattagcaaaagcccataggcaattttataccccatctccttataccctttttattattgactttgcttcagtacgtcacgcatgtacacatagcatgtggtcaggcatacctggcccgtatctcacgagtcacaatcctaaatgaactttctcttcctttctcttctttatttgagaagatgagctaattttctctgtaataaacacctaaacaaaggaagaaacactaacacaaatcgcaatctgccaagcaacgtgatcgtgcagcttgtggagtaagcgaaccaaataattgagcagctttgccaagtaacagaaacaaataaacaagtatgccaagttgccaagccatagagcggtagagccccgtcacacaaacggtttggtacgatgcaacctagcttcccggggcacagaggagacacgagacaggccggatcgccgtcagttgggcccccagagcagcaggtgcatgatcttctccgtcttcatgatctccgtctccgccgcgtgccgcctccgcacctccgcctcccacgctctcgctctcgccctcgccctcgccctcgacatcgtcaccgcctccgcctccgcctccgtcgcctgccggccgcgcccgtccaccgaaggctgccgctgctgctgctcgcccttggcggcgtcgcgctcccgcagcagcgacgccgcgcggaacgcggactcccgcttgcactcccgcccgttgcacatcaccgccgcgccgatgcccaccaccacggcaccacctgatgctcgcgtgccgcgctcctcgtgtcgatttcgtgtgcaaagctactagtaatagccagcttagccagctaatttgcctttctggcatgttatatagggcgccacgaaatttttgtcgcccatgcgatgcggtgacgtgacgtgactggggctcggctcggccaacgggtggagcgcgtcgtgacaggtcggtcggtcgcggcctcgtggggttgcggcgtcaagcgtgcggtggggagcgcggcggcgtgcgcgcctcgactcgacaagtcgacagggcgggggggaaacggtggacgggagcgaccacggatttgggccgagccgttaggcacacgacgggggccgtcgtcgtacggcgcgaacccagagaaaacggccgttccaaaccggtgggtatgtgcggctcgcgcggcgcgggatgggggtgtgcaccgcacctggtgctctgttccctttctcctctccgcgtcggtgcaaccaacaactcgcgaatcggccagcgatatgttcggtttttattttcttcgctctgtgactctgtctctgtctcttccatttcttttcgtttctattttacgaggaggacatgttcgagttgtacgctgcggcgccggcgcaccatgctgcccactacgctctttttttctctcgttaagatagtacttattttatccctatttttattagcacgtttttaaactactaaacggtgcggtgcgttctgtacgaaaactttctatatacaagttttttttaaaaaaaatatcaaacgtatacatttgttaagtttgcaatagttaaaatttaattaattatatgctaatagttttcttattttacgtgcgtcaacttaatctttattttcatcactttttagagcaagtacaatgagagactataagcccgctataaacatatttcgaggagatgaaatagaagagaaaagaacagagggctacagatttgtagccaactgaaacacggactcccaaatacatgtgtgcatgacaagtgtgaaaagataaattgactattaagttaactatagataatttaaagccagcggttggctatactattaaacttgctcttaaacaccccagctgcgaacccacgcgcagcctctggatactcccgaggatcaccgccggcgcatattcgtggcgccgtttttattttagtgcgattgaaatggagtacaacaagtgtgtttagtacttgttgattgagttgattccgtcgcatttggcgcgtgcccatttgcttagtactaaagcccagtctgtacgtagaagactaaggcttaaggctctgttcttttggttgagttgggaacccatccctccggtacggaaaacgaaacagtccattagcacgtgattaattaattatttgctaattttttttcaaaaatggatcaatataatttttttaagcaactttcgtatataaactttttgcaaaaaatacaccgtttagcagtttgaaaagcgtgcgcgtgaaaaatgagacgggggagttgggaactccaggaaacgaacagagcctaaaggcaaacggaatccacacaaaagagagaatttcaactgttataaatagcagccgtgatgtggagagtacgctgattgttggatacagcgtgcagctcttacggcggcagccggcagagcgtgaagaatctagaggatgttgaacatggtaacataagacaagtatcttctgcaagcctttgtgatgtttcatgtgaactaccactcaacttcaacatatctttctttagtgaagagcaaaagaaccttattaatttttctttaacagagaggagcggtagtagagtactgatacatgacttcatgtgtttgtcacttaattaaaagttcccaaaccgtttgatttgtgttaaatcttataaaatccacaatctcattaggggttatatttcaccaacaaacgtgatttcaaaccatgtctgacaattacgcacgtgtgattacactttcaatagaaaagtacttcatccattccattttaagtgtagttgtacgtttctatgtctaatatttctgtccattttatttgaaaattttattaaaaaataaaaataaagtcatgtctaaactattattcatgttttataatctaataacaataaaaaaataattacaaaaaaaaattaaataagacagatggtcccacaactatgatatgggacggagagagcagtgatgtttataaaaacaatgagagaggggaaaagaaatgtttatcaatttacgagtgctcaaaagttaatcactaatttgactacacactttcagaaaagatcgtctgtgactttgttcagtgacaccagtcgatagaatattctaccggtgcaaccaaacccaactctcaagctaccctcaaccctggtttttgggaatcagtgtgtagtttactcgtcccaaaccagcaaccggagccccctgtttcgcactcatcgcgtccttcctcgctgccacccctccccacccgccggatcccccatatataaatgcccctcacctcgtctcctcgccattgccgcaactcacagctcagtgtcaaccaccacaaccacaagcaagcaagccatacacatcaagaaggcgtctgcgtgcgaggaaatcatccggtttttcaagctaaaagcgtgaagatgagctcgtcgtcgttgagcaagaaggcgtcgtcgttcgtggtgacggcgagcatgagcgcggtggaggcgctcaaggaccaggcggggctgtgccggtgggactacgcgctccggtcgctgtaccagcgcgccgccgccgccaagcaggtcaccggccgcgccgtcccggtgtcgctgtcgtcgcagaccggcggcgcggcggcgtcctcctctcccgccgccgcgtgcggcagggccgccaggtcgaagaggtcggaggaggagaagatgcagaaggcgtatcacctcgtctgctggggacctaattaaaatctgttcttcaaattcgtgatttcgtgtagtagttttttcgtttgcaatttgtccacccctcattttctggtgtgtaaatcgagccaatacctgcagggatttttgtattttgatccgttttcatgtactactacttccccatctgattctgatggagaattgctatgtgcaaactacggagtaaaaatcaacaagatgatgcgattgttgcacggaattaattacctcttctctgttgggtgttcatcatctgttgcaacagaaataaacaaaaaaaaagaatctttagttctaaccataactgagttgctgcattgttgttagtgcttggtagtagtggttgcatggcagagatgccaaacgcatgattgagtgaagcgctgatgatgatcagatcaccggccaaatgcgcatcaacatggaccggttaccgttgttcatcaacgctgcactcaatgatgcatttgattctctgtttccataccgacttgtcccctctgacatgatctgcatctcgttatataatagtgtgcgctctggaaaacactggatccaagcttgaacaagtggtactgcgtgtactactgtactacagctgctgcaactttcgtgtgttagatcgagcttgtactactgccaagtgattagcataggggtgtgtttagttcacgctaaaattagaagtttggttgaaattggaacgatatgatagaaaaattgaaagttatatgtgtagaaaagttttgatgtgatggaaaagttaaaagtttttttaaaaaagtttgaaactaaacacgatgtaggtagagcgtgtcttcacggccccaacgagtttcacgaatgtacaaggtgtcgaaccactgcccagctacaactagatttcacaaagatcaaacatcaagtttggtagtaccaagtatattgcccacaacaatattcaagattgtgtaaaagaaaaggcatacgtgcacactatttctttgtactgctcacccaactaatcatcctggtgtgtatctcaggagtaggagggcatttcaacctcgtcgtccatgcgagtcatgacacacaattgtccagttaaaaatgcttaactggtcatcaggatgcgtggcatgacacaccacaattgtccggttaaaaatgcttaacacacaaagatctacgccatgatttgcctgcttgggttggttgctgatgcactagtacgttgacctcatgttatgatgtcagcatcactagagggtgggctagctttgaactgggcttagtcatggcccatgggcttgtaaacatccaacgaaggtcataaaaacatgccgacgccgaacgtcactagtctctacaacatgcaactatgcaaggttggagagtaattcacggagcgaatatcgaataaccgccgaacaagcgcttaattttagcatttcgattaaaattcttggttgaattgcactatgaacaaaattacttctactacaagtctacaaatcaacaagttaaacgtaattaacctctacatgatcgatctcccaaattaaactaacctgtaggggcgatcagatcagaatcaaacagttcgtgaggcgccatttggtcagtattttttttttatccccgatcggcgtctcgccggagaaaccagagcacctcgtcgggcg

SEQ ID NO: 40342 - DNA, 7080 bp, Oryza sativa
aagccgtgcgccaccttgttcccgccgcggcgcacgtgggacacagccatgtcgtcgagctgcgggagcagcgcggcgatctccctgcacagcctcaggtcctcctccgactgcacgtcggcgcggtcgcacaccacgtcgaccaccgccttggagtcgccctccgcccagacgcgccgccacccgttccgcaccgccagctcgagccctcgccggagcgcggcgagctccgcgacggagctcgtcgccgtgccgatccgctccgcgtagccgagcaggaacgcgccgtcgtggtcgcggtacacgccgccgatgctcgcgatcccggtcgagtgcttcgacgacccgtcgaagttgagcttcatccacccctcctccggcttcctccagatcctcgccgacgccgacgagtaggcacgaagacgcaagatccgccgccctccgccgccgacgaggatgcaacccagaacggggttgcgccgccgcagcacacccagatcagcgcggtgcacgcgcagcatcaccgatcccctcgcagaaaaaatcgcaatctgttcgtgtatttagccccaagcggacccaccaatagggcaaggttgggaaatggctagacccaccggcgccggcgaatatccgccttccccggacttgttcctcttgagcgccgccgcggcgcaggcaaagctcgagcagcgctcaggcgcgccatggcggcgccggcggcgaaggagaggagaagggtttgcgttgcgtgtgttgctgtacttgataatgggctatagtcctatgggctacatgtggatcggcccatgatgacccatatttgtacccaggcccaggcgtcaattcattcatgggcttcattccaggccgtgtttgtgatcggtacgcagccatctcttccttggggcttttaactatttgccatttttagatttggcaaataactatttgccaccccctatctcaatgatatgtgggtccacatgtgtctatgacatgtgagttcagtggtaaaaaattaattacaacatctaaatgtggcaaatggtcaaatgcactgttctgactgcagaacatcacaaatcgtgatgaaacattgaaacacacacattaatcactggtgttggtagtcagcccactacacggtccatccatccttggacaaaagccgacgctgcggcccactacacggccccgtctcctgcgtactcaggtgactcggctacagcctacagagcagagctggttactctgcttcgtagcaaaagacgctttgcactttgcagcttggtgagcgtttacgacgtacgacaacgcgtcgcacgaagggaaactactaccgtgccgccgcgcgcattcctctgccaatttctaaaggcgacgaggaggctgtgtgttgcagtctcccggttaagtttccaggcctttttctgtgtcgtgtataacagctagatcaaggctgaggcagcctgcaattccaattcgccatagagagagaaaaggaggtttggctttggatagctaatatgctctctaagtaagcgattaactgatttgtttatgaacaagtgtggatcgtttcctgcgtatcagatgatcttggggataagaacaagccagcaacgctattttccaagcatatataacccagatcaatcgactggaatcagattccttcgatctcaatgcgtatgcatgcgtacgcattggaaggaacctttgctaacttcgaagagaagaagcacatcgtagcatctcgatctgcaactgtgtttgcaagcagacagagcagctagcacaggttgcgcaagcagcagtttgctgctaatcaggagacaccagactgaaaatgttgtgcccctttcaccggctcttaacccctggagattctgcatctccaatcccatattcatattcttcaacaacttgacactccataacactagttagtccagtatcgccactgattgatctagagcatggagagaccaacctagctgtgagatgagacatgcatgcattgcatgctccgttgctgacctaggcagctcgtgatccggtaccacacttaattaacaagctaattgattatttgattacagtactagcacttaattaaatcagccatggcgatgtaaccacgttgcagagaagaatcctagaagctagcagcagctagtagaaatgagcacagctgtgcctcctcgcagtggacagctcacctcaatctgtagcacacaaacactacgatccccaacaatccaatctacccaatttgcagcaaacaaaaccgttaaatcttttttctcagggagcaaggctcacgtgtgcatcgacagatcacagcgtgaagccgtggagaaaacaccaagcccagcgtgcagctgctttgaccgggcgtacgtgcatccgatcgatcgatcgatcgatccgagcagatgccgctgcggctgcgccctgtcgcgggggctccgcggcgcaacccgcgggcgctgccgccaccggcaaggggacatcgtgccgagaatctcaggcgcaggggagaggcagcacggcagcagccagtaggcaggttgcagttgggtttttttttctgaatttctgaactggccgtggatggaggttggggattcagaggggagaaaaaaccgagaaattgccaggcgtgaggtaggtgcacaggcagcacagctcagtgccactgccaatcatccgatgaattgataaaatatttatcatttgaaggcgtggcagatcagggcagtaatgaacgaaacattactacagctcatgacctggctacagttcacgatggacacctcatcagctaagaagcatctaccaagaatcttacttccatccacatcaatcagttcgatcaattctcaccggcaaaattcctggagatataactgatgaaccagttcaagtgcaacgcacacagatacatcatattaattcaccgcaccgtgcactaaacttcacgacggatctccgcccggttcgttgcaccttgcagacgtctgattttagtgattcgatctccaaagtctccgtcggcgctggaccaaaaatatcaccggagcagccacgatattgcaccaaatcaacacgctactagtgcccaaaaaaaaaacggagtacgagttggcagtagctgtgtcaaccgggggaaattccgtgaggtcacgaacgccgccgatgttggacaggcgagcgagacggcgacggcacggtgaattcaagaggacagtacgggtacagtggcatatggtgtactagtctgtcttgaaaaagggtaaaccctcgtaactaggattgattttttttatttttttctaagacgaaggggtacgtggtgatacttgagagaggcgaaggcagcaaacctggagatcgaaaaccgtcgctttcgagcccttttctcgtgcggatctccttgccgcttttgaagcttccggccacattttcggaagctcccggcccagcttactgctgaaaaaaaaaatcatcgcgtccccgtctcatcagttcgttggtcacggatgaggcaaacgcggatgaggggaaaaaaatcgggatgattttgatgggactcaaatcaacctgagaccgggtaaaacacacacgctatacgagtgtggctgtgtgggtgacgagactcgccagtaaaatttgacaatttgacatcgccttcgccgtgttgaattgggcaatctccagacggacggagggaggcaggccggcacgcacgtcggggtggctccgtgtgttttgacctcgccaccactcggagcaggcaaggaggctgctaattcttgactaatcatagtcatcaatcaagaagacaaaaatgaatagaacaagtattagctgatacagtaagtctttggagggcgatgacgtctgcgcccgtttgcaaaattgttcaagcgaacttcaattccttaatcgatcgactgattatgtatgaaaattgcaagaatttgggaggctgttcgtttccttttcagagaggaagaggcaatgtatggatgcacggacagtttgtgaaacgaagaagcttgctgatcaattaattcagattccagtttccacttggaacgaagaaacaagcagagtgtagtacatgagagtacaaatgcgattggaatccgcgaaccaatgagcagtgcccttgatgaatcctgatgctatgaacaacgagaagaaagaagaaagaaagaaaaaaagaagaagaatcctatccatgtcgaactttctaatgaaagaggaactgtgaggcctgggcgacggcgtcgtcgagccaccggcgaggctcgtccatgaggtcggggctgagcctgaccatgaggacgcagaactccatctcgctgagggcgccgtcgccgtcgaagtcgccctcggcgagcatcccccggaggtcgtcgtcggacatcccgccgaggccgagcagcggcgcgttgcggcggaggctgtcgaaggtgatgagcccggaggccgggtccatgagcaggcggaacccgcttgcgagctcctgcatcagcccttcctcccccagcctctccgccatcaccggcaggtagtcctcgaacccctcctgcatcatctgctgctgctgtctctgctccgccgccatgagaatgagtgaggttgactgatcgatcgatttgttgtgttcttgtttgcttcttgcgatctttgagaggaggagaagaggagagggatgatttgatgtggtggggaggaggcgggaataaataggggaggaggaggtggtgggcttcagagaagttgcgagagaggacggtggatgtgggggggtctcacgtgtgggtgcgtggtggattgtttggattggattcctggacgcgcggggacaggttggacgcgcgcgcgtaggggggaggatgggatgagttgggcgtgggctggagggaggaaaaccgcggcttcctgcgcgcttcggcttggacgtcgcgtcgggtcgggtcgggttgggtcgggtcggcgcgagcgcgtggctgcggccgcgtgggtgtgctgtgggtgcgtgtggctgggcaggtttcgggtcgtagcagcgccgacgcggtgacgtggtcggggcggcgggtggatggtgcgtgtcacgtcacgcttcggggtggtggacagacggacggacggtgtcggaggaatcgtgggaccatgccgatacgagatcagggatcatatttcttcgcccacgtataaatcaccagacaaaatttttcatcatatcacattgagatatcacattgaatgtttgacacgtgtataacgtattaaaaataaaaaaataactaattatacagattgcgtgtaaattatgtgacgagtcttttaagcctaattgctccttgatctgataatgttgtgctacagtaaatatttgctaataataaattaattaagcttaataaattcgtctcgcagtttacaagcggaatctataatttgtgttattattagtctacgtttaatacttcaattgtgtgtccgtatatccgatataacacaccaaaactttacgcccctatatctaaacacagtcgagaaaaatgctataggacggaatcttgttcgaacagaatgatacctctgagctattgttatctgatacctgatagatatcgactaataccccgttcggatggaataatatctttgaggtatcgcctgatacctggtagtggtaggtatcggctgatacccaggtatcaggtgatacctctaagatattatccggatcaaacgggataccgtctagtagcattcccctatttctaaacataacactaacatttcatgcttacgacacacgcatactcacatctatgaacatatatgcacaccttatctttatgaatatttttgaaagattaagtcggcatatattgagattgacgaagtcactacagatatctcgctgttgatgagtacataacctatcactgaaagaagctatgaatgtgagcattgtgtcgtagtatttttgattgaatggctccgatcaaacatgatttctacgaaattcatcacgaactcaaaaactttgatttggtcaagactcaggagagtgatttgagtttatctcgttgtgaaattcaggggttcctgacgttggacctcctctgctgcgtcgactcgacttgcttaggtctgatttagggtcacgattgagaagtttcgtgtcccgttttttggtcgcccatgttgggcacgtttagccgtaacaggacgaagtgtcacccatcctttacccaaagtttccatggaagcttcggtcagaaaccccaaaaaaattttgacaccaaggaaggatccatactccacatcgctttctcgagtccaagtcgcgagtagagcagggccagaggctgttcctacttggggatctcgtacggttctcttcctttccacagattgcttttgcttaggacgccttttcttgggtttcttcctctttgtttgctaaggccctgttttcgggcggtgaaaagttttattgtgtcacatcgcatatttgaagtattaaacatagactaataacaaaaaaaattatagattccgtcagtaaactacgagacaaatttattaagcctaattaatttgccattagcaaatatttatagcaccacgttatcaaatcatggagtaattaggtttaaaagattcgtctcataatttacacgcaatctgtgtaattaatttttttatctatgtttaatactttatgtatgtatcaaacattcgataaacattggataagatacggtgaaactttttgcgtgggcagagtaggactagtattttactcgtaccagcagccgggcctatctcacttcgttgtctgcctttcacatctcgaattctcgactccaatctccatattttccatgtgcttttcctctctgactactaatatcactttatttctgctgatgatgctgtcactttcacactgaagctctcagctcaagggccaatgggccatgttggtgactacttagtgagcaactttctaaaggaaacatgaagatacaacaaactaca

SEQ ID NO: 40343 - DNA, 1022 bp, Oryza sativa
ggacgttgcaaccttctttcctgcagtaattcaagtcggagagttcttaagtagccgtgaaacatatggtcataactgtcaacagaagattgatgcagtcatgctaactgtagctatgtatgcaatcatgatggtgtggaactagcttctcccgtgtcattctgggggtctgaatgcaacaattcggtgaagctttggtagaaggcagatgcagattatgtggacagtgccgttcctgcggttatctcaggaactagagagctatgtgtatgttttaccagatttattgtatctgctttgcacatatggatgcccattggtgcgataagctagcttgcactcaagaacaacaagagttgtgaacctactgccttcgttcccttacgctgtatctatgtgccaattatagctcccctatgatggaaagtaagcttttggcttcccctctcgaaagaagagaactgctgatgattttatatgttccaatgtatgtacacagaagtgaaacttcaccttatagcatccaggagattagacatataatcattgtggtactgtatccttttatcatcttgtaggacgtcttctaatctagaaaatgggtggttggcatcatccatacctgccataaacagctccctttgttaactattattatatgctttttaaggaaagaattcttatctactgtcaataatctccagccaacataccattttcagtaatgactacgggcgggtttccatacttttctttcacatgtttcatcagcttgaacataccccatggaactatgtgcagccaacttgatgctgcctgaaagttgatcaatacaaattttagtttcaaccaatcatttgactagaaatagcataaatgaaaggataggtataagtataacaagtcttagcaacggcaagaatggctttgcaaattgtaccgtttctcctattttcttcccatgtctataagctgccatagtgcatgcagagaagtcagtaatactgaaaacagaccaggaa

SEQ ID NO: 40344 - DNA, 2181 bp, Oryza sativa
tcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcaccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgatcctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccatgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcataggatggcatgcatgtggagtttagtaccaccttgcttattctaggagagggggacctccttaaaagggaggatgccctcctagccacttgaagcatgtgtggtggagagaagaggggaaacacacgcgcgctcgctcacctcgcctcgcctggcctggcagggcagggcaggcggcgcgcgtgcacaacgtacgcgtcgaatggtccgaaaaattggctcctcacccttgcgcagatgcaacctccttttgcagttttgttttgctgcaaattcggattcgtttttgttttggaaacgttccgaaaaatcgatgcgtgcaaacggcgtggagtccggat

SEQ ID NO: 40345 - DNA, 5565 bp, Oryza sativa
tcgtgccttagtagacacctgcgaaaagtttcgaccaagcagccggttttttcgtcacctcggtacgtgttcaatatgttgcgcatatttggtctgttcatgtttttctacgtagtttacatgtgtagatctaatgatgcgttcatgctagttttcatctgtaatgtcatgatttatttatggaataaattaaatcattatatgcccataatctcaacagctagtaggcatatgcatgccctctgcacttgacgtgtatgtatatattatttcagcttttacacattgaataaatacaatgtaactcatttcttgatctttcaaattaaggattagtaaatagtcactctctcagagaagtaggaggccagttacatcacgtttctcccttatataagctgcatcacttccccccttttatagaatctagctagctactaatttgctactaactcacaagtacagatacaggacagtacaagagctgaatgtttgtcttggcattttttgcacacctttaaccactaacgttaataaaaatcttggtcagttagtgtgtcaatatctgtgctacactctctaaataaaacagcactacatcaaaaaccttatataaagaatcttttgtagagacaatttttaaaatgcctctaagttttgaagctctatagtctagagacactttttagaggcactttcaaaatcgtctaaaatatttttactctagagacatttttagtatactttgttaagtttatctcgtagagacacattttcggcactttaaaatttgtctcatatgtaaatgcattttcttaaggcatttaaaacgatgtaaaggcattttttcaaatattaatatatatcaagtaactagatataagtaacacaaatcacatacttacatataattatatgaggttgagatggttagtgcgtgcctctatttgcatagagacatcttataaaatgcctcttagttcgtagaaacaattcaccaaaaggcacttatgagatactcttcaaaatgtcctcttagttcgtagagacaattcacctcttagtttgtagagacaattcaccaaaaggtatttatgagacactcttcaaaatgtctctataacactgtaaaggcattttaaaaatgcgacaattcaccaaaaggcacttatgagacactcttcaaaatgtctctataacattgtaaaggcattttaaaaatgcctctatagtattagaaaaatgaaaatatctctataagatatatttgttatagtgcagtgttatgaattgcattttattgcacggaacagacttgccagccgtcaactaaaagcctcgttatctgttggttagatcgctatacctactaaactgtttttaactttgatttgatgcgatacccgtgaacaagattcagctaagttttggccttctatgaattaagtagatccaaccctccctgttggacgtagctgtctgttcaattctggattgtcgtggcacgagagttttttagataatggatagaaattcggcatctgtagtgttcctattaggatcgttgtttgttagtattgttactacatggaaatcggtgtgattgaggctatatatctttcatcttctgaatctttggggacagcattactggggtgtgatgtgagtgagagtgagagcgtgtcctagttgccgactcaacacacaaagaatttgcaaaagttaactatcgttctctgcatattgcagattttgcagcacgatatcacatcaccaattcactatttgtcggtggcttgtactacgcatttgcaaacaccacatagctagctacatcaagctagataaaacaccaaacctgatcgagttgtgtatcctgaagactagtaatcaatcgacttaattaggatataacgtgaaaatcgatctttggctgccgtttgtgtcaagttaaccaatcattagcttaggtgaatggttttacttttcttttcagaaacgatgctgtcataagctgaaactggggttttgatcgaccgcaactaattttcaaaatataagcaattttagaatagtgtcaagtcaaacatttttaattttaactattaatagtaaaaaaataaaaaaaaatcaatcatgtaaaattgatgttactagacttatcattaacaaactattacaacttttttttatttaaaacatctcacttttatagatattgttgatcaaaataccatctcaaagactatgtcaaagtctaaaaatgttactccctccgtcccattttaagtacagccatggttttccgcgttcaactttgaccgtccgtcttatttgaatttttttttgaaaaaaattaaaaacataagttacgagtaaaatattattcatgttttatcatcttataataacaaaaatactaattataaaaaaattttaaataagatggacgattaaagttgggcgcggaaacttatagttgttttggaacgaaggaaatactattgatggtgaagtctgaactctgaaatggatggtgaaattaatactgaaattaatatatggaagagtgaatagttagtttacctgacaaccagatgaggtcggcgaggtcgaggcccttgctctggaaggaggagaggaggtcggtgaagttcatggtcggcgccgggatctggtccagcgcctcctgcttgatcgacaccctcccgtcgcgccgccccgtcgccacccgccagaacggcccgccctgctcgctcgccgtcagccagctcgccggccatcgcaaatgcgggagaggaggaggaggaggagcgaggtgctagcttacgatgacggagatggcgtcgcgggtggcgagcgcgaggatgtcggcgcaggagacgacgccggggcactcgctctcgaccacgctcttgatgcggtcgatgaaggcgaacccccgcagcgtcaggttcggcgccgcgtccttctccgcctccgccccgtccgtcccgttcagcaacaccgacgcgtcgcacccctacaattcaaaaccaccacgccatggccgccgtcgccgccgtcagaattccgccgccgcgccacgccgatcgatcgacgagctatacgcgcttaccctgacgaagcagtcgtggaagtgggtgcggatgagggtggcggcgacggagggggcgagggggacgtgctgctccacgtagtgcttcaccagcgcctccgcgcgcgggcagctctgctcgtagaacccctccttgagcacccacccctccacgccgccgccgacgaagacgacggccaccgccgccgccaccaccaccaacgtcagcggcgcggccattgccatagctaagctcaaagctgctttctctgacaatctctgagtggcagtgcactcggctatatatagagagagacagtgagaaatacagtgatgttcagtgtgttgttcagttttggtgtttgtatttgtatttacttggggtttggtttaggcgccattataattaggggagttacgcaactgaaaataatcagacgagtttggtaggtagaggagaacgtactaatactatatacacacacaagtttggtaatggacagcttcgttagcatctagtaggtgatcaagtcaccaatggcatctgagacgatactgccaatcaaagaattacactctgaaaaatagaccatgtactgattcatctgaaaaaaaattacactctgaactagtatgttctaacttttataagcgaaacgatgaatgtattgtgtatccattgtccctcttatacatattattaattataagcgaaacgtcttattaatgattaaaaaataatttatgaataaaacttttatatgcatcatgtatgttcttagcgatttaaatacgaatgatggaaaataaactactctaaaattaagttttaaaattcaaatttgcgcttatacttataagctcgaggctaaacgatggggtactcagtttcagatattatctgaaaaaatgacagtacattcagaatttcatattcacaacaatctggtgctgtaagcctgtaacattggtcaagatggcaatacatgccaagataggccttatcacaacctgcaagcttctttacaacacttcctagctctcctctctgtctgtatctagcatatgatccagctccatccataatccgtattcagtactccaatgtgaagaaaaggggagaagaatggatggtccacatgaacgcagattaaatggccacccaatgtgcaatgcatgaacaactgtgatgaacatgtccatctctgcactttcctttggcacttgctagtactagtacttagtagttgctacaccctccagtacttcagaagttcagattgcagcatcatgtacagctgtacattttgtactgaacaaattgtctcacattcagtataccactccaaacattcagtattggagaagaagcagcaaatcgcagcagatttggtgatcagtaggatattctacctgttacaatttaaaactgaatagcagtagcaacaaggacacaaagctagtataacagtagacgatgcatggctcacattgtatctatcacaattcataatgggtagggcatgcatgcgaggcctagttggaatctgaatatctatctatctgattgggttgcaaggatggacgaaactcaactccagctctaattggtgaaactgtcccagctcaagaagtttcctgctccggtctcttctgttacaatggcagtgtctgtacctaatctatcagtgtgcccatgaaaaaattcaggttaggttaaaggccatgtcattgcttaccacattgctatgttcttgggctcttggttgatgattcttgtcgagcaccgacagccaagtctgattgctaccggttgtcctgagtcctgacattcagattcctactgtaaccagaggggttgggttagcatcacatttttaaagttttcatgtatgttattgctgataattgaatgaataaatgctaagattaaaagcaaccgagatttcgctttttttagccgacattttggcatcacattattgtcttcacgggcatgatatctatctcctgtgagagataaggttggtaaacaaggctttacagagggaaaagaaagtgaacacatcaaaagcaacttcctatagccttcacatcttttgttggctacctatactgcagcctagctacgaatctcttccaagttcagagaattgaaacaacttttggaataacttgtcaccagcaaaaattacagtgccgagataactatgtattacacgcaatgccaatatgtatggtgtgctcctacttttctctgatgaacaaactagtaggttcagttagtttcagttatttcgatccagttcaggaccactctagaatctacatgttcatctttcttctcaagagagaacagaatcagcaagacatctttatcagtatattagtccatatggaccatgataaagcaatgtgcatgctcaatgtagtgaaagctttaagctgattacattgatgaatgatga

SEQ ID NO: 40346 - DNA, 869 bp, Oryza sativa
agcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaagcagtcccgcggtgtccaacatggcattcaccaagtcagtcagtgtgcggttcttcctttcagcaatcccattagactcgggagaatagggaggcgtcctctcatgtatgatgccatgttcctca

SEQ ID NO: 40347 - DNA, 8263 bp, Oryza sativa
cctgcagcccttaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccataactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccccctgccctgccctgccaggcgaggcgagcgagcgcgcgtgtgtttcccctcttctctccaccacacatgcttcaagtggctaggagggcatcctcccttttaaggaggtccccctctcctagaataagcaaggtggtactaaactccacatgcatgccatcctatgaggtgggcttttgtgattttccaaagaattaatcttcgagtgggctaaggcccattcattaattccaacactagctagtagtttgcgtcattgattctcaaaattttcatacaaatataccccctcctcctcacatcgatctcttcaaaatccttatattatgggatggatggagtagatagatactatgtagtaccagtgagcaatgatagttgtgatgtagacatgcatctgcatgccacagctaattacaccctcgtgttgatgtagtcacgtagatgtcagcgttaaatggatgttttgatgttttctgaagttgtagtatagtactccgtagtaggtctaacgttgcattcttaattaacactgcatacatatcacttaagatattcctagcttagctaccgtccacatacttgaggttcctagctagatgacaatactacgtgcaagccattgcaggagctgaatatcttgtagtacttgcgcatagttgcatggtccagaaaaacagatatccagtacatctctcgttttctcccattaattgcagagtactgggtatctgatcagttaatgaaatccgcaaactgctgaacaaccatctacctgtagatttcaattgaggatttggactaagataatatacaaatggtttttaggtacaaacttcagagaaactgcacttgcactggttttctatgaaattcaaccactcagttttgtcaccgaaccatttgaaatgggttatttggattattttcatataaggataaactaaatacttttagaaataaacttacttaacaaaataacaaatactatgctgagtgaagaagtatagtgctgtagaataagtagtttagaagcaatatcatagaaaaaaaagtttttcgagaaaacatttctttttagacgtggagtaaataatctaatatagtaattgaaaagcactctcttcgtttttttaatgaataacactgttcacttttaaacatatattttatcattcatctattaaaaaaattttatgtaaatgtataagatataaatcatgcttaaaatactttaagtgataaaacaactaacaacaaaataaattataattacgtaaatttttaaaaagatgaatggttaaacatgtgataaaaagttaacggtgtcatttattaaaaaacgaacgaaggtagtagatgcttttaatttacttctgaactcactaattgagttgatgggtgcaggggcgcacacgatcggcatcgcgcactgcaactcgttcagcaagcggctgtacaacttcaccgggaaaggcggccccggcgacgcggacccgtcgctggacgcggagtacgcggcgaacctgcggcggagcaagtgcgcggcgccgtcggacaacacgacgatcgtggagatggacccgggcagcttcctcaccttcgacctgggctactaccgcggcctcctcaggcgccgcggtctcttccagtccgacgccgccctcgtcaccgacgccgccgcggaggccaacatcgccagcgtggtgtccagcccgccggaggtgttcttccaggtgttcgcgaggtccatggcgaagctgggcatggtcggcgtcaagaccggctccgagggcgagatcaggaagcactgcgccctcgtcaacgacatccactactagtattatcactagctcatcgatcttcagctcctcggtgcttgataaaatttcagtagaaatatatatacatgtaacttaattcgatcgtcatcctgtttattctctctctctatgtaattttgtttccaaattgtaactgttttattttggagcaactgtaactatttctgtatgtgcccatgaatatatttcaattatagaaaataattcactttttagtcatagatatttaatgtttaggataatattcagattaattatcattaatattatattaaaataaattttaaaatgttttgatatatttacgattttacttttctactagacaaatttacgtatattgattttttaaactagaatttgagatcctactactagttaaagtttaaaaaattaactaagttttattattctaaagttaaattgctcccctctttctctctctctcttaatatctgacaccattacattttcaacgtactaatcattcatcttacttaaaataatataataaattgtcttattaaaattatataattattaattatcttgttatgaattgtacgtttaaacattgaagataatcttagcataacttatatattcttgtatttattttacataatttaaataataaaaagtaaaacgtatatttaaaattcgacgccatacaatactgaaaatcaaaggagtatttatgaccatataatcgtatttgcacgtggtcctccttgtcggcggctcggtggctgtcgccgtccacgcgctgccttctcgacagggcggtactccacccggtaggtaggcacccgtacggagctcggctaatccagctgaccattcaataattttagatatttaaatataaacttttgtagtgaggctgtgatcagttgttttggcaaaaaaaaaaaatgtatacgacacatatttaaagtattaaacgtaaactataaacaaaacaaattacagattccgcctgtaaactgcgagacaaatatattaagcctaattaatatgttattactaaatgtttactgtagcaccacattattaaattatggtgtaattaggctcaaaagatttgtctcgcaatttgcatgcaaactgtgcaattggtttttttttgtccacatttaatgttacatgcatgtgtccaaacatttgatgtgacggaaaagttggaagtttgaaggaactaaacacagcctgattctctgaaactaataacagctttcaaatggtctcctaaattcaactttaaccattacttcttaaaccaactaaaaatataatattgtgcaattattttgtaagaaaaaattgtggctttcatgcatccaatttaagcaatttactatattatggtagctaacgtttaaagtttttatcagataaacaaaacaccatatttcactttgggccacattttatcacctatatttcgctttggatcacatttcaactaatgttttattttggatcaagtaattttacctccatgatgtttggaccatcctgataacttttttatccaactatatccaatttattatataaaaatagattaaaggatgatccaaagcacatatcaatagtaaaatgtgaagcaaagtgaaatttactcaaaacgaaagttcactctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttcccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagcattatgccataacttaaattattcattgtcttgtcagttatgaatgtatagctcattatgtgtgggattagggaagaagagggtgacatgggcaaatggctacatctaacgcctaaaaaagaagtaatggtccagatttgcgtaggtggatttggaaccaactctaggggatctgcacctgtagattggagatccatccggactttgctggagaaaattttagagttgagcaccctttaggtctgcacctgtttctagatgttcaattcattggaaattgatgacccaactgatgggcaaacacatttgtgaattgaaaaaaagattgcatgagtactgattaggagctatgttaaaactcagcaatacagtctgaattaaggttgtttgtgtgatcattcggacacaaatgatgtgcatgatgccatgacaacctgttccttctgcaatctaatttccttctaggactagataactaaagccatagtttccatgtgaaactgttatttattgtataatgctaaatggtaagattttcgtattgataggaagcatgaaggttgatgatggtcctggcgtcaatggcagtaggtgggccaaaatgatgagcacagattcgtggaggtggtgtttaggattgatttacattgttgctgttgcgagtatatggattgctgcaagctacattgttcagtctgttgtggatgagggtgtttctccattcttgattacctacatatgcaattctctatttgttatttacatcccaatagttgaggctgcacgatactttgaggattctatcaacaacttttggacaaagttgaaaggcaaggatgttgcggacctggagcagtctgctgatctggagagcataaatcttctccatggaagtgaacaagagggcaatacagcctcaccaacaaggttgcctgaagacatattggcttcagaagcagtcttccctgtccaggccgagctgaatgtagcagatggcagcaaagggttggatgcaaaagggcgctggacacgtgctcgtgtggctagagtcagcatggtagtctgccctttctggtttctcgctcagcttacattcaacctgtctctaagatacaccactgttacagtaagtgttactaaggcctgcatttccatgccattatttaacctcgctcctgtccattggtaacatgtccttgtttctttgtacctgcagtcaaatacgatattgagcagcacgtctagcctcttcactttcttggttgcactagtatttcttggagaaacattcacgtggttgaaactaatcagtgtacttctctgcatgggaggaacgataattgttagcctagctgattcaggtagtacagcgaataccattgccacaaatcctctacttggagatgtcctttctattgtttcagctggattgtatgctgtgtatatcaccttgatacggaaaaagctgcctgatgagaaagaaggtcaaggcgaagtgagcatggctcagtttcttggattccttggactgtttaacatgttatttttctttccttttgcattgttcttgaatttcaccaagctggagccattccacaggctgacatgggagcaagttggtcttattgttggaaaaggtaggtttgcagtttacgcatgaccataatgtgagctataataatgcattgtgtttgtgtgtgtaaacctttgcgttgttttaaatataacattgtaggaagtcataacggaataacttcgtaaaagatcataaaagctcaaactatccatggactagcactaacatcaagctgttgtgttctttacaggtttgttagataatgttttgagtgactacttgtgggcaaaagcaatccttctcacaacaacaacagtagccacggctggtctcacgatccaagttccaattgctgccattgtggatacactaacaggtcatgctcctcatctattggactacatcggagctgctgctgtgttggtcggttttgctggcatcaacatacctgtaggcactccacagggttctcagcaagagcaggaaactcctatcgtcagtatggttgatgatccagtccatttaccaagtgatagaaatgctactagcatggttgatgatccagtctatttaccaagtgatagaaatgctactggtgctgttcaataaggaccggcttggctttggagtttgtcacaatgtatatttttt

SEQ ID NO: 40348 - DNA, 12059 bp, Oryza sativa
  unsure (1)..(12059): unsure at all n locations
tgttcccccttgccatgaaaatcatagagaaggggatagacagggattgaaattagattaacatgctttccttgctcataattttgagcaactagccagttgtgttcgtttttgagttaagcatgattatgaaaacattcaagagattgaatagaacatgtgtgtactaaacattcaaaccactcgtgttcttttttcttttttttgtcgggagcttagatcacactcactttcaagagattgaataaaacatgtaccttttgagtcgggttctatctattattttgagtcgttccgcccatagggtggtgtcgtagatgcaccttggtaaatgcgatcatcttctagcaatgagccaatgagaagttgagaacgctaaccaagaagccacttgaattaggaggcaatgctaataatcctgatggtgaggagtgatgctttaggaaaacaagggaaacaaagcaacaagcattatgcttgtctttttcgcaatccctctcgctgatactcccttccaaatatccctcgctgacgggtgattctttttagtgaaacacttgcattgtgctagttctagattaaaaaaaaaaaaggttagaataactttcgctggctgtcgtccgctgccgcgccatcgtctccccccccccccccccccatttggtgcagccgtccgccgccttgaagccaccggcgtcgcctcgtcggcgcgctacatgatcgagcacgcctcggcgtcggaggctgcgccgaagctttcgttgccgccgccgccgtaaaggtcgtcgttgccgccgatgtcgccgccattggtcccgatgctgctgctgccgtcgagtccgccgccgccattggcgctgtgcccgccaccgccgttggcgccatagtgatggtgatgatggtgtacggtgacgtcgggtcgaccgtctccagccggcggcggacgcggacgatacagaggaagcggcggcggtggcttcttcttcttcttcaagctcttccagcactggctccggtagatgtaggcgccaccgcacgccgagaagagagacgcgatcatcgtaacgaacacttgaacccatgaccatgacttgcagttgcagacgaacacgcgacgctcatccccgccggaatggccgtcgccgccagaaccatcattgccgccgccgccgccgccagtgcatgcagggaagccagcatagcaggggagcgcgggtggagagaagtacgaaacgtctggtggagagtagaaaatgggtggaggtggcggcggcggtgagagaggtggtgggcagaagatcgcagggggagggggagcaccggagatgatataatccatctgagctacgcggtggagaggatgaagctagggcgacagagtcgcggagagagagagacagagcgcacgccggcgaagaagaagatgggagggttttgtagtcttcctccctctgctcacggtgggccaaaaaaaacccagcaaaacagggtttccttcccagaatgtgtaggttcctccctctgctcatgatgggtcaaaaaaaaccaggttttcctcttctcatagtgggtcaaaaacctagcaaaacaggttttccttcccagaatgagtaggttcctccctctgctcatggtgtcttggtgtgtccaaaacccagcagaacaggttttccttcccagattagaatgggtaggttgggctaaaattgacccacctagctctgctgcctctgcatccccaggccagcctctccaggctccactattctcttgttttgggcctgttctttcttttcttttctttttttttcaaatgcagcattaggccactggcttccatactagtgctatatatggaggggggagggaggtatatatggatggttgaatgtgacacctcttggagcatctcaactgtttattccgatcatcgagccaaaaggccagtacaggccaaggtttagatcagctgaaagagacgcttcagatcagttgaaagagacagggtctttctgatagaaaaatatatgatgacgtgccatgagcctcttaatatcttgtactagtggctaatcaaatatggttagatttggaagtggcctgcatggtagtggcacaccgggctctcctagtacttctctcggcaagagtgacattgacgctggcactacaaactcatccgctgactgctggatcatcatatgttgaccatcatcattatttctatatagcaaatcttttcgcaataccattatataattttttttcgacatgaaactatattacatcttcacatgatgaatgctgtatagtaatacatacgttattcgttataaaatgttttcttattattatctaaaaaaaggttttcttattgaaacataagcttattgctaacaatacagtaatagtattagaagtactactaccgcgtttgaacaaaatatcaaattactcctctaaactattgtgacaatttaccaactgaacggttacaccaggctacccaaactcgttaatccaaataaattatcctttgaacactcttttaggcggttttggcatgagatgacacacatggtgcaaccggcactcttatcagtataataataataataataataataataataataataataataataataataataataataataataataataataataataataataataataataataataataataataataataataataataataataataataataataataataataataataataataataataataataataataataatagaacccacatgtcagatctctccgccttctctatttctctatttctactcaacaacaggatagacgagggaactcagcaacggttgaaggtagattggagctcaggcaatgcgatcaacggtgacaacggtctttgaagcaaatcccttctaaagcactcacctcaatgctgaccaagtgaccgtcccccgctggctgacgaatctcgcgtagagcctcctctccaccccgttgtcaccttctccctcgcagcaaaactagatgccaggaccgacgaggaggcccgcatcctactacctcccatctctggcttggcctcctcctctgctaaggtcacagcagtgctcgacgccatctttgggggatggcaccatgagggagagagaatagtaacggtattatttataaaagcgatccaataacaacgaaacaatatagttttcactatgttaggattcaacatgctttaatgtatgatatgacttgattgcttataaagtcttctggatcagcagcgaagaacaaccaatcttccgaaacaatgacgtctacacagcaaacgcaaaattaaaatagacaaaatttgctacaggacactcaaaaaacgtataattggtccgcaaaaacgagacacggctgatggacactacaaaaaatgtgtaattggctatagcataccgaaaacaatattttataatatccaggtcaaaagaggtgagaaattttcgaaatagcaagattgcccctagctccatcttcctccacctgaaatcacacacaaaaaattagcagggagcagccgccggcgaggttgtccacggcaagagagcaagtagcggcgaccgcgcaccaggagcggccgacggcgtggaggcggacgcggtcggggagggagcgcgagggcggcggcgacggcggcgcggagcgcgagcaggaggtggccgtgcgcgaggaggctgttgaacgctggccgatatgaggcttgctatggccgccggtcgctgggtctcgccggtacacctacacatccatgatcttgggtctcgcaatgcacggccacggtgaggacgccctgtctctatttgccggcatgcaacgagccggcgtgacgccgaacgaggtgaccctcctcggcgtcctcacggcgtgctgtcatgccggacttgtcgaggaggggctccagcaactcgacgccatgccggaacctcgcatcgagcactacggctgcgtcgtcgacatgctcgaccgcgccgggagactagacgaggcagaggagctcgtcgcggcaatgccagcacaccccgacgcgctcatctggggctcgctgctcgccgcatgccgcgcacatgacgacgtcgagcgcgccgagcgggtgatgtggcggcgcaccaccgacgccgacgcggacgccggcgactacgtgctgatgtcgaacacatacgcgtcgaatggccgccacggcgaggtggtgaaggtgaggaggcagatgaggaggaacgagatcgacaaggtccccgactgcagcctcatcgagatcgacggcgtcgtgcacgaattcaaagcaatcccagcaaattccatccgataaaaacacaacaagattcatcaaagaacaggttatccgattgatcgattgatcactgtagataacaagattcatagaaccaaggatgcaagatttccactggaaattttctacttctagctgtacatgagatttcagaaggcattatttggctttattggttattgctgcaagaagttgatgctcatttgggcttgtgattggcagcggccatgtcgacggccggcctctcgacgtcctccatgtcctcctcgcggacgaacacagcctggtcaagcaccgacggcgagccgccggccgccgccgctccgcagtggtcatggtttttggtgccggagacggcggcctcatccgccagactcgtggtcgggcacccacgcgtcctccgggccgccctccaccgtctcgtcctccgggagcgcctccacgttcttgcggttcagcgccgcctccacctgcgctccggcgacgccgcctgccgccgtggacgccctcctactcctcctccggctgagcctgggtgttaatcgaatgtacgcgtcaaatggttttcggtgctgatgtcgaacacgtacgcatcgaatggccgtcgccggcctcacgcgtagccgcctcctgctagcgctccacgccaccgccctcgcgctccctccccggcccgaccgcgtccgccttcgcgccgtcggccgctcctggcgcgcggttgccgctacccgctccacaggacaaactcgccggcggctgctccctgctcacaggtggaggaagatggagccaggggcaatcttgctatttcgaaaaatttctcacctcttcagacccggatattataaaatattgtcttcggtgttctatacctaattacataattttttgtagtgtccatcagctgtgtcttgtttttgcggtgactctcagccaattacaagttttttgagtgtcctgtagtaaattttgccattaaaatatattccctccgtttcaggttataagtcgttttgatgctctaagtttaatcaaatttgtagaaaaaatagtaatatttttaatccaagacaaatatttttaatgaaactaatttgatgttgtaaatattactaattttttttataaatttagtcaaattttaagcgttgtaacatgaaacggagggtgtcggtgacatggggccgggggtatcgtgactagaggcttgggtagccgcggtcacccacgtggcctgaccccctcgggggggtcgggcccgaaggagacgtggccacccctccctctgtctccccgaggggtcgggccgctcccgtttcggccccgagggctggggcgccccgaccccctgtggttttggcgccacgtgtgtgggttaggtgagcacagcggcgctcacctaaccgcatttatagcgggctagacgagcgcgccacgccgcattcaatgcggcgcagcgcatgcttatccggtctgtgaccagtcgcggtatatgaccggtcacagacctgtcagatcgcgggttaggtggcaacaggcggcctgtcacacgcctcgccccgtcccgtcggaatgatgagagcttcctggctctcgtccctagccggagccggcgtgccaactccaggagtgggtatgtcagtcccggtcagattcattccaggcttcagcgcaagtatggcaaggaagtcgctggccagtaaatgaaggttgaagtgggcatccccggaaaaagcgggcgggcggagaaggaggcgtgcgtactgcttgtcagaggtcatttccggctgtagattagccctcattgtaaaaagcatgtttcttttctgaggtagcgagaggcccgtgtggtgacccctaaccagataaaaaaagaaggcccaggcctaaagagggagagaggaggtcgaactctggggaggggattggagagtctgaactctctctcgctctcgagctctctggctccagagctctctgtattccttcacacacagatccaccagaacacaggagtagggtattacgcttctcagcggcccgaacctgtctacgtcgcccgtgtcttgtgcatttcctctctcgctgacattcctcagatcgagggcgaagaacctcacttagcgcccccggccgaaccggcaaaggggggcctgcgcggtctcccggtgaggagccccacgctccgtcagaggggtactaggttaagaaaaactatacaagcagcaaagctcataataggttattttcattgttaggaaaaatcagacacttaaatgggttaattcggaattcaaacggcaaagatattaccaattgaatttttatggttgttaaaatggatgttccaaatttcttaaattattttttatatattacaaaacaatgtttattgcgtcatgtcggccccacgcggtgccaagcaggtaaggctggagaccggcaccggcgtccggcggcatgggagccagggctcgccggcgttttgtgccacaacggatgatggagagctcatagggaaggagaggagaggatggcgggctcactaatgaggactctacggcgaggagaagacggaggtggccggcgacggcaaacccgatggcaaactgcaacctgagaagcttcggcgccggtacggttcgccgccgatttaatgcgattaagggcccgatcgggtgggattattatggttcaaatgatgagatgggagtggggaatcgattttcgcattcaaatgggagaggaaacgatcagggaggccgatggatgcatgcggtggcggcttttagggctcgtcggccgccggggagaagaacgagactcggctggaggaggaagacgccttcgacaggtgggccccacctgtcggtgcgggaggggctgccctgggctagctgggcgaggcggcccaaggcggaggtgggccggagagagaggaaggaagatgggctagtgcaggaggcgtggcccacgagggggaaagaaagagagccgtgggacagcgaggagggagagagagagagactttaagccgaacgggaaagggatattattttttcgattttgctatatctcacccaaaacattttttctaggatctcatggtggagagcatgcaaccattaccaaatgagacatgtatcaattttgttttgatatgcacccaaacatgtaattacaatgtaaatatgtaaatatgatgtaactattataattgaccgtaattatattcatatgatttttataaaaacatcttttgagtgatttatagctagtcccttattttttattttttatttatctttatctttactagcaaaagtgtccgtgcgttgcaccgggtgattacggagtgtgtgtattgatcaaaagtgttgtttggtttagcaaaagtgcccatgcgttggaacggaaagaaaagaaaagagaattaaattaaaacatattaaattctaatttaatgaaatttaaattttctacaatattaattatacactttgaaattttagcaaaagtgcccgtgcgttgcaacggaatgaaaaaaaagattaaattaaattaaaacatattaaattctaattaaatgaaatacacattttctggaatattagggtatttttatgttggtaggtatataattaaattaatgttcaagtaaagtaagtgtgagaaataaaatattatgtttggatttaatttttattaaattttctatattaattacactctttgaaattttcttggaatttacatagcttaattggtaattttggtaattttgataatacaaatatcatttcagcatttatttaaataaaagtcaaaataaaaatcatttttctctatgggcccttttcagcccattttcttctttagcctgcaagcgcaaaagtctacttaatacccccatactcctcctctcacttgctagtccaccggccggcgtgcggcccaaaccctcgatcgatctgagccgttcattttgatggacggctcagatcaattccaaattgatgaccctaaccctccccctcccccttcccccagctgagccggccaccaccctgcgcccaacgcctcctctccccctccctctctccccaccggcgccgcttcccctcccctcccctccggcggtgccgctccctctccccatctcccgcttctccccctcccccaagctggccgcctcccccaccaccggcgccgtctctcccaccaccgatgctgcttcccttcccttctccctcccttctcgccggcatggcgcggcgacgacagggtgcggcggagacggcgccctcccaacggcggcgacgacggcgttggcgttcgcgctccgtctcccgctctccttcccgtctcaccggcacggcgcagcgacggcggggtgcgacggagacggcagcgacggccgtccctccccctctccctctcctcgttggccttgacggtgatgacgccctctcaacgacggcattgacggcgatgacggcgtcggcttcatccgcgggtggatccgtcggcggtggcggccaccgcgggtggatccggcagcggcggctccctttgctgcctctcttttccctccggtggcggtgatggcgtcggcggccaccgatttttttttttttttgcaatttttttccatggctattgctaaccgaatcggnnattggcatacgaacatgatgaaaattagatgtgatgaaaggaaaaatacgaatatttatattagttatagattcataaaaaaatatattgtcaaatatataatactacagtatctgcttatttccaattcacaattataaatgatgtggtggcaccatggcagattggcagcagtgatgcgtgcctgctgcaagagacgaatcgtgccggcagcagtgatgagtacaagaaaaatcaactatacgaagctcggaaaagaaaaaaccggaggccatctagtggcccacggtctttattctttaatccctaatccccgtccgctccccagtccccactccccaccgacccaagccgccaccaaacccacttctcctcatcccaatctcgaatcctctgactccgagcaaggaggcaagcagtagcgtccggttcgctacctctacctctcctttcctccacctctcatcctccgcctcgagcattccctctcatcctcccgccccgagcgtccggttcgcaacgaccacggcgaaggggacaagaaggcggcagcagaccagcagtggccatggtgatggtggatctagcaaggcggaggctggcgttggggtggaccggtggagggcagcgtgaaggctggcaacgacctcaacttctccggatctggtggttgtaagtggcaatggaggaaggtgcaagcgcaggcggcaacggtgtgaccacaacatcaagtggtccagcgctgttcatcttctatccaggctagtcgccatcgatctagtgccggacctgaagaagctgaagaaagaggtcaagatggatatgtaagaagggatttgtcaattgctttaggttgcaatgctaattttgttggggtggattggagttctcccatggatccctttgttgattttatttgggtgaatctttggttattgtgtttgccttatggtgttgtgcatccgatttggatttggttgtgtcgaactatgaaagtctgattttgggaagtggttctatgagattagattattgttaggattatcggtcggtgtagttgtaatacttacaatgattgttcgattggtttgttaatcgatctttgatttttttttatctgtccggcgtacacgagtaggctttggccgtcgtacggatgtaattgcgcgtgtatatggagggtgccgcttttctgattgacggacccaaaattactatgacgaaaggaaaaatatgaatctttatattagttatagattatagatatagatatataccttgttaaacattagtagtgtttctactatccatcattcgcttacgtaagcatgatgttgcccccgctttaggttggagtccgattttgctttactaagggttatgaatgattttttgtccattatcgctctatataccagccgcgtacgatggaaaaatcataaaattaaatatcgataataagaaattcaatcgggcaaaactcaatacaaaatccagtcatgcaggactaaacggaccgagaacaccaccataaaattcaatcagctctgctcgtagcccacgccctcacctcgtgccactggacattggcccgcttcgcgggacagcggggaggcggaggcgaccattggcggctcagacacaacctagtgccccgcaacacccaccgtgtaccgccaggttttgaccggcacgacggggcaacgtggaggagaggttgctgatttttttttcataaacttggtcaaatttaaagaagcttgactaagaaaaaaaatcatatgactataatataaaacagaggaaatatttaaatatacatagtgattttttttcaataggcataatctaaattatttttcaacctatgccaaaggtagctatgagaaaagataataaaaaaacaacactagtagaagagggtaaacgacattagcgcgcaacatggttcccgagcttgtgagctggaaggggcccccgtagaaaaactgatcgccaacaataggagtaaaggtgtagtcatccttcttggtggagaagccaactaaaccatttcctgctgaccaggctcgcccttgctcatcgatgagttgaatgttcttcatggacgctgccatgttaccgttgtcagctggcatgtaaccgctgcccatcggaagcggaggagtcggttgaaatgtagcatttgtagccaccatgcctccaaaccagatgttagttgctgagttagatagtgtactgtagtacgacatgggaatgcgaccaatgagatcaggatccctgttaaacccataatgcaccatccaattcgcttaagttatatcctgtacatcattatcaaaaagagaaaaatagattaaaccttttttgttctcacataggagtattatccattgatatacgatattgattttttgggattggtgaaaaaacaaaaccttggttattttgagtgtgatgtattccttggttccatttggttgggaaataccagggatagaatcgttaggacgtatgtatgcgccgatcctgggttgaaaaccagggcaggttttgtccacgtgagagggatctgttaacggaaagctaggacccgatgtcttttttgaagagataaatgatattttttagtggctgcaagagtattagtaaacagaatatgaaatgctggatgtgtagaaaaatcactcacattgcaatagaggtcgaaaacaggcgtttatcacctggctcgacctgtgaggatattaagacgattaactagaaactaatgctttcctagttaagaaaaaaatataggacataaaccaaaaaatctaccctccaaccgatctgaatgacttctaaattcgatactggatcatcaacattatcagttatgatccaagctgaaccataactgacaatttggcccgggctaagagggaagccgtaaacgtccattgttgctataaatccatagtgtgcctcatatgtttttgttatatacccagctgactgaaagaaaaaacaacagatta

SEQ ID NO: 40349 - DNA, 10462 bp, Oryza sativa
tctctctttctatatgggaacgcttgttataaaaatagtaaagtccatcaccggtccctaaacttgtaccgctgtgtcatcccggtccctaaactcgcaaatcgatcattcaggtccttaaacttgttcgactgtatcatcccggtccctaaacttgcagatcactcgtttaggtcctccaacttgttcagttgtgtcaccccggtccctaaacaggacggtctaaaaactttataccaaaaaataattcataactttttcatgtgaactctaataaagacaaactttatatcaaaattgtagccctcgacgcgacctacaactttgtagttgaaaattttttgaattaaaactgtttagggtcccaaaatattgttgcatgtttatagattttgtaattttaattttaaaattacattttgggacaaaaaatgacgttaaaataaaaaaaacgtccaactacaaagttatagatcgcgtcgagggctacaagtttgatataaagtttatcttcattagagttcacatgaaaaagttatgaattatttttaaatataaagtctttagaccgtcctatttgacccagatgatattcaaatccaagtttagggactggggtgacacaactgaacaaattggaggacctatacgagtgatctacaagtttagggaccgggatgacatagtcgaacaagtttgaggacctgaacggtcgatttgcgagtttagggaccgggatgacacaacgatacaagtttagagaccggtgatgtactttactcttataaaaatataactacgaaggcaaaagattcgattacaattaattgaatggatagaattgtttgacaaatcaaactttaaacttttctaaaagaattacaatcaaatttaataaaatttaaattaggaaaattgcataaaaaaatcatttggttttcctatttctcctctacctggaaaccaaaaggatatttttttaaagaacttcaaccaaattggaagacatgtgtccatggagagagaaggtcaaataccattaaaattttcatcaaatttaattaaaattcattttaaaatttaaagttggggtaatatatttatctccttgatttgtttttaatctaaaattgttcttgcacttatgcttttcaaattagctttttatgtacgaggaagaggtagtatggtcattggaaaaaatctaacggccagctaatagaatagacataaagtagatcaaaacacataagagagatgacaaactcaggggtatgaaaaagatatgagcatagggcaaagatttagaggcacaaaaaaaaattcccaaaaatattacagtatgccaaacaacattagtacggagttcttatgtcaatctattcattattatatactgtattacattattaattaaagagaagaccaaagcaaaaaaaaaaccacattaacataaaaaaataaatagagatagattatacgtacgtgggatcatgttataacgttctgatcaatgtgattgtatctaaactacaactgcatgcaaacttacgcgggttcgttacaataaaagaactcacctgaaagatactgccgtcttcaataatgtatccgtcaacgatctctttgcagcgcgctgttcctccaattgcaccacattttctctgatgaaccaatcccaagagtacatatatatgattttgtagattgaaattaatttgagaatagatcgaccgatacttcatgcaaccataccaaattaaaagcaattcaatcagcaatgtgtagtgtaacataccgcttggttcatcgaaaagatcggcctgatcgttccattgccagatgcagaggaaataagcacgaagcagcagctcatcaggagaacgccgacgaaaaggattgtggccatctcgacaatgaacaattaatagttggtcgtcgtatgattcgagtctttagatctgcatataatatatatatatatatatatatatatatatatatatatatatatatatatgtttttctatatggaaggtatgttttaagaaagaatatatgtttcctttgatgctgatcgaagctcacatatatgaattatattttgaaatatgcattatttttcgtagttttacacatatatacatgtttctaacgttgttgtgaaaatatacttttcccgctgaacgggaacgcgccaccgcaccggcggcgcagcttgaagacgcgggaccgtgtcagtctagcggtgccgcgatacagttgtgcggaaccgacgcagttccgcggattggttgcgcgggattagtggcatgcatgcattagcagtaagttagattacgtgcgtagtgtagcatcctgtgagccggcattccattggctggctcgtgcaaagcatatgcacgtaagcatgcatgtattggaggagcatgcgccatcccgcatcaccaatctgcggggacgcgacggtcccgcaggacacagccgcggcaccgcctcgccaccacgttcccgctctcccagaccacggcaccgacgcggtgccgcagggaccgcagtggtgccgctcgttcaacatgcgtgaacaacccggctggcggttacgtagcactcccgcattcccatcgtgctgtacgggtatatttgtgctaattcttcttatgcatatatataaatgcaaatcattccaaaggaaggtatattatcaatttttttccacatatatagcatttttatacggaaaaaatagcacgcaaactggccttacttccttattaatcgtctaatattgctggagtaactatatatacaaagctaaaaaaattaattgttgttttctgtgtgtatatacgtagactatgatatggaaaattataaacttccggcagttgttactcccttcctatcccttttggcggctctaacaggcctttagatcaagtttaatagtagagtcaggccatgtttagttcccaaaataaaaattttcacgctatcagataaaatgttaatttggacacatgtattgaatattaaatgtaggaaaaaaaccaattacaccgattgcgtgtaaattgtgagacgaatcttttaagtctaattgcgccatgatctgacaatgtgatgctacagtaaacatttgctaatgatgaattaattagccttaataaatttgtctcgttgttttctggcggaatctataatttgttttgttattagactatgtttaatacttcaaatgtgtgtccgtatatccgatgtgataaccaaacccaaaaaaattccccaactaataaggtctcaactgtgagcttatgttaacatgtaccagtagaagagttacatggttattaactactagtataattttcttctcttctctctatctctcacttccttcggttccattattcttaatgttgtggacaaagttaatgtcaaacttcgtaactttgattatcaataactataaaaatatttaatttaaagtaattaaaacaacacatatagatttatctttcaaagtacaataagaaaagtaaacatgcatttgtttattatatatattataatagaaaaataaagtcaaagttatattttggagaccgtgtcattatccaaaacgtcaaaaagctatggtaccggaggaagtatgcatttaggttgtgtttagatccaaagtctgaatccaaactttagtcattttccatcagagcaacatgtcatacacacacaacttttcagtcacatcatctccaatttcaaccaaaatttaaactttgtgctgatctaaacacagccttaatgtgttcttgaagtactccttcctcccatactccctccggtactgtatatacctcatgttgatgcatgttgaggaagcgagcatgggagtacttcacatgaggtgagtacttcctatactttatattgaatgtattcttgacgttttggataatggcacgtcacatgagcttggatcagatgaaattagcgagtacttcatgttgaggagtatgcgttatatcttggtactgtggtacgaatatgtgaggaatataaaatgaactttaggtgcaacctgtcaaattaaaccttgcacgcagaaaggccacgatccggcacggaagctagtgggccgggctgcaaattccatcttattttatgtgggcctaaacgggcccatctactagccgcacgggagaagaaaccctagaaacgcttacctcctctataaatccctgcgagagccgccaagccgtcgacgcatagcgcccatctcctctccgcccgtcgcctgtttcctccgtaatctcttcccgttttgatctcgttttcgtctgattgctctcgaatttggtttgatttctattgtattttcgtttcgctggtagacaaatagatgttggagcggtgatgagcaattttttgtggactagagtttctgatactacttttgtagtatttgaagaccaaacccttggctgtctgagctcctcattctatccatcgctacgaccattctgaattagatttagattgttttatatttctgtttgcggcagctgatttgagatcttggtagcggtgatgagcaatttttatttggactagagtttctgatactgctactttgtggtagttgaagaccaaacctttggctgtctagttccagatctcacaaaacatactgttgcttttagattattaggctgttgtttatccttcgattaggttttagatctcttgattagatgcgtccattaccaattccggaggattattcagttcttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttcaaaagttttttttctgagtatgttttattgcttgcttgctttgatattgtttctgagtatattttgccgtcccaactgtgcatggtcagaagtgaagaatcggcagggatttcatattggagcattctgcaatcagagcaaatggaccacggagaatggaatgtgtttgtcaataagtaaaattgtactaaagtaaattgtggcaaatctgtatgttgatttgtactatgtactggtatcttgctctaaaacattgttaagttttaccagcatctttgcccaaattgaattcgtcaattcttctctggcgtcttagacggaatttggactataaacaacaatttgctctgctggttaaatttcgtacttcgtagcctaagaaggatgcttagttcgtgggcctgcttaacgatataggtggtgttattaagagttccacgcattatcacaaatttgaaaaatagattaatcttatatttataacaactaactttaatatagaaggtttctacacgaaactttacggtttgccacttttatcctaaaaaatatgttcaatactcctccgatccaaatatataagcacgaagtaatattatgaatactgtactgtattggttccactaagacagaagcgaaggaatttcttttaaattgcaaatgtcataccggtattattcattgaactaaaaatgtggatttgtacatgttccaattaaaatcatgtgcagggcccagtatgaaaatggaccgatgggaggctgggagcccacctggctagtcgccaaatacagcccaatgattttttttttcgaagaataatcatactcgcgagatggatcatcagttaattagcgtacgatgagagtttgacacgcaaatgacaaatccgtattgcatcatggagggacaacttcaaataaacagtaaactttatttatttcacggacaaaaaaaatacatgtacgctacttaatagcgctaaatatctactagtatgacttaatcacatcctaataccctaaaccttgtgtatatcttaaaactcctgagactaaagaagactacggctgaagcagacgacaggctacggtgacacacctgccagaaacaaatagacaaaatcagaagatgttagatgagaaaaagaatcataaattttaacagattaaatttcagagggtttcaaatacgaatttacctgaatatttacgacgatgggggactaccaggcgctggagcagcagcagatgggctctgaggcatcaatggaggcaccgagggcgctgtcaaatcaaacaaaacaccagattagattaattaatctcttcatcaaacaagcaatgcatgaaaaaataaacatgtttcatgatggtttatactaatctcttcaatcaaagaaacaatgcataaaaacaaaacatgtttttacgatggattatgttatcttcaaacaaacaatgcattagaaataataaacatgctttacgatagggtttaattagggtgtaatttgattagcaagaacttactgttgcacatggagaacgtctgaagtgggaccgtggcgccgcaggtgttggggagcgtcatcatcttcatcatgtcgacggggagcgggaggaacttgctcaggtcgccattgatgccgtggcacaggcagatgggcgccgtgctcaccagcgacttgaacccctcgcagcaggtgcccggcggcgtctgcgcgctgctgttcgtcaggtagtccgcgcacgacatcatcgacaacagcggcgtcaagcactcctttggctgcggcggcgatggcggcgccggtgccgccggcgaggcgggtgatgcttgagacggtggcgagaccggcgagctggggaacgggaacgggaacgccgggaagccggacccagacgacggcggagcgccgcccggcgaggcgggcgcagggaacggcagcgggagcgggaacgggaaccggaagccagagccagccgaaggcggagcggcgccgccgccgccagaagagccgccgatggggatcagcgggaacgggagcgtgaggaacgggaagagcgggaacggcaagccgggtaatcccggcaatgtcggcgctcctcctccggtggcagctttggactccccggctgcggcaatggcaggctcggacgccgcttcatggttgaacccttggaccctcgcttctgcggccggtgccagcgccgccgccgccacgacggcgaaggcgaagaagagggcggcgagcttggacgacggcgccattctgtctcgtcggcgagagatcggtggtgggtggtgagattggtgttgcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatactagcataaaaacctgagataatatagcatcagcactggcaatctggcacaagtcaaacagcctcaaaatcatagtacatctcaagagataagagataacaacgcattacaggagcaacagctgccaagtgccaagtcggcggctaggaagagaggacaaagcattactggagcaacagttgccaagtcggcgcagcagcaactttttcagccgtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaatttggacacaatgattagggatcacttattcattatagttcttccatgctgctctaccacagcaaaacgtttcagacaccatcaaaccagacttaaggatacacattacaggtaaatagtacacaatgaaacgggacacgaccaaggaccagaccagacaaccatagctccattggggaagacaaataggcagacttgtgaaccctagaacagcagcagctccatggctgaggacttactggccaccacggaggcggagcaccaggtggagtgtggactccttctggatgttgtaatccgcaagggtgcggccatcctcaagctgcttaccagcaaagatcagacgctgctggtccggggggatgccctccttgtcctggatcttcgccttcacgttgtcaatagtgtcggacgactcaacctcaagggtaatggtcttgccagtcagggtcttcacgaagatctgcatcccacccctgagcctgagaaccaggtgaagggtggactccttctggatgttgtagtcagccaaggtgcggccatcctccagctgcttgccggcgaagatgaggcgctgctggtccggggggataccctccttgtcctggatcttggccttcacgttgtcgatcgtgtccgaggactcgacctcaagcgtgatggtcttgccggtcagggtcttgacgaagatctgcataccacccctgagcctgagcacaaggtggagggtggactccttctggatgttgtagtcggcaagggtgcggccgtcctccagctgcttgccagcgaagatgagacgctgctggtccggggggatgccctccttgtcctggatcttggccttcacattgtcgatcgtgtccgaggactcgacctcaagtgtgatggtcttgccag

SEQ ID NO: 40350 - DNA, 3334 bp, Oryza sativa
cattgtcaatggtgtcagacgactagacctcaagggtgatggtcttgccagtcaaggtcttgacgaagatctgcatgcctcccctgagcttgagcacaaggtggagggtagactccttctggatgttgtagtcggccagggtgcggccatcctcaagctgcttgccagcgaagatgagacgctgctggtccggggggatgccctccttgtcctggatcttggccttgacattgtcaatggtgtcagacgactcgacctcaagggtgatggtcttgccagtcaaggtcttgacgaagatctgcatgcctcccctgagcctgagcacaaggtggagggtggactccttctggatgttgtagtcggccagggtgcggccatcctcaagctgcttgccagcaaagatgagacgctgctggtccggggggatgccctccttgtcctggatcttggccttgacattgtcaatggtgtccgaggactcaacctcgagggtgatggtcttgccggtgagggtcttcacaaagatctgcatctgcacacacaattaccgaagcatggtcagcaactatgaacatgaaattataacaataccaagcaagtacagcagaaatcagtcaatcaaattattccaatatgttagatacacgacctaaaccacaataacatcagtgtacctatcaacaccaacagtgacctaacaaaatagagagacgcaccgtgctcgagttcacaaaaataatctgcaggtctatgaactactagaattccatcggcaaactgattcaataactactagcactatcccgagagcacataaggcaggttaattaacataggctagaatttacaggtgcaacagttgataagataggcataagcaagtaaaatatcctgaaagctatgctatgtaatcactaatcaacaagacgcagcccttagattaaacatgaacagagtagaatctatgcaactagagggactgaatcaaaaacaacctaagcaaaatatacctgaagctgctacttggatcaacgagaaaaacagagactaaatcctactaattgaacagatcggaacaaatcacaaccctagcacagttctacttctagatccgaaccaatcaatacttggaccacgaacagcatcgctcataatcacagatccagcataccacgcgaaccccatctaaacctgttcaaatctaccacagatcgcaaaacggagactaaccacaacatctcacaatcacgaacaggccgggaaatcaaatcaaacgcgaggaacggagaggatcagaaaatcgcataccttgagaaggcgattcgacgcttcgcttcgaggggagatttttttttctctgcgattttggggttcgattgacggaggaagaggcgaggagggggtggggtatttataggtggggagggggggactcgtgagtgggcccaggggtgcggtgggtggggcccagtgagaatatagacaaataaagaaaggagagagggagaggcggtttggggagtccgtccccaccacgcaaacgcgagaaggaaagaaaggaacggaaagggggcgggtccagacggcgccgcggagatatcgaggaggtggaaagctgatgccgtttgctcacggcggggttggtggccgttaacacgcagcgaagcggcgttactgccgtgtacgttttgtgacctttcgaaagagagccccagcccaagaaaggctggccaggtttttttgtactgtgtacgattacgatggaagaaaacatactcgttgttttgtattggtacatactgggccgtagtaaaattagaatcagttgttaattggttattatatataccatcttaagctaccaaaattaataaagttgtgatggctatggtatattttggtagtgaattatattgatttggtatatattagaatcaatccaaccacaacacaaccaaaaatacctgaagctcaatattgatggtgcttttcgactatctagcaaatgtggtgaatggggctttataattgaagcagcccaggatgcactttgtgcagagactgatgtgatatatatatatatatatatatatatatatatatatatatatatatattaaatttgtttggtgctatataagaaacataatatcttcgtcccataggtgtcttcccagggaaaaaaatatctttcaaaaaatcaaatagccaaaagaaaatcatgatcaacaaaataatcatcaggtcgacattcctgatggcacgtagcatctgccctggcctcccacgcgcaggcgcagcgacgtcggcgtgccgacgtgataacggagacggagggagacgcgcatctgccaacggctacggcgccgtgccttgcggtccaaccacaccccacgtctctttctctctctcctgaattttctttccttttttccatcatcaaagctgcatgatttggccacacgctggtagtaccagcaagagccaaggaccattcttgctttaataaaaaaatcaaagaaaaatcgagaggctgaggctgagcctgagggagagaggctgtggttttcgcaaaggcggttttccttcttatccgctggtttttggttttccctcgtcgtcgtcttcctcgtttgagaatcacagtgactttgcaatagacaggcattgcagagaagagagagattgagagagattcctatctctcatcttcagatgactgtttgtttgtagagattctttgcagtatttgcagctgaactgcatcaaaatttttaatcagatggtttcttgtagtgttagtttttctcgttgtaagtaaaggatttctagttctgtactcatgtactggtactgaaagtctgaaacttggcgtgccgcgttcagttcagttcagtagtgtctaggcaaggtatcttcagataatcagatgaatagcatgaacaaaaaactagtaactgaacactacatgattttaatcaatggcatgaacgaaaatagagaaacaatacatgattttaatcagaatgtcaacctgacaacctggatttgctcaagggctccatcggttgatttaataaaccaaagtcaaagctaaaatttgaattttcaaacttaattttaaaatattttcaatgtagtttttttaaacattgtcttttacctcctccgtcccaaaaaaacctaatcccagctacaaacctggacataggttcatagctagggtttgtctttttcttgggacggagtaatagctcattaaaaacacatatacaaaagttttacctgtaaatcaatttgtattatactccctccgtcccataatataagggat

SEQ ID NO: 40351 - DNA, 15501 bp, Oryza sativa
ctaagagcaacatgtttatatttgtctgatactctgatgtgtatgtagttgtgtagtttgtaatttataagtatatcaacaagcacaagtgcctttaacataagcatgccccaggctacctgctaacccttgggtgcatcacaagcaaagggcattaacaattagcaggaaccaagtcattcggtcacatgaaggtagattatatgcccaataaaatagataaaaacaggcataaccacatgtaaggactcgattacaaagatgtatgtataccctagccccatacctcttcctgatgggagatcttgaatgactagagcctgcagggaagatttcaacatacaaaagttcagagattatatagaagtttaaaaatagaatagactagttacaacgaagaattttattggtagcatattacctctatctcgagagcgcggtctgtgatcacggaacaaatgatccctggcatctctttcaggggaattcctcctatggggtctcagatgcctacctctaaagtcatcaggtctatggtctcgtctccctacaattcagtatggtagtttttacatacatatatgtacaaagaagcaatatgccacaaaagatagaggagctatacacatatgaggcagcacacaaacccattaagcttaccacaaccttgagccatatgattattcaattatcagtaagtagcagaggcaccaacataaccccaggggggcataaaagagcagatccaatgagactaatgcatgagggagaccaatatatgatcacatatcacgtgtatgatgcaccacttaaaaaataaatccagcaccttgtaacgtgtcagtcatgagaagtgaataatggatggaatatccaatttttgacatcatactgagattatcacgaagaaagatcttccaaattccaatattgtcgaacaaacctaattccacttgtccagatattattggtattgacttcaaattttatatttctgtgatcatacttggaatggcaggcaagaataaagcccaagaggagaccttgccgctgtgtattcagcaaatttgttacaattagttgcaaaagctgctaggtgctttagcacattaagataacatgcatctgactgaaaccacatgatatccctcaagaaatctcctgtagcaagataagcattccagcgaccataaaatgtctgattaccaactgaaaaggtgtgcaatgaaaataggatgcgtcatcctctgcaagtagtcggttggagaaaatctctctgggaacagctaatttgtacagtagcaaaaatatgattagcaaagatgtcacattgttcatgaaactttggcagccaaagtactataagaaaaggataatatatgggcgataaaacagtacaacaaaatgatatcacacaaactgatggaattattacgctctagttttgtatataaatgactctagtgctgatatcacatgaccaggtgcaggctgtagagtatatttcttccaacaagtagccagagatagaaaccaggtcatcagtgtttatcttacagggcagctcttgtcagatgttaccatggttggtattcttctaatcattttctcttactactagctcagttccacaacatttccaaaagtttctgcagaaagcacacagcgcagatggaattgatatctctttcacttcgctgtacaaccagcatcccgcactgtctgtcatattccccacatatgcagcccatcctctcaggatttataaacgaaatccaacataaacagatgaaacgatgtatactcctattttaaaaagaatgctctttcttggggccatggtaggacaccatgaatcttctcaaaatatgaatatcccccaaacttttcaaactgatagcagatcacactcaacccagtttcactccgtctgaataatttcctagaaaacaatcggcacaatctgtccacaatagaacatcggcggagacagtaattccattgcagaagaacagatttagagccacctagctgcggatcgagagcacacggcaaccgccgagaagcagaaaagcagatgggaaggggagagcgagacggggaaggggaggagggagagggggtgcgcgcataccaggtccaccgcgaggcgggaacggggaacgaggcggcgggccacggagctcggcgtcgccgtgggcgaagctgcaggaggcgcggttgcactcgccttgcctccacagcgcgcacagcttcgtcttgtacgccgggccgcggcggggaggacccatcatctccctcatctctctttcaccaacccaacccttctcccgcggcggcggcggcggcggcgaggaggaggaggagacgagacgtggcggcggccagtggggagacgagaagagcaaagcacgagtgccgcacggcgagttcgggagacgggacgacgacgacgacgacgacgaaatgggcctcatagcaaagtccggcccatgtggcccggcaaatcaggcccatgttctctgcgcaccattagcggcccaaccaaacaagcccaaaccaatgataatattccttccgtaccaaattataggtggtctttttttttttacacaatcttcaattgcatacttgaaccattaatttattctatgctatattcccgatgaatgcttcaaaatatgaatctagtaagataacgtgtataatatttagcactgttaatacgacgattaggggcaattgttattagtcaaacatttaccgagttatttttttcttgtaaaagaacaccctataaactgtgacaaggagtaataagtttccgggcaggagtagagaatgaagagtacatacgatacatgagctgatactgctagcagacaggagtacatttttttcatactacacatcatccagatccagttattgcaggaaggcatctcaacaccacgaacacagcattccatgcgagataggactggcacgattcaggaaggtcgtatacatcaggaggattcagggaggtcgtcacatcaggaagaagggcgagccgattccgaataagggagagttgcagactccacgcatgttgaagcctcggagacgctccaggttcatcacgtcggagtgatccacgaacagattcacctacattcacaacgcaacacgttagatacacctggaaatgcctcatgaacgagtctaagcttcttgcttgcaaaatggtctgtcagcatagcattgtaataagcatagcattgtgcacagcttcagggtctcagggaagaattgaagattcgtttacccgtggcccgtatcttctgacgaaccactcggaggtgttggggttggaagcctcgaacatggtcttctcgagcccgagccggcctacaatcttggcgacgatgtctgcccgtagagagtcagcgcgctggcaaatgtcgtcggcatcgatcatgatcatgtctgcccctgcttccaagcacctctcggccctccttatcaacaggtcaacatcctcgactctttctgcaccacatcaaagtgaggaaggcatcataggaaaatgtagacagtacaatcacagagccaacagcatagccaaataaacatacggtgatagtattaaattgctttgtaactaaattccccaaggaaaaactgatgttgacaaatgtatgttgagcaacttttcccttaatgctgttttcttgcgtttgtacttacattgcttagtacgcagagaagtagctaaacaagggcattagaaagcgattgcttattatagttacctgaattctgcttcactggaactatgtatgccccaaatgccctatctccagatggaggaatatcagaactgtcaaacttcactgaaaacaggggctttgcttgcaaaccactagtcttgatgaggcggactaatctcaggagagcttcttccgggagcttgagagatccagcattcagctcgatggtgtcaaatcctaatgccttgcactcctgaaacggaacatctaatgtcatgcatgtggtttcagaattttcagagacaagtgtgtatcacagtgtaccactaccaatgtacctcaaaacaaacaaaatgcctgcatacctcgacatattgcttgaaaaaagaaggtccttgacgcagaagatgctctgcccaatctcctgtactcacatatatgtcatgcttgtgtgctaaatcagtaatctctctaaccagttcttttcccatcaaactatgagatccaccagtaaacttcaaaccatcaacaaaaggacctagagaatccaatatttcctgaaatagaacaggaaatgacagccttgagaacgagctgttttattccttgaaatccctaaccaggaggttcattctgttttcaagtgatgtactcctatctagattctagaattttcttcatttgaaaggaaacagtaatataaaatcttcctagtcacagcttcaatgcagcaataaagtagccagaaagttcatttgcattgcaagtaagcatcctcaattctcaaattctcaaatggcattaagcacttcatataatcacgggaccatgctatgtcgacataagagggaacagcttggttaagaatctaactgataaaactagctgtagctgctacgcattctgacatccacaaatgtaccacttgatctacaaactgacactgatcgttgatcgcacagactgaagattccaatatggtggccctgtttaggaattaacaaataaacaatcaagtcacgaagaattatgcagcagatagggcttcatttcaaacacgattcggtgggaatcagaacgcgattaaaagttaaaactacaccaaattccacaacccagcagcgattcgtagaagcatgaaacaaaaatggggatggattaggcggggggctctccgagaacctggagcgcgtggtgggcggggcggaaggcgtagaaggggctcctcatctccgtcaccccgtaccgccgcggcttctccggccggtcgtcgtccccgtcgccgaatccgcacccgcgcagcgacagcgccaccgcatcctctctccaccgccgcatcgccatcttctccggcgaacttagctctcgctctccctctcgttgtcgctgccacctgatcgagcgataaaaagccaaggggaagaaggagatggaaacttgccgctgcttctggaagcggatcggcaatgatgacgtgttgggatctgacgggtgggacccttgtctgcaccctatccagtgttatgatgtttgggctgggccgtttaatcacgggtgatgtacagtttgggcctaaatgggctacattttatgggcctttgttcgtgaaaagcccaatcagatttcgaggcctattagtgagttcgtttgacagtgctccggccgttttttttttcttgaaaagtcccaactgttttttttttaacaaccgtgcaaagttccattgatagagaaaaaaaattacaagattacaaccctaaaaggtcataatcaaaaaaaaggaaaaaaaatataccaccaccaaatctcaactattgatgaattgggttttgacagttttctaacttgttcatgtattggctggctataatttgacaccaccttcgaatgatggtaaaatagtccttgtttgatacgcctttttttccagagattttttttgtcaaatttaatgcttcggtgatcatctggtcaacatgcatgccttaaggattcatttgacaaatggaacattattcaaaggacattattgtatcttagctatttattattcacacctcatttaatcctagacattcattcattttccttttccaatcacacatcttataacccatttgtcgcacatagcctaaatttaagagtaaagtgtattgtttcggtccctaaagttgtttgcttgtgtcattcaagtacttgaactctcaaaacatattttcatgtctccaaacttatcaaagtgcctaaatcgccacaactcctctgggatcctacgtgacgctcacgtggcatgccggtattgactcattttctttctctttttcttttcttgtcttccttcccattcatgtggggaaaaaacgacagaagggaaacgaagaagggaaggaaaaagaagaagaagaaaaaaaagactagaatatctatctgacatgtcactttagtgttcatgtggcatgccagataatcaccacgtagaatccaataggctcgtgtcaatttaggaccaaaatgataaactttgataaattggagacttgaaaatgtattttgaaagttcgggaatttagaggacacaagtggactagagaccggcaagcacttcactctaaaattaatttgtttcacactgtttagctcattgagttttggtagattttcaaggtttcttttgcatttattactatatgtttaagcaggacatgtaatttcttttgactatgaatcctggagccaaaatggccaatctgatcagctcatgccgtgccaactgagcacccacgttgcatcaccgcttactgaacggtatcctaggacttgctaacggccatgcgtggttggatcatgccattatgcggtgacaaatgaacaaaaccctgccgcatttcagtgccggttgtcgatcaatcaggccatagcttagcccattggcacgaactgaactgttaccgatcagctcaaactttttttaatccccatagcccagtattattactgtattttgttcaaagattagaccagagtgtgcattgtacgcagtgccaaagattctcctaagccgcagacccatttacgatccgttcgtccgtttctggtccccttggaagtagcaaaacgtctcaagactgaagagtgagcccatgtcactggcatagtccatgcataagaccaaagagcaatttcagaggccagccagtcccaattgtttttacctaccagtttactccaagataatgccggcctctagctagctgcatgtgccaatgagacccgttcagtttgaactttgcatccatggagacagtaatactctctggccagctgaaggtagaagaagaagaaggcaatgatgaggaatgaatgacattagcagttacagacttacagttagcagtgcacagtcattgcagtattcaggttcttccccctgttcatcttgtagataatttctttcttgaatatacagtgattagtactatctgctttagttttggatcctttttctctagatggaatcatggaatgtgtgttgcgtgtcttgttaaaaatggagtggtttgattggcagcaatcggattgtccggcgaggaaggggagtcgccggagaagggggagatgccgacggtgtgggcggcgctcaagaagtcgctcaactgcaaatcgggggattcttgcggcgtgatcgagcgggaggaatctcagggcggcgtcacagccggcaagaagtcgtcgtcgacgtcggcggcggcgctgcgcaggtcggggtgctcgcggtccatcgccaacctgagggacgtgttccacagccagtacggtggcagccggaggcaggaggacgccgtcgccgccgccgccgccggcgaaggcgatgggggatgcggtagcccgaggtcgatagggagcaacgacgtgctgaacccggtgacccacgacgtgctgctcgccgccaggtcggacgcgaagtgcgagctccggatcagcacccccggccgcggcgcgtgggccggcgccggcggcggggtgccgttcccgcacagcccgctcctgctgcggtgcagcaccacccctgtctcgacgaggaagtccccgtccgccatgtcgccgctccgccgcgccgatgacgacgacgacaacgccgaggcgccgtcgcccgctcccgccagggcctcctgcgaggtcggcatccggtgccaccgctgcggcgaccgcttcgccaaccacgacgccctggagtcgcaccaccactccagacacgccggtaagcggagcaccaaacaccatggacgaactctcaaggcaagctttgctctgcctctctgtttcatcatccatggcgcgcgttcttgcagtgaccgagctggtggaaggcgactcgtcgaggaaggtggtggagatcatctgcaaggccgggtgggcgaagacggagaacgcgctgggccgcatcgagcgggtggtgaaggtgcacaacgcggagaggtcggtggcgcggttcgaggagttcagggaggcggtgaaggggaaggcggcgaggctgtccaagaagcacccgcgctgcctcgccgacggcaacgagctcctccggttccacgccacgacgctcgcctgctccctcggcgctggcgactcctccaccctctgcacgtcgggcagctgcagcgtctgccgcatcatccgccacggcttctcggcgaccagagagatcaaggacggcgtcggcgtgttcaccacctccaccagcaagcgcgcgctggaatgcatcgccggagacggagacggcgacgaggcggcgaacgcgggcgtgaggaaggcgctgctggtgtgcagggtggtcgccgggaggatccaccggccgctggagaatctccaggaagtggcggcgcagccggggttcgactccgtcgccggcaaggtgggcgcctacgccagcatcgaggagctctacctgctcaacccgagagctctcctcccttgcttcgtcgtcatctgtaaaccttgatgattccttctgcaaaactgcttttaagaattgaggaatcgaatcattgtttagagtggtgatctgatcccaggtattgttctgttctgttagatgctggcgatttgttagtatgtacattttgctgttgtttcttcttcagaaaaaaaaagcacatgattttagcagtttttttttttagatttgcaaatgcgtgtgtttatcagtggatgtttgcatgatgttgtggtgcttaggaatatggcatcaattcgagatagtggtgaatgttgagctgcatggataatactgaaaatgtgtgtgtgtgtgtgtgtgtgtgtgtgtgtggttctgaaactgatttcataccgccttgatctcttgtcaatacaatacattactgaattacaagtactaactactagtagtacaagaaagaaagcctttcaggcccaaccagacagcaacttggctcagtcactgtctcactgagcgtcactactcactactctactaccactaacagttggaactgtcgggatcctgcaggaatccatgatcaacgcactgtacgacgctgttcttgatgatttcctcaacatcatactcgaacctgaaccccaaatccctcagccgcttggacgataccaccgacgggtttgagccatggaaatctttgcttaacctgcagcttcatgccaaaacacaccagatcaacgtagtcctaatcaaacaccagaaaagcacaagatcaacttgaccctaaaaaaatactactactatgatctgaaagacatggatgtggctggttgacagctgcttgcctttttgcaggtttgaaaggagggtagtgcaaggacagaatctgagcaatctgggccatcggatagctccctccggcgcacagataccgtccatccgcttgctccgtctccatcaagaacacgtgagcgtcgcacacgtcctggatgtgtgccaatggcacacacccgaacctggagtgcacagatgccagcagagaatacagcttcggatcacctgcatatggagatgaacacacaaattgattttcagaacaatgctgttgatcattgcaagattagtacaatctgtacatgattatgtacttgtgtgatggagaatttgtttgcctgtaattggtgagaggaggagctggatgctggtaggcacattcggcgtcaagaacgggccggccaccgtcggcagcacgagcgacgccagattgatgccattctccctcgcgaacccgaatgccgcctcctccgtcatcagcttcgacaggatgtaaacctgcaaaatgttcattgatccatggaacactaagtttttcagaggattcatggagtgtagcaggtgtgtgtgtgtgtgtgcgcgcgcctatgtatacgcacccagccgatgggcttggtgttccagacgtcggcggcggcgcggaggcaggactcgtcgacgacggccttgcgccgcccggtcgccgccgtcgtcgtcgccgccgtcatcgtgctgatggacgacgtgaagacgaccctgcgcactgtccccgcgcggacgcaggattgaagcacgttgatggttcccctcgtcgccggctccagcacccgcgtcctcacgtgctcctcttcaagaatccatcaagaacacgaaaactaattaattacggtctaatccaaatgtgcatgcggttagtagcgattgatggaagtaatcttgatttggcggagattaaacttcgtaaattaccgatgttgttgtcgttgccattctggggtgggacgtggatgtccatggaggcggcgacatggaagaacgccacgcagccggtcgcggcggcgtcgaagctcccctcgccggccatgtccgcccggaacacccgcagctggtccttcccctcctccacggcggagaacacccgccacgccttgtctgccaccaaaccccggccgccggccgccatgatcgtcagtttcaccacgccacgagcttcatcgatgctagcgagcgagctcgcgcgtacggcgtacctgggtcgcgggcggtggcgtggacgcggtagccgcggcggagcagggcgcggacgagccacgagccgacgtagccggtcgaccccgtcacgcacaccggcccaccggccgccgcgcgctcctccggcgagccgccgccgccgatgctgcccatctgtactaccagctagatctggctcgcgcgctgcgcacgtgctgtcaaaggctgtgtgcactgtgcagcacaggttgccgacttcccgttgttttcgtgaccttgatgggttgcatcttcgtctcatgggatctggacaggtgtcaggtttccctcgcggagcaaaacgcaagcagaaaactgtggtttgcttacgatcacctggatttgatatttgcgtgccatatctgctatgttgattctcagccgtcagcacgagctcttgagctttcatgttatcaatggcaaatcagatttgttttttcctttttctgactataatcttttagcactatatatttgtattttttttcctactatatcaatagaaacatcgctatcttttagcactatatatttgtatttttttcctactatatcaatagaaacatcgctgcgggttgtttcaaaaaaaaaattgctaagcttgtttcttttatgatactcctatcttactactccttaaaaaaaagaacttatcaatcattcatgggttttatatgtacatctcatctatatttctatatggaaatggaccaaattagtcaatggttgcgaataatagctcaggacaggggacagcaacaacattacaaaatcatttgtatgagcgaatgtagctgaaccattctagtagctggttaacaagccaagcatgtcattggatacaaaaaaatgttggcaactgtatagaaatttacaagactctgaaatctgaatctagaaaagcatcaactcatttgggcatacaaaaagtgcagttcagaaaatgtgcaggactcccatgctaccatgatcactccgaacttccttccttgaacaccttgacccaattctcagcactgtcaattatttcaccagtcttgaccaggtaccgaaccttcgttccatcctcaaggaatttgtgtccaaccctactcgccacattcttttcctttgagtagagcatcacatttgagctgtgaatggggccttcaatctgatcaaagaaaacaccaacaaccataggttaacgatcaggcatctgaaactatatatacgacactagctagaagcagcacagaaagaagtttcaagagaaacaatgctgaccatgacgatttcacccggttcatcttctgttcctttcttgtgcttggacttcaagttcaagtccttcactattacagtgctgttgtgcttaaaaagccgcgtaacttctccaactttacctttctcacggcctgcaatgacttgtactgtatcgccaatcctaacatgcatcttgtgcaggacaggaagactgtttggtttacacttcttcctctcccatcgcttaagctgcattggaaaaagggaaatttcagacatttgagtaaatagcaagctgcagaccaaaaaagaattgaaacttaccctcatttgaattgggcatgtcttgatcataaatttaacctgcatataaaaatttatgcatatcttgtcagagtttcttatgaaaatgacataaaatgtaataatcagctgcttttgagatatgacatgaatcatgctcacgatgtttcttaggcaagaatatctaggataatcatatgatcttttagtacgagtttcttcatataagtgcagattttagtacagttcatcatataagtgccatatatagctcagtcactccattcaagagcaattattcggccttattttctctcatcaccactttccaggtaagtaattagtcgtgagtgagtctcattctgaggacgaagtgcagtagactatctagaagagctaaggaacgccaaaaagaatatacaaaagatagaacaagttcagtctgataagtataccgagtgtgccaatcatttgctacaggctatccccgagtgaaatgagtttccatcattttcccatggaagtcttctgtgaaatttctactgttgagtaatttaaagttcaaaggcaaaattgtttctagccagcgaaatgtgatctatacagcaggttagaacaagaaatggtctgtctcactagagggcacatctttcagaaaaataatcctctgcttgaaaggctgaatattgggtatccatcgcttataccaccataggaaaaaataatattcaagtttaaactgaaacataacaggccacatcccatggtagacaacacaatttctaacttctgaattcactcagttgatatactcaaacttgagatttcaagcattcattaattcatataaaccctccttatactagccaactaggttcaactataccacaaaatccttgagaccttttctctaaaaaaaatataccacaaaattttgacacaacgttggttgttggctagttgaggtcctgagcctgaactcctgaaggcaacaacagtacagtgaggcgatgtagacatcaccattgcaatgccacgctgttggtgagctctaaaatcctaaatctcagtgcaagctggcatttctacttttccagcgaatcataagagcagagcaaacataaaggaatgcgaaaaatgagaatcagggttgggagtcggcacaaaccccagccggcgcggcggcgaaggtggagagcgggtggccccagaagctgctggtgctcgccgcccccggcgcagagatggagagggacgccatcgcgccctgcaacgccgccaccccggccatcttcgtctcctcccctcctcttcctccctcgctcgctcaaaccgcagagaagcagcagaggataacgaacgccttcgtgtgctcgcggacaggataatggcgagcgcttttctacatgacaaatgggcctctaggccgaatggattggcccacttgtaagactcataaaggcctaatgaaaggcctatcgtaatccagcccaactacaacggaccttacggcccaagtcagccgcgatcccgttcaggctcaaatatagcgggcctcacgtaagccgcaatcccgtctcgacccaacaagaacaggtcgcacctacacagataaaatctattgtacatttctcatctctgctcctgattgaattacctccctcaaccgcaaaatggaggaaaatcggtcttattgtttggttatgcttatatttatgagccaaaatttgaatttgagaacttagttttgaatttgcttttttgtttttttaaaatgcttatattttacaacatttgctttaagttattatggacatatataaacattttactcataaataaatttttatttgctaataaacgattcgaataagcgaaaaccgtagcagatcaacccttagatggtttgtagggtggttcctgttgacgtggcaggctgactcgcagagaacatgagggaggcaaaatagacttactatcacgcacgtcagcaatccggttaaggcccaaatgtcgtgggccgctcgtcgtccgcaatcccgtttgtggtcaagtaacgtgggccgaacgtcctgggttgatatgggccgacacccgttttcggataaggcccagcccagcatacgctcgtcgtcttcctcgttgcgttgcgtggcttcgtctccacacgcatcatcaccacgccacgcgccgcgagatgctgcttcggcgggggcgcccaggcgtggcgcctcccggattccggcggcttcgacgtcgccggcgacgcgcgcaagccaagcgacagttgcggaggcaagcaaccccccaagttccgtcccttttgcgcttttctgggacccatttcctctctcttttggggggcgctttcgcggtgacgacgctgccgatgcgcgtacgcctgaggagttcttccccatcacgccgcgtgggggatcgggacgtcgccatttccgctgccgttttcttctctttggggggttgcaatctcgcgtttcatttgatagggttgggcgtgggcggtggggaatggggatgggtaggtagatggcaccgatgtgaatcggacgacttcgaatcgaagccttccgatccatgtgaggaggttgaggaaccaacctaatttcgaatcgaagaactcttggtttctctacctaaaaccaaatagcatagtgacagtggtcgttatactatgaattccaagctttttgaccgaagatttcgaatcatcgagcatctttggccaagctattctaacacggttgactcagaagtctacgtttctatgcattgtgtatttgagtgttagttactatatttcgtgataaacaaaactgttgactcaaaagtctacgtttatatgcattgtgtatttgtgtgttactgtatttagtgataaaccttaggtgtacatgtgagggatttcatggataacacgtgcactacattcttgcctgttccactggtcaccatcagcaaatcgctcctgtccctttcgtgtggctatcactggagctattcaattcttgaaaggctctgccgtgcaagcaaaccgttttctttccaatgggataagtgtgtgactgtgctataatctcaggataaattcatcactaaatcgttgctatcagttttggtttatccactcattaaatcaatgcaaca

SEQ ID NO: 40352 - DNA, 6452 bp, Oryza sativa
cctcaaaaacaaagaaactcatcaaagcacatgcacgctatgtgaaagctcaggatgatttaaagaggcgggttgcctgtttgtcacctatctgatctgcatacttctattttgtctatatgagaagacaaccctttttttagatcattacagtctattaacacattaaagggggtgcaggcgaagctcgttttgagaggttcgctgatttgcttgcttcagataccttgaagccgtgtagcaaggatcagggttctagtgctgctaaggaagatccatataatgcttatgaaatgagtccaagtgatcaacggcagaatcatgaaacaactagaaaaagatccgttgccctctcaactagcgaagaaggaaggaatggtaagctaactagatgacatgtttggagatatctatttaatagtcgaatggtttgtccgtattaacgctgccaactagatattagacacatccatgattttcctctgtggtaaataaacaaatgattgacatcctgttactctcacctgtggcttcttcagggaagaaaaggagagagagttatgacaacagggatcctatgtcagagaaatatagaccagaagatgctctagaaccttttcagagcagcaagggaactgaggcaaaagaactattatctgtgaagaagaatttgggggatggtgacaacaatgagaaaggaaatgttgtttcttctgcaaatgtttttacagatagggtgagatgctttcttgcttattctctttatattctctgtggttgctagttgctcgttgctatttctcagtaaaaattagctaatgttatgattcaaagttgatttcctttttgtttattatcaaatctggtagctcgtttggctagaatcaaatccgataatctaatgtttgttcattagcagctaataaccagaatactataatccatcagtttcaaggttttgctgattggttctaaatgaatcatttgtgttctgtgatccaagtttgataactagaataacttcgtgacaccatatggtaattgcatgatttatatgtatcatatgtgttctttatgatccaaatttgatatctaaaacaactctgacagcatttggtaattgcatgattttcttttatttcttgatctctttccatgttttaattttttttctaatatacgtcctccacataattccctcccactagtattatgcttccgtttccaaacattgccttggtatttttctcagagcatcatcctgacaatttgtgccctattttgcttacagtatgagggcggtgatgatgatgatgttcttgtggactagtaaattcatgcagatggagattgacaaagatttcagcagtaaggagtagggtgaagtatggaacatgcgttcattgccatgccagttgcgttttcacagactaacctgaaactaaggctgccagcctgttatttatcttaatgtatcatttaatacaccgggcattaggaattaagcatctcgataacttctgtggcgaagacgagttgcattgttctcaaacaggttattctcacatttgggcaaactgtgcgtcgttattaccatggattccaagtagcctgtatggataatgtatctggcagcctattcgagttaggtttggtattcatggattcatcattgtgttgtaaatttgtaatgctgcgatctttagcgtctgtgttactacagcatcccatggtttcactcggcatgaagcttcaatcctttttcttttttctttgagatggaagttgaactgtggatgctaaggccaccatcgtttggcttagaggtgaaaatggtaacggtaattcccggccgactggcgttcgtttttgacttttaaccggccgaactatatggaaatggtaatcgaccaaaaaaatatggaaatggtaaaaaatatggaaacagaaacggaaatggttttgctgttgtaccgatcattttcgtatttaccgtattcttgcgaaaattaccgtttcttataatatggtaattaccgtatttctaaatatgtcgatatttatagggcatgtatctacttgacccacaggttaaagattgattgactcttcaatcaaatccctaacttgagtgcatggctaaaatatagttatatagtacaaccctaatttatgtaaagttaaatatatgtttttatagtttaatgtttccgtatttgttaccggtttccgatctgtaccgacatgttttcgtccgtattattctgtttccggttttccaatatttccgataccattttcatttccgattttaccgttttcgattttgtttctgagaagaatatgattacggaaatggttgaggctgttttccgatcgtttctgaccgttttcatccctagtttggctaaatgcaccatatgacagcagatgttgtatagaggaaacgataggcgcttaaattagaatgtttcaatcccgcgtgagcctttgtgcatacagtattttagaggctttttgtaggaattctatttcttcaaccccttaataatgttgttcttcgcatcggttgtaatttggtaatgccatttttttttttgttattgaccagacatatggctaatattaagatatttctaaattctgatttggttgagttcggctacaaaccaacagttgctatcaagtcaatgtggtgtttgaaagatgaatataaagattaagtgtttttacgtaaaatgagatggtattacgtatgattaattgagttttaattattacaaacttgaaaaatatatttatttgatattttagagcaacttttatatagaaaattttcgcacgaaacacaccgtttagtagtttaaaaagcgcaaatattcaaattttcatccaacttttgttcaagaaaagaacagggcctcttttcgaaaatcagctatttacgagggatgtttctgtaatttcacacaaagaagagggtacaagctctcgctctctctcggagtctcgggaatcctctcccctccaccgccgccgccgccgccatcaccggcgctccgagccctacctccctcccctcccctcccctcccaacccggctgtctcatggaccggcaagcccaggactacgcggccgcggccatggcgtacgcgcaggcgcagcagcagcaaccgcagtacggcttccaccctcaggcgccgccgccgccgccgcagtacccgcaccacccgccgccctacgccgcgccgctccctcagtacgcgccctacgcgcgcggcatgccgcccccgcaggcccagcagctctactcgcacctcccgccgcaccagcagcctccccacttcgccgcgcacgccatgccgtcgccctccccgccgccgccccaccccgcctacatgcacccgccgccgttcgactccgcgccaccccccgccgcggccccgcccccctccgacccggagctccagaagcgcatcgacaaggtcgtcgagtacatcgcgaagaacgggcccgagttcgaggtcgtgatccgcgacaagcagcacgacaacccggactacgccttcatcttcggcggcgagggccacgcctactacaggtacaagctctgggtctcgccgcggccgccggtggcgccgtaccctcccgggtcgatgcacatgatgccgccgccgctgggtccgatgatgcgtgggccgccgatgcaccagccgggttacccaccgttctacgaccagcaccagcatttcggtgctcacggccatggggagtatgatgccgcgccgcagcaatccttcaagggcctctccgggccgcttccggtggatgtcgcagctgagctgcacgacgtgcttaccaatctcaatggcaccaaggagtcgatcaagggtgccaagacatggttcatgcaaaggtcgccgttcgcgccggctttggctgaagctctgaaggatagagtgtttgctttagaggattcggagaggcagctccacattatcttcctggttaacgatattcttttcgaaaggtatagcttcgatcggcatctgcttttggtatagaattgctatcctctgctgatgtgaaatgaaggcacgctgtctgatctgattgactgaataaatcacatgatacgatgaagaaagcaagaaaacattcctgctgcaaagatatctatttgcctaatatttagcaactcctttcatggtactagttaggacttaggactacttgtttaatcctttgtccaacatggagatgaatgtctttaggtgtttgttggtccttcaaaaactttgcgatgaactgaggtttattcctagtagatctgttatgtcatatgttcttttcctgaaagtcaattctgttttagcttgtgcttatatccatttgtcaggagggtccataatcagatcttagcttctacataatgtaaattaacattagaataatttgattcatcaagatgttagcaatagcaaaatcagctcattgcagacaacaatgttgaagctagcatctgaggataaaattcaaatgcaatgcatgttttatcaataatagcatgaatgcttgatgatgatatttctgctatatgttgtcaatgtttgatgataggtcatatggatcagtagatcgctttggtttgtatcactcattgtactgttttattgataccttttgtgcatttgatctggagaagctgattgtggcatgaaatctttattaattaaattaatatgtcacgactacatgacctttaatcgtttgtttttacatattcctggtcctttgctgaccatgttcgatctgctgcagcttacaaagacgaactaattctcgggaccttgacaatgaggctttggcttttaaatttgtgctgggatcaatgcttgcaaggatatataacaatccacagagcaaagatgataaccagattcgcctcgagaaaatcctgcagttctggggttcaaaggaagtttatgaccaggaaaccattgctaaccttgaaagagacatgaaaggtggggtagcatatcctttgccaccacggcatgtctcaccggatccctcaacattttcaggtgtgtcctctctctttttccatctttcctattattttatgtctgtacatgttgtctacattgaccagcacatttttctcatgtgagttcataaagttttaaggtgttagttttggcataaggattttgtttgtagttttgtgctattgtccttacttcttttgattggataactttttttttctcgaatactgatcagattactctcatgattgttatgtttatatgttaatgcctaaaaaataactttgtaagttggtatgtttgaagtatgtcggcagttcgctaaatttcaccatgcaacagttatctctacttaaatacctttgaagttcactcttattaatatgttcatataactagaaaaatcaactattagcttcttgtctgtttgttatttcctaattaaaccattgtacagattgagtccttttattttcttaatttaattattgtagaaatagatttgttgtggcatcatttctttgcaatactactaacttttatatgtatacaatggaccttttgctttttggaggtaaacctaaatacgcggttggatgttatttcaggatcagtgcatcagccctcaaaatggtcctcagatccacaagaggaaatggcaacccatcctctttctgttccaccccaacctgtgccttctgcacaatttccattaaatcaacttccagctggtgtttaccctcctgtaggtcaaactgcttttccaggatctttgccagtgcaaacccccactgtgctgcctcaaactgctgctacaccagctatcacaaatgatccaaatccacctccttatccactattcccccctggtctgattccaggaatggtgcgaaagatgcagatcgggagtggagtgccatactctcccctgagtccacttgacatccccacaatcattccaccatccactattccggagtccgagatccttgagcgtgtatcgaagttctttaaggagattggagaggtaaacccatcagaagggccaatgaagcaaagcgagcccgatgattacgataactatgagagggacattcctgctcgcaagggtggtgcatgtattcctcccccacccaacttgcttgtaaaccttgagacagggatgcgtgcagatggttcggttgatagtaaaccggggtcaactggccgattgggccttggagcgtctgccgatccaaatgagatcggccagtatgatgatgtctactcttcatatcgcaaacagaggagcagtacataccactcttccatcagtgctcgctcattagcaccaaagtgaacggcagaagcatcatatgaaccctttcctcatctgtgtaggactgtacttaaatgaacag

SEQ ID NO: 40353 - DNA, 3244 bp, Oryza sativa
  unsure (1)..(3244): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcccgtgtaagttgttttgacaggtatgaaatgagcaactttagtaagcctgtcaactactacccaaatagaatcatgtcctgccgacattctgggtagaccggtgataaagttcattcctatttcctcccatttccactctggaatcttcaacggttgcagcagaccggctggcttctgatgctccgccttgactcgctgacacacatcacatagagccacatattccgctatctctcgtcgcatgctggcccaccagaattgttgcttcaggtcttgatacatcttagtgctcccaggatgaatggaatacaaagtttcatgagcttctttcatgataatatccttcaactacttattatcgggcacgcaaattctttctcctagccacacagttccttgctcatcctctatataaccaatggcttttcctcttctcatgttctttttgatttcttgggtatcgggatcattcacttgagcctctctaacttgatcaaaaagagtaggttgagcttctaaagcggcaacaaaacatttgttgactattcccaatttcaacttttccaattcctggcataactcccaaggtagatgtcgaccttctgacatattacagtagcttttcctgctgagagcatctgctacaacatttgctttacctagatgataatgaatttccatatcataatccttgatcaactctaaccatcttcgctgacgcatgatcagatcaggttgagtgaaaatgtacttcaaacttttgtgatccgtatacatctccatacggttaccaaaaagataatgacgccaaatcttcaatgcatgaaccacagctgccaactctaggtcgaccgaaatgaaaaagttcaacaaacgccaaaacatgatttttggacatattgtagtttattgggtgcgttcatgggaaatactcacttcgtgattcgcgcggcgaacttttgtcaattaatgccaatattggcatatattggcccacgtgagtgcgatgtttttgaccggaatgaaaagttcaaaaagaaccaaaatatgattttttttgacatattggagtgtatgggtgcgttcgtggcaaaaactcacttcgtgattcacgtgtctaacttttgtcaattaatgccattattggcacacgagggtacgatattttcaaccgaaatgaaaaagttcaacaaacgtcaaaatatgatttttggacatattagagtctattgggtgcgtttgtggcaaaaactcacttcgtgattcacgcggcgaacttttgttaattaataccattattggcacacgatggtgagatatttttgaccgaaatgaaaaagttcaaaaaacgcaaaaacaggatttttggacatattggagtgtattggatgcctttgtggtaaaaactcacttcgtgattcgcgcggtggtgttttgtcagttaatgccaatattggcatatattggcccatgtgggtgcgatgtttttgtccggaaagaaaaagatcaaaaagcaccaaaatatgatttttggacatattggagtgtattgggtgcgttcgtagcaaaaattcacttcgcgattcgtgcggcgaacttttgtcaattaatgccaatattggcatatattggcccacgtgggtgcgatgtttttgaccggaatgaaaaagttcaaaaagcaccaaaagatgatttttggacatagtagagcatattgggggcgttcgtggcacaaactcacttcatgattcacgcggcgaacttttatcaattaacgccaatattggcatatattggcacagactggtgcgagctttttgaccggaatgaaaaagttcgaaaagcaccataatatgatctttttgacatattggagtgtattgggtgcgttcgtggcaaaaacttacttcgtgattcacacagtgaacttttgtcaattaatgccaatattagcatatattggccgacgtgggtgcgatgtttttgactgaaaaagttcaaaaagcaccaaaacttgatttttggacatattgaggtgtattggatgcgttcgtggcaaaaactcacttcgtgattcgcacggtgaacttttgtcaattaataccaacattggcatatattgcccacatgggtacgatgtttttgaccggaacgaaaatgttcaaaaagcacaaaaatatgatttttggacatattagagtgtattgggtgcgttcgtagcaaaaacccacttcgtgattcgcgctgcgaacttttgtcaattaatgccattattggcacacgagggtgtgatattttcgaccgaaatgacaaagttcaaaaaacgccaaaacatgatttttggacatattggagtgtattgggtgcgttcgtggccaaaactcacttcgtgattctctcggcaaacttttgtcaattaatgccaatattggcatatattggcacagaggggtgcgatgtttttgaccggattgaaaaagttcaaaaagcaccaaaacaagacttttggacatattggagtgtatttggtgcgtttgtagcaaaaactcacttcgcgattcgtgcggtgaacttttgtcaattaatgccaatattggcatatattggcccacgtgggtgcgatgtttttgaacggaatggaaaatttcaataagcaccaaaacatgtttttcggacatagtggagtgtattgggtgcgttcgtagtaaaaactcacttcgtgatacgcgtggcgaactgttgtcaattaatgccattattggcacacgagggtgcgatattttggaccgaaatgaaaaagttcaaaaagcaccataacatgatttttggacatattggagtgtattgggtgcgttcgtagcaaaaactcacttcgcgattcgtgcggcgaacttttgtcaattaatgccaatatggcatatattggcccacgtgggtgcgatgttttt

SEQ ID NO: 40354 - DNA, 4151 bp, Oryza sativa
tcaattaacgccaatattggcatatattggcacagactggtgcgatgtttttgaccggaatgaaaaagttcaacaaacgccaaaacatgattttcggacatattggagtgtattgggtgggttagtggcgaaaactcactttgtgattcgcgcggcgaacttttgtcaattaatgccaatattggcatatattggcccacgtgggtgcgatgtttttgaacggaatgaaaaagttcaaaaagcaccaaaacatgatttttggacgtattggagtttattgggtgcgttcgtggcaaaaacttacttcgtgattcacgcggcaaacttttgtcaattaatgctaatattggcatatattggcccacgtgggtgcgatgtttttgaccgaaaggaaaaagttcaaaaagcaccaaaatatgatttttggacatattggagtgtattgggtgtttgatgaaccctgagctccactcgagacactcaaggctgttgttggcccgatctttcggggagctgtagataactacgatttaggagaaacgttaacgacccgactacaaccgtactagatgttgttgtgttgcgccttagctatcgatacacctctccgtgggttgttgatcttgccggtgcagatcaaccttattcctgcaagcaaatcgaagaaacaagcaagaacaagattaaagcaatctgaattgcagataggaattgaacataaatgataagtttggggttccgtaacgagcaaacccggcgatctaaccgatcacggcattacccggcaaagtagcaaagctaaactttaatctaaacaaaacccgagaaaccctgaaggggtacctaactatttaaggaggtggttggacgacctaggggtccctagggtcgtgctccagctggttggggcgcaccccacatgggccccacttgggcctgggtcccaaacaaagttacaagcccataggcctattacaggtgacgcagcacattgtttcatcaattgcgcatgactgtgaaggaatttggcgatgaggctggatctgtttgaaagaggactccgagagatttccatcaggtactcatgtttcaaaaacggatgtcgtatgaatatttggcggccgtttgaagtcagcagtgtagcaaatggccgaatcggattccaacacttggaggacttgatcttgctagcatcttgttcatccatgatgtgagcaactgttgtatccatagtagccatggtcacatcatcctccccttcttcacggaaaaccgtcctcggtttttccatatggtgctcgtcgcatggtccatttagaacatgtttcttccaatcaaaacaagacaaactcgagataatatgattagcaataataggtctctctaacttgtatgttttatctacatcaacaggaggttctaaatccaaacatatataaattctatgcaccaaatatatgtctatcattatattcgccagatatgaaaaataacattagttggacatggcaaattagatttatcaaataatttctccttcaaactatcgagctcaaaaaaatcatcacactgaacatagcccaaagtatttaaagatgatgtcaattcacgttcctctacttcattagcaatgtgaagaacatgcttaaaatcagcacacaaagaaacactagagacaacatgttcattcacttgttgtggcatggatataagtgaagcattatcacacaactcttctttatcacaaggaataacaagtaaatcaacttatgacaaaggcatctcagcaattggatccactaacggttgctctactatagcatgaaaagtggacatgtctagctcaccttgagtatgctcaccttcaattatctcagcctcattgaatttaccttgcaaactttcttcagattttacaggtgcttcatgcttctcctcttttttcacaaattcatcgttctcctccttttgtttaatgttctgaacttcctgcaaaatgttagtaataggaggcacaagacattgctcctccaatgtttgcatatcatcattgcacaaagatataggagattcaaaaacatgagataaatcacattgttcatgctttctcacatttgatatgatttcactctcaatgctacgagcaagcatgaataggtgtccaatatgattatatgtcacattagcaagcacaatctgaatataaaaattaagccccttgaaaaatttgcgcattgtgttttcattgcactcttttagatcactgcagatgacacaaactttaaattcatggatgtactccctaacagttctgtcaccttgattcagatgttcgaatttctcacgagtagtagatttgtaataagaactcacaaaatgctttctcatcatgtttttgtattcatcccaagtttcaggtttgttactaacataagtccaccaaaataatgtagaagaggtaaacttattactagtagccttaatcatttgagcatcagaaaaatcataattgtcaaattcattgtctactgctagttcccaatcaatatatgcaacagaatcatgcttaccatcatagaatggtaacttagattcaactcgcacaaaattatagtcatgtacctcgtatgcatcacgtggagaagttgtcatatcttgtagacggtgaagaagccgatgttctcgtattcccttgcgcaatcctgccatggttagtagcaaacaagaaacacacacaagaatatgcacgctcctatcaactactaggtagtggcagctcaaatatcacacacactcaatcctttaaccaagctcttacaagttcttaccaaagcaagtggaatggtgacatacactgactcaaccaagcaccccaatagaggttggatgtatcgatgcctcggcaaacacttgctatacggctgcaatcaaatctgtggagctctgggtaggcttaattatgtagcaaaggaatagaaaatgctcaaatcagagaatgcaaagttgaataattgttcaaagtcaagtaccgtgctagtcctaggctagaacgtactagagacacgagcctagacacaaatgatatcacaagatagcactaggaacaactcatgcacaactctgatatatgaagttcagctcaaacataacaatattttctcttttctttctttcttctttcttttttttctttcctttcgttttcttttctttttttagggtgtggcttttcttttcttctttttattttttttttacaaaaacagattcaaggacctcaatgtaaggttacagggactcaaatgtaaatataaaatttacaaggactaaaatgtaaaagtccaaactcaaaattaaaattatataaaaatggaatgctgaatttatacgggttccctttttgcaaacggatctccaatccgacactccaaaatttttcaccaagatgttttgcaacccacggtgtggattgaaaccgggagggaggaagccggactcggctaagtgggtgacggcaggagatgagcgcgacaaccggccttgacgcatgggaaaggaaacagacttggcccaagtagaaagttttctttagacgaaacaaaccaaccggactgatctaatctgcaaaatatcctccaacaaccgattatcctctcttcttcctcgcgcgacagaaacaagagcacggtgcactagacaactgaaatccaagatgcaactccaccgctccaaaactaaccgatagaaacttctgaaaactacaaaaatagaaccgtggcagtgagccgattccgcttttgtagatcccgacaacaactaacacacggcggtggcgatgacagtggtactaaacgtgaccagaactcgaaactctaaacggactaaacgctaagaccagcaacacgactcgacgatgcaacacaaattcaacagagcaaaaactgaaaagaacaatgcaatagcacaaatatggctaggtgatggatgcaacttttttttagctttttctagttataggtagacaaaaactcaccgagtaacgaaagctctgataccacctgatgaaccctgagctccactcgagacactcaaggctgttgttggcccgatctttcggtgaattgtagataactacgatttgggagaaacgt

SEQ ID NO: 40355 - DNA, 10300 bp, Oryza sativa
gagtgtatagggtgcgttcgtgtcgaaaaatcacttcgtgattcgcgcgtcgaacttttgtcaattaatgtcaatattggcatatattggcccacactggtgcgatgtttttgaccggaattaagaagatcaaaaacaccaaaatatgatttttggacatattggagtgtattgggtgcgttcgtggcaaaagcttgcattgtggatgccctaatttgccgatccaatatattattactttcttttttttccttccttccccccccaaccgaatccaaacagatctgctatattctgccttcttcctccacacacaagcacggcaaaaatacaagcacgctatctgaagatgaaaaaaatcggaaaccaaccgatctaccgattgtagcacaccatccaaaaaccgatctgctatcctcttctttcctcttcctcacacgtaagccagacacggcagagcaccacactacagcaaccttctagatgcaactcaactccaaaccgaccgacagaaacttctgagaactataaaaatggaaccatggcggaaagacgattccgttttcgtaggtctcgatgacaacaaagatacggcggcggtgacgacagtggtagtagacgtgacatgaactcgaaactctaaacagactagaagctaagaccaacagcacgatgtaacgatgcaacacaaaaattcaacaaagcaaaaactgaaaagaacaatgcaatggcacaatatggctagctaaatgatacaattttttgtctagatatgtcgggtcccaaaactaatgattcggaaaccgacatgtttaactgtatcaagccttggatcagtagattgatacaggttaaatgatctagatcttcattgcatgcatttgatcaagctttcaaagaagatattattacaaaatgcaagggtatttacaagcttgtggctaactaacacagcagaagctataggatgacttaaccctaatgtttggctatagacttaaaccatctatctaatctatgtttgagaattaagttaaaataaaactaacttatgtgattgaactcccagcttcagaaaaactcctaatagacaatgaaaaagaggggttgaagcaagggtgagtacaacgtactcagcacgctattatattcaattatgaaggcatgatatagtaatatttgactagggctatgattacttgtagaaagctgaaaataaagagggagaaagcctggaatgtttttgatgcaacaatattaataaaatctggaattatgtttctaaccaaatatcatatgtcccgatactcaagtccgtgagcacggctattcgaatagttttaagaatattcatactgcagtagatgtacgctttacccgcagtccataacttgtcaataatcgttagcttagtcatggcccagtattaggttactaacaatagtggcacctgttccatgaactctagtcctcatgcgctctgaacgtaacgttatcagcagcgagaggagttctggcgttcccgaggtttttagagagaactggttgagagacccccgtcatctcaaacaggttttcacaattcatacacacagctcgcgagacaatcaagatatttacgtgcgcctcggtaaatattacaatcgccctgctcggcataagtttgcctcctgcgtgaggacataaataagaaccactacacacaggtaccacattgttaattaacataataactaggtctatccccattctagaagctacggtcgtactcgttcgtttgacataagtatttagtggcaattatatcgaccgggacagtactagccaccgggaaatcaaccaaatcttacgtactgtcccaatctaagttcattatatttttgtgcagtctaactaggcagggctaagcaaaagctagcatatctggtttgctatatgttcaggttatgcattcaaaatcatttaatggctaatgcatagaatagaaatgtagaatatagggtaattatgctcaagggcaggaataataacttgccttgctccaacgcaaataaatctcagataggcaacctgattattcagtcctcgaaataccacaggttgccatccaaaagacaatagactctactaaagaagaggaagaaccaaattcaataaaattcattgaataataagaaaaaacaaaaaaatggcgagaagggcaaggtttagggtgtaaatatctcctttattggatatagggattattgggctaatatttcatgtgtaagttctatagggttggaggctagaggggattaagcaaccatggtcgcttatattttatgtgtgggcttggtcgctgaaaggataggatgtatattaggtaattgaactggttcaactggtatatggctagttttggctggtggtagggttaggtaatattatacctaaggtttagttgtatttgagctgattatggagtagggcagtatctcggctagggtttggttatttactagtcgttgctagagttgggtagcatgacgactaggttttgtttcgtttctagccggtgtcgatagacaacatatcggctggaagaataggaggtgggtgcaggtttagtggggtggaagtgttattttgacaaccgtgagtggcggcggagcggctaggatcgcacagagctcgagaactaaatgtgtggtgtgctgtggaggtcgagaaaatagtaaagctccaaccactatacgcatcaaggtgtgggggtgccaggagcagcacttcgaccttaggtttggttttgccaggctttacaaccaacggttcgacgtcggggcgagtagacgcgaacggacgtcaccatggaaggcgtaaagtttcaaccggtggcttttagtgggtaaaaggtattttggagtaaaaggagatatttgaaaagcaaatgacatttaaataaattaagaaaattcaaatgaaattataaaattgcaaattgggtatcaaaatgtagcttttgaatttggatgaatttaggtccaagtttcatcagaattggatctacggtttaggagatatgggcttctaaagtttggattttgaatcaaatctagaaaatgtgaaatagtactgtaggggcccacctgtcagtagctgtcctttttctttttctttttctctcttctttttcttcttcctcccgattcctttcttctgttccttcttcccgtgtaatagcagagagagagagagaaggggcgccggtgctccgatggtggaacggcctcgacggcggcggccaagtgtgttcccgagcgatgcgcccccggggaagtggtcgcccagcgaaggagttagggaggaggccggaacggcgagcgtaaaagcttgcttcggccggttagaggaggtggcgttggcggcttattttggcgggggaaaggaagaggaagtgagggaatggattcgtctcgatgagacgaagctagtggcgcgagagcttggccgacaacgctccggtaagggagatcggtggacggccggccatggctagagagagaaaagtagagctcggagctcagatgaccttgccgactatttatatgtcgtggagaggcggttgccgaaggtggttgtaaaggcggtcgtcgatttggtcacggcgacggtaacttggaggaggagaagacggcgccggcctcgtcttccgattggtcgacgacggcgtcgcgtgcacgtggcggccgcggcagggctgggcggtggcagtggacaggcacggaactgctacagtggcggcgcgacttggtgcacaacagtagacaacggcgtccgacagcatcgtctgtgggcggcgacggcggcagtgatgcgtgcatgcatcacgcacgcccacaggaaggtggagggaggcggttgcgtcctgggccggctgggccacaagagagagggggtcaaaagagagaaaagaaaatctcggcccataaagaattatttatgaatttctaatggaataggatttgtatttggagggaatttttttttaaattacatagtacagcgcagacactcacaacgcacgcgcacaaaccctatacgtcgctcccatgaggagtcaaacccaggacctcaggtgctactaaggctcttgtaaccactaggctactggccctttcgcgtatttggagggaattttaatacgaaggttgtacaaaggaacttggacaaaatttatatttgaatggaatttgctcagcaattcttggaaggaatttgaatattggaagaaagttaaggataggtttagaatcaaaggatgggtcgacaattaaatccaataaaattggaatcgtttggtttaggttttacgacaatagtggagaatttattggaccataattcataaaaatagaaagggatttcaaactaaatttgaataaaataatttttgtcaaaagaagattttaaaccaaatcaagaaatacctcaatttaaccaaatatatatttttaaatgaaaaacacaaaagagattaaatactggagagattttgtgcgagttagttttgtgaggtccctctaattataggacgcctaggtttaggaagttattaagaacataagaagcgacatgatgcaggattagaaaatgatacattttcaggatgttacaggtatttcttggttatgggtagataaaaactcaccgagcaacgaaagatctgataccacctgatgaaccctgagttccactcgacactcaaggctgttgttggcccgttctttcggtgagttgagataactacgacttgggagaaacgttgacgacccgactacaaccgtacaagacgttgcattgcgccttagcgatcgatactcctctctgtgggctgttgatcttgccgatgcaaatcaaccttattcctgcaagcaaatcgaagaaacaagcaagaacaagataaaagcaatctgaattacaaataggaatgaatacaaatgataagttggggttccgaagaacaatcagacgggcgatctagccgacacgcgctgcaagcaagtagcaatagctaaactttaatctaacaaaacccgagaaaactctgaaggggtacctaacaatttaaggaggtgggaggacgacctaggggtccctagggtcgtggtccacctggttggggtgcagcccctatgggccggggtcgcagagaatgttacatgcccataggcccactattggtgatgcaacaccttgtttctttgattgcggccaactgagatggagtttggtggtgaggctggatccgttggcaagaggactccgagagctttccatcaagtactcatgggccaaaaacggaggtcgtatgcagattcggtggccctttgaagtaagcagagtagtaggtggtcgaatcggattccagcacttggagatgttaacaaccaaatttggtaatttaagtatcggagataaagaagaaatcgaaacggagttcgcgatggagattgtcctggaaacagagtaaggattggctggagtccgaatcggctgtgatcaggatcggcatagtctgagttggagagggttagccgattgagttgaatccgacaatgtgacacggtatacgttgtcgggttaggttaatgagcttcatgaggattgccacgcatggatagagtcgtgaggaggcaattgtatctattaattaggatattttatgtaatttcgttaaagatatttttgggcgaaagtctgccgcaaagacttatgttatcttagagtttgttagagataagagtcgtgtccgatatgaacatattttgtaatctcgggtataaatagaccccaagccccatgtaatcaaactaacacatgttcaatacaatctcggtgcatcgccatcctttttactttcttttgtttcgacgagttcttgctttcgggttgagctgcatcggtttcgatcttcaacaagtggtaaaacttgttatggtggattgcgttctcgggattagtgcttccatttttatgatactctaatcttgtttatgtaatttgtcgagttatcatatatctcatataatctccggcaatatcgctatctaacctccaatcggctaacgtctgctactagaaggcagccgatctggttaaataccgattttgacttagattatataggatatctaccactctatgaaacatccaacggcttgattgtctagatattgtttttcttttcaaacttatagctgcatcagttgagtttgatcttatgagtcatgattagaatcttaatctctagcctgcttttggttgccgataagggtagcatcggggtttcagccgattttacctgatttaactacatttatcttatatgctttattgacatgttaaatctgccttttatgttaagatcttgttgcatttaagtatattaggctttttgtttggtatattctacttgctttaatatcttaatatagagtggtatcggagtattagccgatacatgctagatctatctgatcggctatgctatgaacatatatagtattgttgttaatatatatttcagcctaagtgatttatactgtctcggcatggcgaccgatctatcctaatcacttgatttaagtatatatcgacataaggattatatatcgttaatatgtacagccgatcgagtagatttagttctttcttacttatttatgactgccgatcgatctacatgtgacatcggctcaaagataaatgatatgtcatcggcaactagccgatcgggtatcgtttatggatttaaccgcggtttctttgtctttgtttcttgttgattgcaggatcaaatcaactagcacgcttatacacctaaaggcaagcttttgggcccgcactggtgatgaaccctgagttcctctcgacactcaaggctgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaacattaatctaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctaatatatgaagttcagctcaaacataacagtattttctcttttctttctttcttctttcttcttttctttttttttctttccttttcttttctgtttttttttggtgcggcttttttttttttgcacctttctgcctttttttttcacttttttcttgattttttttaacaaaaattgactcaaggaccttaatgtaagattacagggactcaaacataaatataaaatttacagggactcaaatctaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactaatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcagcgagccgattccgttttcgtaggtcccgacaacaacagagacacgggggcagcaacgactgtggtacaaaacgtgaccagaactcgaaactctaaacgaactagacgctaagtccagcaacac

SEQ ID NO: 40356 - DNA, 1636 bp, Oryza sativa
aatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcaactggagttaagcagatctcccaggcctcgtgtttttacatcaataggaggacacgatcttgatatctccttgttcatccatggtgtgagcaatggttgtatccgtagtagccatggtcacatcaagttcgccgcacgaatcatgttgtgatattttgccacgaacacacccaatacactccaatatgtccaaaaatcatgttttggtgctttttgaactttttcatgccggtcaaaaacatcgcacccacgtgtgccaataatgtcatttattcacaaaagttcgccgggcgaatcacggagtgatttttttgccacgaacacacccaatacattccaatatgtccaaaaatcatgttttggtgctttttgaactttttcattctggtcaaaaacatcgcacctaggtgtgccaatactggcattaattgaataatgttccccacgcgaattacgaagtgattttttttgccactaatgcacccaatatactccaacatgtccaaaaatcatgttttggtgctttttaaactttttcatgccggtcaaaatcatcgcacccacgtatgccaataatggcattaattgacaaaagttcgccgtgcgaatcacggagtgattttttgccacgaacacacctaatacactccaatatgtccaaaaatcatgttttggtgctttttaaattttttcatggcggtcaaaaacatcgcacccacgtgtgctaataatggcatttattgacaaaagttcaccaaaaacatcgcaccaatagtgggttgggtgtgtatagggatagatgcttaatctcagatattccacaagtgttggtttgtatttgtatgcaggtgataaaccctaaagttgggaggaaatctagactaaagtggggagaaatatgtatccatacaaggatgggatctaaacttcatcaaaattcccgagaatcatcccaaaatcctgaggaatagatagaggtggaccaggggagaagatgggtcaagagccaggcctgggggcccagcccaggttttgccgaaccccctggttcggccgaaccaccatctccaccgttggatgtggggtttggcgtggacgtcccagatgcatccctgatgacggttggagggcacttcagacatttccccttcgctaactgtcatacctacccctatataaagacatcactccctcacttcacatacacactttcaagcttgagctgaattataagaggctctattgtactatattgtatactagaataggaagagagtagagtagaagaagtcggaagaatttcggagttgtcggtaatcttctctcatttcttttattatgtttattactctgaattcaatataatattatttctgagtaatttagatttatcttgtgagaattatctcttcgtta

SEQ ID NO: 40357 - DNA, 2467 bp, Oryza sativa
cggtgtgaaaggaaagatcttgaagcaatcatccaagctaaccgggcttccatcaatgaagaaaaagcaaaacttgatgaattggaggctggtccaagctccacacaagccaacatagatcggctgaatgctcggaagatagaactcctagccgagttggagcaatgcgatgctcaaattgcaattgaagaacagaatcttgccgatctgcccaaagctactgaagatcagagatcaaggctaaaatcctctatcaaacacttagccgaactgacgaaatctctgaaagtaatccctgaaccgatgcagctgatgccccagatcattgacaaagtagaacaaattaggcaaagagctatatcggtatccaaaaatatgtatctggatgaactgaatatgtaacttttgagttgacaaacttttgggctgtaatgaacttcaaggttttgaaatcttaattccacatttttgcccttactctatttgcttctgaagtccacatttttgcttttgaagttcacatttcacatttatcatatatatttgcccccttaattttgcaatgctgaaaacattgattaaattataattgtactaagggcgatatgatacatatcggccatcatacatcggtaagcacaaccgattatgatcacaataaaatgctaagggcgatataacctatatcggccatcatacatcggtagagcacaaccgattatgataaaaataaaaacactaaggacgatacaacttatattggccatctaaaggcgatgtcaacacattggctaacatatatcggcaaaagtcagccgatcatgaattaatccaaacacttggataatatttcttcaagtacttctcgtttagtgctcgtccaaaaacttcaccataaagccattccaacatctaagctcctttggatacaattttgtatatttgaaatggttcttcccaatttggcgacctcttgccgaatttattatcatgagttcctatcggcaaaatcaacttccaaaccaactttccctctgaaaaggatttaggtacaaccttcttgctataatgaccagcaactcgttccttatctcttgtcaccttttccaaagcacgtaatctggactgaattaaatcttctgtttcatccaccagaagagtttaatactcatcgactgtcaatttatcctgtaaatctattctccttgagccgatggcattttcccatggtagaactgcttcatgtccatatacatgcttgtaaggaggaacctgaatcgacccatgacactccatctgataataccacaatgcttcggctaatcttatatgccattgccgaggaaatcacatatttttttattaaccaactgtataaaactcttgttatatgcctaagcctgtccattaacttgcgcagtaagtatggcagataatctaacaacttgatgcccatgctggcagtaaactgaacacactcatccaacacaaagattgaaacctgatcgggggcgatggtttgaggaacaccaattcggtccaccatctattctataacaaactggatagcatctctagaatcaaccttctacacaggaaccgcttgcgcccattcggggaaataatcggtgctactaatgtaaacttatgtcccttgcttgaatgtggattattctgaccgatcatataatgccccatcctacgaacggccatggcttaataatcggattcataggtgatgctcctgctcgctgagtcgctccaaatgtgtggcgatcttgacaaccttgagcctatcataagcaatcctctaacatcgtcggccaaaaatacccagtacacctcattttataagccgattgatgagtgccacagataccttcatgcacttctccatcacaaccttggcttgatcggtactcaaacatcgaagcaataccccatcaatcgtccgataatataactcaccatctaacaaggcatatttcaaagctttatacctcaatttccgtgaagccgattgagaaggatcatttaaatactggaacacatcgtatctccaatcatcggctgtaattgcagcaacttcaacttcaatgtcttgtaccatcggcttgtatcctgatgccccctgagccaaatcattagcttcaacgttctgctcccgagagacatgcttcaaatttaccaaccgaaaactattcatcagttcttggcacttctcattgtacatcagtagcacatcatttttgaattcatattcccctgccaactgattgatcaccaacaatgaatcacccattatctcaatagcatcggcttcaacttccttcaataattgcaaccccttgagaactgcttcatattcagcctaattattggtcgcgtagggtttaatagtataagcaaactcaaaacttgcccctcgaggagaaattataactaagatgatgccgcagccatgagt

SEQ ID NO: 40358 - DNA, 4789 bp, Oryza sativa
tgggcgataaatacctaagatcaaactctgtcaaagcatatatccacttcccaactcttcctttcagaactggagccgatagttgaccacatcggctttgcacactatagtgcactcgttggacaacaaataatgacttaactttgtgcaagaaaaatataaacataaacacaacttctccattggataataccttgtttctgcatccaaaagtctgcgacttaaataaaaaatagctctttccttgccttctaactcctggattaaaactgagccgatcgacttcacatcggctgataagtacaaccttaaaggcactcctttctgtggaggaattagaactggaggggaacttagatactccttaatattatccaaagccttctactgctctgccccccaagtgaattcttgatcggccttcaatctgagcaaaggtgtaaaaggttctaatcatccggacaaattagatataaaccttctaacaaaattaatcttgccgatcaacgactgtagttgtttcttgtcctccggaggttgaatcttattgattgcattaatactcctctgagttacctcaattcccctctcatgaacaagaaagcctaagaactgttcagccgatacgccaaaagcacacattgttggattaatcttcaagccatatttccttattctttcaaaatttttcctcaaatcggctatatgatcatctacctactttgacttcacaactacatcatcaatatagacttcaatcaacaagccgatcagatcatggaatatataattcataactctctaatatgtagccccagcactctttaaaccaaaattcatcacaacccactcatacaagccgattgcaccaagacatctgaaagcagtcttatgaatgtcttcttctgccataaaaatctgattgtaaccagcattaccatccataaaacttataatgttatgccctgaagcagcatcaactaattgatcggcaatcggcattgggtacttgtaacatactcaaaaatcttgaatttttggagaaaatttttcgcgacgagttttacttttggttcttattgcatttgactaaattggagcatttcctatttttatccttttcaaatttatatctctaattaattaggttgtgtttctatttcaaaaattttcaaatccttttggtaacctaaaagctttattttaattttccttgtcaagttcaaaaagtcctcaaatttatcccctctttcatttcctttgaatcctatttcaaatctatccgcaaattgccaaaggctcctatttattttgggccaaagtcccttcattcggcccaattagcacaagtctatgttatctccctccccttctcttcctgtgggcatgtcgccgccgctgacatgccgaaaccagcgcgccgccgcccagccaatccgccgccgccaccttgccgcgccaatccgccgccgccaccttgccgcgccaatccgtcgccgccaccttgccttcgcccactatcctctccaccgccgtcccgcgagcgtcatctcgagcagttaccgacatcgagccgcccattcgctgtccaatcacaagctgacacccaacgccgccacctccatttcctctcgacgccgagccgtgccatcgtcgaccatctctccctcgaccgcctttgcctcctatataaaccggcgaacccctccatttccatcacaaaaatcggagctctctctctctctctctctctctctctctctctctctctccaatccaccgccaccggccgtcgctttcctttgctccccacacctggccgccaccctagccctgccggccgccaccagccgccgccgctgtcgccgttgtcgacgagcgccagccgctagagccgctcttcccccccacgtcctcctctgctcggctctctctccctttcatctgtgtcgcaaggagaaggggaagaaaagaaatagggaaggaagaaagagctgacaagcgggccccacctatacggtaactcttctacttttatttgatttatttcaaattccattctttagagatccatatctctccaaccattgatccaattccaaaaattctttaaccatctaatttcaaaccctttattagataccaaatttcctaatttttaaaattttatttaaatttctttatttaagtaccccttttccttatttatttactttctaattctaaattattttaattaacctataaaaattattttaaatttattttttttactttatatccctttaattttaaatttcttgttttattttaaaaacctttttaaaattaaattatcctttagtttctttaaatgcccttttctttattttaaaataccatttttaaattttatttctttaatatatttaaaaccccttcttgaattaaaattcccttgatttacttgaattccatttttatttccaacctatagaaaccgacaccgttttctttcaaaattcaaatatctttggaccttttgcctttgcctctcttcatgctccaattttgttattttcttttattttatcgtttatttgtagtactttttcttataggctttgtttgctatacgtacgttagacaatacagaagatctcgtcgacatcacaggagctgacatggatccagccgactacgcagaagcccatgaaagtttcaaggcgcaaggcaagacagaatttaagcatgaaataatcaacccccgtatttactttatgcataagttaatcatattatgctttactagcaacttatttaccatcttatggttgctccttcagcatctcatgggtatatgctatagtttagaataacattgcagtgggttaaaataatatttaatgcttttaatcattgttacatgagattatggaaagatacattagacatcattttatgtggtttattattcaaatatctttacaaacgtaggaatccggttaaaatgggcatttttatgttgtaattatgaatgttgatgaatgatgaagtttgtgatgttggtgtggggagtttggaaagttttgtgtggtttaaccagattataattacccccttataccatgggaaatgacatagtagtgtccatccacacgaccaagtaattggacttagcatagtacattgtcccactatatgaaagactgttgagtggctctatgaacggttttggggtgaacatgcgtaatgagttagggggcagtgtttcacaataatggatctcatgaaagtgtgacaatatagtaaccttgccctaggtgttggtatttcttataatcacagataaaatccgcaagcgcacggatataccgatgtagcacttcccctacggagtattctaagggtatcgaatccaagggaacgtgtgtgatcagatcttcctccagtttatccaaggacaccaagcaaatgataggccaggatagagaggattcactagtgagaaacagtgtctagggaaagcttaactttaatcataatgcaatactgcaggcactaacaacccgctgttcctagatggcgctctactacgtacccggacaggcaggacttaagtcatctcgagggctgtcacctcctctacacccacctctaacgtactgtgggatacacatcaattacaggataataattacctaaacaccatgtctaagcaattactatctactttagtgtttataactcaccaagcaatcactatattttagttgattatagtgaacaataatcctgtatgctacttaggaactaaccaagagttaattctcacaagataaatctaaattactcaagaagaatattgtattgaattcagagtaataaacagaataaaagaaataggagaagattaccgacaactccggaattcttccgactcctactctactctcttcctattctagtatacaatatagtacaatagagcctcttataatttgtcacgcccaaaaactcccgaatagaattccaagcaaaatgtgcattaaaacccccgtccaggaccggtcggggtacacaaacgacaaagttgacatacagatcgacgtcttacaaacattatcaaagtcttacatgaatgcagcggaaaattaaaagacaactggagctaagccttgacttggactgcagcgggaacaccactccacaggcatcctcgacggcacggacgaagcctactccttagaaaagccaccatctgacgcatactcaaactctggggtttggggaagatagagcaagactgagtactacccactgtactcagcaagtcataccggaataggggtatgatgcagggtataaccaaaggatagttagagcggttcatttgcataaagcgagcatttatcgacagcagttgaaagcggtaaaaccgttgtaataattaatcaatattaaccatccactgtccaacgctacaccacgatgcaacaggcccaaccatccacctgaactaatcaattccattagactaaactagggtgaggctaatcacggtgaatctggttgaccgcccataaccgcgggcatggctattcgaataattttactctgatcagaggtgtacaactgtacccacaagacacagccccacgacacgttttcgtgcgccgacatgccaccacgacattctagaaagaggccgtgacaggacccttcgcataacccgctctaaccaaacacaccacacctcaggtttcaaccccactcctcgcaaggcagcgggcagtcccctctcgtgcct

SEQ ID NO: 40359 - DNA, 9730 bp, Oryza sativa
taggtatgacggttggcgaaggggaaatgtccgaagtgcgctccaaccgccatcagggagtgatctagagcgttcacgccaaaccctagcctgaatgtctgagattttggttcggccgaacctgggctgggcccatctggcctggtctttggcccatctcctcccctcattctcctttatccatttatcagtattttgggctgatttgctgacattttgatgaagttcacaacctattcttgtatggatacagaattctcctcactttagtctagatttcctcccaacatcagggtttatcacctgcatacaaatatacaccaacattgtggaatatgtaagatttaagcacctaccactatgttggatgttatattatctgaactctatgcagatgttggcggtacagaattggcatttaacagctgccaacaaaaccccccacacttagccctttgctcatccctgagtaaaggttagtgtagaattaatttcttcaagatataaatcaagcatataaatcattcacaaccatacctgcacctgtgaactttatcagtggctatcttatcatcttgtgtaattgacaaatggaatgatcttgattccagtccttcttgcttctctgccagactcatgggatttttatagattttcacaaatcagcatttctcctcctattgactttctctcatgtctctcaaggatgtatattttctttttggatccttaccaaggcaaaatttgccagaattcatccctattataaggctaatatgtggagcttggtagggataaattgtgacatacctgcatcatatatattgcaagtccaaaaatatggactcaagaagatcatcaatcatactcttagatcaagggtctttatttgtggtggaaaatggaaaagtaatatatttttgtggaatggtggaataaagaaatgattcttccttcttcctataccttctctccatttggttctcttagcatgatcatggaaggggcatggctatatattttttcaactttgctcaatattttgggagcaagatttctttctttctttctttctcccttttttttaatacataccatgccttgcctccccttttctcattttccttttttttaacaaagaacttttctaagagaagaaagcatagtctgaagcaggagtttatttgaatggaatttttgtggaaagccatcttccaatgtagaagcttagcttaattatatatgtggaaaaataggaatggaaatgataatgaccccttgattatgagagtatgaaagatgactagcacaagtcacataaattcatcaaagctcaatataatgttaggcagtcatatgcataagatggtttatcattgacatacttgcatatggcctcggtgggtataaaatgaagtcaattgaggattgagcctttaaaacaattttattttgaaaacaaattcccaagtgtcaaaacaggagttgcaagaattcttttcatctcgaatcatctctcatataacaattacttggatgcagaaggttccctaaacatggaaggttgttcacaagcacaagttcagttgagaataatgaatatacaagatcaattatatgaagaatttcattagctggaaattttatctttcaattatgcttgaaccaagtatattctgaatttccagctctagtactatacaatggtggagatatacagataatggatgtgctcacctgcttacctatgaaaattgagaggaattggggccagctttggttcgcccgaacctggtggttcggccgaaccactctggtgtccaatccctctgcaattttctgtagagttcagtgccttccaggtgttcagatattcagcatttttcagagtttatgcacgtcagaatctggaatatctcccccacacttattcaaaacctgaacattattaaacataaaacaaaaacaaactttggcaaacatgggagttaataccaatgagccacattattcatagcaagtgcttacatgattggaaaaataaaaaccaagcaccaactactattttattcatgggaaaggaaacatctaattagcataatacttattttcctttccatttctacgaatgcgcgctttatcttagcgcacaaaccgcgactaagggtatcgaaattatttctaatttcaacaagctctacccctagctccgcgttgcgatccctaagctctatgttctccttgcggagtttcttaacttgtacggcgagcttatgaatcgagggctccggcgacttcacttcgtcttcttggaattagccgggagccctcacaattggaggggacgtcaagtgacgcttcaccttcataggtggagggctacgggattccgctgccccctccttctccgatgccgtcaaaggccggagtaaacccttgccatacccacctccgggagttcgcactccctaaatgcggaatcgcttctccttttgagtggatggagtagcggtgggtgtgacatacttatggagcacctcatcccccgccttggtgaacagggtgtccacatagagctcggtgggaggcggagtggccttctcatcgtcttgaaaaaggcgtcgcgccttcaaaagaccgagctctcccgttgttggccgtcgagcaggcgaatccccccgaatttttatcttcatgacatcgcgaggggagagggatcgcactgccgaacggggggccgaacggggctgagaggggttcagccgaaccagggagctcgccgacgggctccagattcacaagggagcccggcaatgttgcgaggggctgtgcccacggtgcatttaccccttccatggtataatgttccactgggatcaattgatttgccggtgtcggctctctgtcgaggttgtatgtggaattggaggaggagccaataaatgggatcaatgattttccagccattggtgaattgagggtgatggagcaaaggaattgagatgatatggagaagggtttgcacaagtagacgagaggaggaagaacaagtgctttgagctttgatccgatcgatctacctctgaaagcgcatatcaacggactaagaacgagcgggggaaactgatatacaaaattggtgctggttgggcgccaccctggttcggccgtaccataaccctggtgggtccagctggctgccaatgtttccctaggcctataaaatcctaaactaagcataaaaataacaactttaagggttttaagcataccttagatgagatcatcatggttcataatcgattagttcaataacatccacttcttcatctaaagtttcatttggctcaaggaaaatctttaagcattgaccgtttaccttaaacatgttacctgagtcgtcgcggattgtgattgccccgtgcaaagaggtgtcgatgacattgaatggtccttcccatttgctgtgttgttttccatgaccaaaatgcttaaccctggagttgaacattagcactttgtctcctggcttgaatttcttgatttttattcttttgtcatgctagcgcttcgtcctttctttgtatatcctcacgttgtggtaagccctctctctccattcttcaagttctgcaatttgcatttttctcctttctcctgctccctcaaaatccatgttccaatttctgatggcccagtatgctctgtgctcgagttctacgggtagtcgacatgacttcccgtagactatctgatatggggacattccaatgggtgtcttgtatgctgtccgatatgcccacagtgcgtccggcaatctatcattccgtcatgttcccattttgttgaccatcttctgcagaatattcttgatttgtttgtttgatgtctctgcttgaccactggtctgtggctggtaaggagtggccacgttgtgtttggctcccatctatcgtaggaggtctcggaaggttttgtcaatgaagtgagaaccttcgtcacttatgacaatcctgggggtaccaaatcttgggaagatttctgtgaacatcttcttggcatgcctcgcatccgtggcgctgcacggcatagcctcaacccacttggagacatagtcgactgccaccagaatgtactcgcagttgcgagacttagggaaaggccccataaagtctataccccaaaaatcgaatatcttgacttacaaattgtatgtgaggggcattgcatcgcgagcagtgattcatccttgcctctggcagcttgtgcatcttctgacgaattcttttgagtcttcgtacattgtgggccagaagaggccacttttccaaatcttggcctgagtgtggaatgcaccgtaatggccatcatagggtgaggcatggcatttctctatgatcctaagtccttcatcaattggcacacatcttcgtagtaagccatcggagtagacccgatataggtatggctcatcccatatacgacggcgactttcatactttagttttcattgattttcccctagtggtatgtacttggataccatgtagtttactatgttggcataccacgggttggagtcgcgaactgtcatcaacatgtcgtctctcaagaaatcatttatcggctgttcctgcatgtcagtgatctgcagcctagacaagtgatctgttacggaattttctactccctttttatctttaatttctaagtcaaattcttggagcagcaaaatccatcttaagagacgtggtttagcatctttcttagtgagcaggtatttcaaagcagcattatcagtataaattatcaccttggctcccactaagtaagacctaaacttattgatagcaaaaacaaccacgagtagctctttttcggtagttgcataattcaactgagccccggttagagttttgctagcatagcagattgcttgatgctttttatccttggtttggctcaaaaccgcaccgacaacgaaatcgcttgcatcacacgtgatctcgaagggcagagtccaatccggaggttgaatcattagagcggagacaagtgcctttttgagaatttcaaaagattttaggcacgcgccatagaactcaaagggcgcatccttggccagcagattggtcagaggtcgggcgattgtagaaaagtcataaaaagctggcgtgtcctaaaaagctgcggatttctttgatgttcacaggaggaggaagctgatctataacgtcgattttagcacgatcaacttcgattcctctttcggacactcgatgcccaagatctatcccttcacggaccatgaaatggcatttttcccaattaagcaccacatccttttcttggcattgttgtaagactttgtctaaattctacagacaatgaccgaaagtctttcataaactgagaagtcatccatgaagacttccatgatgtcttcgatcatgtccgagaaaatagacatcatacatctttggaaggatgcaggagcgttgcatagtccgaaagacatcctacggtatgcataggtgccatacggacatatgaacgtagtcttactttggtcctccggatggataggaatttgatgatacccggaatacccatcaaggaaacagaaaaaggaatgatttgccagccgttccaacatttcatcaatgaagggtagcgggaaatgatcctttttgtagccttgttgagcttcctgtagtcgatgcacatcctccatccggttatggttcgttgcggattaagttcgtttcgagcatttgcaatgaccgtcattcctccctattttggcacaacctggactgggctaacccactcactatatggtacaggataaataatcccggcatgcaggactttcaagacctctttctttacaacctctcgcattgcattattgagctgtcgttgaagttccctggagggagtactctcgtggtcaatatgaatacgatgggtgcaaagcgcaggattaatccccctgaggtcttgaagcgagtagccaagaacagaacgatgcttttccaacacgatgagaagacgttgagtctcgtcttcagagagcttgtcattgattatgacaggggcctctttgtcattgtgtaggaaaacataacgtaggcctggaggtagaggttttagctcaagcggaggtcgaggtggtggttcctgatccgcttcctctttgatgaaatcggggacctcatcttccagaagggcctcaggagactcatgagggggaactgcagtaacctcttccgctgactcaatttctgggagagggtcggtcaaggcaatccttgcccgtgagaatggaattgaaaattcattctctcccagtgttattttgaggctatctaatcggggtgtgttgatgagaagttgctcaatgggcagcccaatgaagatgtcaaaatcttggatttcaaacacgtggaaattcaagatcgcctccctgtcttcaaagcagacaggcacatcttgtacaatcctgaatccttcaatgatatttccgttcggatgtttgaagaatttgtttgtcggggtcatgtcacaccctaaaaatcctaaatatataaattgttgtttaattggaattattagaattgattttaaaagcctagaagagaagatctaatttttaaataataaattccaatataaaattgggccagataaaattttattaaatactttacttgattctatagttcctagatttttctgggatttatttgagccaaggaagaatttttaataaatggaattgcatttcatgaataatttaaattgaaaaaggttttaaaagttctcttttggctttgggccgaaagtcggcccaaaacctctgtctctctccctcggcccagtcggcccagtcagctcgcagcctcccgtgcgcgcgccctcggccgctgacaggtgggtcccacctgtcggactcgtcgtccacttgcagccgccgcgccgaaaccctagccgccgccgccgcctttccaaattcgctcgcccctttctcgatccggtgaaatcaattgaggggaaatgtttcccgagatcttctctacctttttccttttggaatcgatcgctaaatcggtttggaaaccgtcggattcgagctcgaatcggattcgtttctttccctttaacactaacctttccttcgcgccgccggtcgcggtgggccttcgccgccgccccctagccgctttaaaaggacccccaggccctccgctacccgccgccaccctcgccttcgcctctcgtcgcctgtagagccctagcgccgtgccgcttagcgccgccgttcgtccagccgtacgccgccgtcgctctggttgtcgtcgccgcttgggaaggtcgccatcgtgatcgccaagccgtcgccgtcctcgtcctgtcctccgtttttgccgaagaccgccggagcaccgccgtcgtcgtcaagccgaaggtcgccgccgcttcttcctcgtcgccgtcgccgtccgttgatcttccgccgctgttttggtcaccggtgagttcgccgcgtcgccctctacgtgctggtgtcctccattcgcgccgccgcgccgtcgttcgccggcgagcttgcgcgcccgagccgccgctggtgatgacgtcatcgctgacgtcatcgttgccgtccgtcgtagaccggtcgtagaccgttagatcttggccgtccgttgtggataggatagatctcggccgttcgtttccgtgagccgccgccgtgcacccggtccaccgtgaaccctagccactgacgcaatatccccttttccttttcaaaaataattcattattgcgtcataattcaattaaaatccatataaatgatttaatccgatttaatctttgaaaattcataactaattcatcttagctcggatttagttggttcaagtctttaaatttttctaaaattgagatctacatgttaaaaatatccacatgtattgttcatgcttgtttatgtgctgttttagtgatttttttcttttctctttagattccgacgttcccggaaagtccgattttgcaggagaagattttgaggaattccaaggccagcaaggcaagtcacacagatcccaaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatatattggttcagctagatattagatatgattgctcagccatgcttagaaacactatttcatataaatgggatacttatgactcactattatttaatgatggcttaatgatagctcacgatggtcaatcgtgattggttaattaattaaattgccaactaaaacctgataatggtgggttgtgagtacatggttttgatggtcgtgctcatgacaattaaggaccggttcacgattttcggttgtgaaacatttaccgtgccaaccacaagccagcgtgggcaacggctttactttctgtatagtatggttcatagcagagcaccagactgtgaagtggcagagataagcccacgggggtcgctgaggagtccatgccttgtttataagggggtgattatgatctgggaatggtgcaccgctttgaattgtattatatagagggtattgtcacaatctctattcgggaacttgttaagtatcgcgacgcatggttgacatgatgttgaggttgtgtcttgtgggtacagtggtacacctctggccagagtttaaactattcgaatagccgtgcccgcggtaatgggcgggtctaacaatgtctttcgtgattagtctcatatttcacaccataataattgatgatgttaataatttgtttagctcctggtttggaatggtacattcctggtttggagatagaactgtgcagccgagattggttgtttagaatggttgggcctatgcaacagggtatgttgtatagcattggattaatactgtttaattaaatactttactgttttattaaattctgaaatatttattaaatgctatttatgcaaatgagactatactatgccaccctttgttatcctgtgcacttgcatatttgctgcgtggcttgctgagtatgtcatatactcaccttgtaatcattcatcagagaaggagatctacagtgatgctgatggtgtggaggattaggtgtacccctggtcaagctgcctgtggagtgtagtcgtctgcgccgtttatcttatttttccgctgcttagatctttattggttgagaggaactatctacctctgtaatgacattttattcgcttattaattagagtaataattgtactctattatcaatttgttattgtgtgcctcggctgattcctagacgagggtttacacacatgtaagcgtttggaattttggatagaaattccgggtgtgacaggtcactaccttatcgcttaaataagcgaatgcaaaagactcggaaatgagattgaccccgacagttggactatagaggataccgacatcgttcccttccatatggcaaggaatgattcggggagcggtatttatccaaattacttcggattaaagctctgcctcccttagtcattcatcgctcattatggatgttaac

SEQ ID NO: 40360 - DNA, 17327 bp, Oryza sativa
tatcaagacaagaaattttgaaacatgagttctcatactccaaaactggggggcatgtgttaacagtgaaatttggtaagcccaaagttaccattggcttagagtcagtatcgacttcaaagttctagaattagccgatgggagtcaagtcgccatgatgtcgtgttcttggtggagttggatcaatcagagttggggtcatcggcccttggttgaacaggaaggagttgatggtgttggaccagaaataggtggcagcggccatcaagtgttcatctttggccgaattagctatggtgagagcgagggcttggccaattccaattttgtcccaatgggtgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaacataacaggagctaagccttgacttgaactgcagcgggaacaccactccacaggcatcctcgatggcacggacgaagcctactccccggagaaaccaccatctgacacatactcatactctggggttggggaaaatagagcaagactgagtactacccactgtactcagcaagtcataccggaataggggtatgatgcagggaattatcaaaggagagatagagcggtgaaactaatcacggtgaatctggttgaccgcccataaccgcgggcacggctattcgaatagttttactctgatcagaggtgtacaactgtacccacaagacacagccccacgacacgtttccgtgcgccgacatgccaccacggcataccggaaagaggccgtgataggacccttcgcataacctcctctaaccaagcacaccacacttcaggtttcacccccactcctcgcaaggcagcgggcagtcccctctcgtgcctaggtgaatccggaagcgacagaggccgtcgcagggcccgccccgttccatcacacccacccttgcctggatgcgtcagctagaggaaagctacactacaagcccagccgttgcccacgctggcttgtggtaagtacgataagttcttccagggcatccggcgaaccggtccttaactgccatgggtgcggccaacaaaacaatgcacccatagcccaccatgtgattcattttaattattcaacaccaaagaggtggtactaatccaacattaccattagaacctgcagtctatactttaataggatttttccccaatgtgtgctagttgaactaagcatggctaagcaattcctagtccaaagtctattcatgttataacccaagctaacaaaggaacatggtaccaaaatagcatggctgtaacaataggtaaacatcccatagtaacattataaaacaatgcagtatttgaagaaaaacaataaagcatttgcaatataggatcaacatgttcaagtgacaggcatgacttgccttgctctgctgctggaggaacctcggcgactatctcgaagtacaccggagcggggatgaaggtggtggcgacgacccggcaacgaggaggggcggacgggtggcggcggcacctaaggagggagaggagaggggttaggggattggaggaaacccgcggcgacaaaaatggccggccggagttgaagggaatggaggggctcaccgacgtgcgaggaaaccggagctcccgaggggttcgggcgatgtgaggcggtgaccgaggtgctccaagcggcggcgaagctaacggcggcggcggcttggcgcggtggcggctctagcggcggcggcgcgcagttggaggcggcagcgaacggcggtgcggcggcgagcggcgcgagctcggtagcagtcacgggatggagcggcgagagcgtaaaggggaataggagggcacggggaacgttttataggcggagggggaggcggacgtggccggcaggacctccgattttgccggcgacatggggaggagagagaggaaatgggggggattcaaattgcgaatcccgccccttttcaggcgcacgcgcgggccgggagacgcggggagagggcggcgtcacggggaagacgcgtgggcgacgcggcgtgggcacgggatgagcggcggaggtgggcgcggtggtttcggcggcggttgccgacgtggggcgggcggccggaggaaggggacgacaccgacaggtggggcccacctgtcggcgtcccgaggagagagggaggggcggcttgtgccggcccacaaggaggagggtgcgcgcggcggtagggtggactgggccgacggcccaagaagaggaaaaggagggaaaataaaaagaaaaggaggaaaagattttccctggtatttaaagattgcactttgcttattttaattggttaaaattatttcgagagctctgaaaattccactaaaaatcttgttaatgtattggagcatggggaactcaagaaaaattccaccatgccgaatttggttattaaaagcatttattaattaaggattcaactctaggttaattcaacaatttctttaggagatttattaaacaaattttaaagctggaaaggggaacttcagggcgtgacaaacctaccccccttaaacggaatctcgaccccgagatttggaagagctggcgaagaggtgcggatgggcggcctttaactcatcttctctttcccaggtggcctcttcttctgagtgatgactccactgaaccttgcaaaatctgattactttgtttctggtccttctctcgctggtttcgaggatacgagtcggcttctccacatacgtcaagtcttcttggatttcgatttgatccggacttgcctgttcctcaggaactctcaaacatttcttcaactgagagacgtggaacacactgtggatgccaagcatgttggagggaagctcaagctggtaagcaacttcacctcttcgttccaagattttgtatggtcccacgaagcgtggtgtcaacttgcctttcgtctgaaaacggtgcactccccggagcggagtaacacgaaggtacacatagtcccctgcttcaaacgtgagctctcgtcggtggttgtccgcgtagcttttctgtcgagactgggcaatcctcagcctttctctgacagttctgactttttcctctgcctcggttagcacctctgtcccgaacagttggcgttctccagtttgatcccagaagagcggagtgcggcacttccgtccatacaatgcttcaaacggtgccatttgcaaactggcctgatagctgttattgtaagagaattcagcatacggtagacttttatcccaagctccgccaaagtcaagtgcataggctcgcaacatatcttccaatatttgattgactcgctcagtctgaccatcagtttgcggatgataggctgtgctgaaattcaaacgagtccccaattcttcttgcaacttctgccaaaattttgaagtgaactgactccctcgatcagatactatcttcttaggtaccccaagcaaacacatgattcttgaaaggtaaagctctgccaaccttttcctagtataggtagtgtgcactggaatgaaatgagcaactttggtgagtcgatccacgactacccagattgaatcgtggccagatgatgtcctgggcagaccggttatgaagtccattctaatctcttcccatttccattccgggatctgaagaggttgtagcaaacctgctggcctctgatgttctgccttaactcgctagcaaacatcgcagagtgtgaaaaattcagctatttctctcctcatgctgacccaccagaatttttctttgaggtcttggtacattttggtgctgcctggatgaatggagtactaagtctgatgagcctcggtgagtatcagatcctttagttccttgtcgtcaggtacgcacaatctttctcccaaccagattgtgccatgctcatcctcatgaaaatctcgggcttttccaaccctcatattcttcttgagctcagctatttcaggatcatttacttgagccgctctgacttgatccacaagcgtaggccgtgcttccagagcggctacgaactcgtgttcaatgactcccacattgagatgttcaagctcctgctgcaattcttcacacatgccctcgatgcatagggcattgcagtagcttttcttgcttagcgcatctgccaccacattggctttacccgggtggtagtgaatgctcatgtcatagtctttgattagttccaaccatcttcgttgtcggagatttaggtccggttgggtgaagatgtatttcagactcttgtggtccgtatatacttcgcagcggttgctaatcagatagtgcctccagatcttcaaagcatgaaccactgctgccaattccaggtcatgagttggataattcccttcatgtggacgcaactgccgcgaggcatatgcgaccactctaccttcctgcattagaacacatccaagcccgtggcgggatgcatcgcaatagacctggaagtctttcatctggtcgtgcagaatcaaaactggtgtggatactaatttctttttgagctcctcaaaactcttgtcgcactcagctgtccatttaaacttctcatctttcttaagcaactgactgagtcatgggtcgggcgatcctggagaagttttcaatgaatcggcggtaataacccgcaagtccaagaaagctccgaatctgcgacacggtcttcggtggggtccatttggtaactgactccacgttcgatgggtcaactgccacgccctgagctgtaataacgtgacccagaaatttaacttccaacaaccagaagtcacacttgctgaacttggcatataactggtgctccctcaacttctcgagtaccagacggagatgttgttcatgttcttcttcggactttgaatagataagtatgtcgtcgatgaacaccacaacaaacttgtcgagaaattccatgaacactttgttcatcagattcatgaagaacgcgggtgcgttggtaagtccgaaagacataaccgtgcactcatatagcccttaccgagtggtgaaggccgtctttggaatatcctcttcccgaattctcaactggtagtagcctgatcgcaggtctatcttagaaaacactttagctcctttcagctgatcaaacaaatcgtctatccgaggtaagggatatttgtttttgattgtgacctcattgagtgcgcgatagtcgacacacattctcttcgtcttgtctttcttctccacaaaaatgaccggagcaccctaaggtgaagtacttggtcgaatgtaccctttctgcagctgctcatcaacttgcttcttgacctctgctagctcgttggccgccattctgtacggtctcttgtaaataggggcagttcctggtgccaaatcaatctggaattcaatttctctcttgggtgacatggtagtgaggtcttcggggaacacttctgggtactcgcagactatggggatatcctccaatttccgcgaattcttctcctcgatgaccactgggatttccacctcaatctgattcaaagagaccccttgctttggtgagactagtgatttgtacactactgtttctcccttctcgttggtcaaggtgactgtgcggttcgcacaatcaatgactcccttgaacttggtcagccaatccatcccaagtatgacatctaggtccttggattccagaagaatgaggttggctagaaatggtgatctttggatttctattgttatagaagggctgaattgtaccgaagtggagctattccctggggtatgaacccgcattggtgtgctaagttcctctcttattaacccatgcatcccgacaaacttctttgaaatgaacgaatgtgttgcaccagaatcaaaaagtactgttgcagggattgacttaacaggaaacgtaccccgtacgacctcttgtgctgcttgcgcctcctctgtggacgcgtggttgacatgggcctggacaaaccttggcccggcacgcctaggcttcgggcatttgtcagcgaagtggccaagctcgccacagttgaagcagggtcccggctttcctccggactccttcttgagctgttctaactgagccagcatagctggtagatctgactgggctggtgccattaatgggggtggagtcgagttgtggttgtgctgcttactgttgttgtgactgccaccgttgtagtcattgttgaagttactcgggtgatagggatggtgctgacagacgatcagggtggaaggcccacctagctgtcccaccatgaagcgaggctagaaattcataatcgccatgggcacaactagcaaaaccgtgcacccacagcccaccatgtagtgtgttttaattaactaacaccattacggtggcattaatccaaagctataccaataatcaaagtctatgtattaatgtggttccccatttgtgtaccctggctggtcctggacaggggtttaatacacattcaccttagaaattctggttcgtgaatttctgggcgtgacaatgggtctgcttgctagccgatatgcgcttgtaccacgtggtccagcttttctctggggaggttttctcaagggatggccaagacttgaaggtgtttttccaatgacctaaattagggttggctagtctgaaagggattctgttggtttcaccaatgatgaactcagtgggatcaggattgccgattggaccaagaaagtaatggttctcgtgagataggcttgggactgcaatcagattggaaaggtgctacgaatccaaaagaacagagaagcggagatcttgctagagtaggagtcgcttgggaatcgcttcatgcaccgaggggatcgacggagagagagaggacggagtttgctttggcggtgaaaacggaggaaacggtgtgaggtttctcggggacaatggttagtatttaaagcgctggaataacagtcggaaaacggcaagtgcgatattctctcggaatcgatgtatggaaaatccgaaacattatccaatattccagacttggggggcatgtgttaacgaccaaatttggtaattcaagggtcggatgtgaagaaggaatcgaaatggaggtcgagatagagattgtcccggaaacagagtaaggatcggctgaggtccgaatcggctatgactaagatcgacagagtttgagtcggacaaggttagccgattgagccgagcccgacagtatgacacggcgtatgttgtcggtttaggttgacgtgcttcatgatgattgccacgcatggataaagtcctgagaaggcaattgtatctattaattaggatattttatgtaatttccttagagatatgtttgggcaaaagtctgccgcaaagacttatggtatctcagagtttgttagagataagagtcgtgtccgagatagacatatcttgtaattctcgggtataaatagacccgagcctcatgtaataaaaaaaacaaacgttcaacacaatctcggcgcatcgccaccctttttactttcgttttgtttcgacgagttcttgctttcgggttaagctacatcggtttcgatcttcaacaagaggtaaaacatgttatggcggcttgtgttctcgggattagtgcttccatcttcatgatactttaatcttgtttatgtaattcatcgaattatcatatatcttatataatctccggcaatatcattatttaatctacaatcggctaccatctgttagtagaaagcagccgattaggttaaatcccgatgttggcttagattatatagggtatctaccactctatgacgcatccaacggcttgattgtctagatattgttcttcttttcatatttatagctgtatcagttgagtttgatcttatgagtcgtgattagaatctcaatctctagcctgtttttggttgccaattagagtagtatcggagtttcagccgatcttacctgatttagctacatttatcttatatgcttgattgacatgttaaatctgccctttatatcaagatcttgccgcttttaagtatattagacttttgtttggtatttttatttgctttgacgtcttagagtagtatcagagtattagccgatacatgctagatctatttgatcggctacgctatggacatatatagtctcattgttaatatatatttcgatctaagtgatttatactgtctcggcatgggaaccgatctatcccaatcacttgatttaagtatatgtcgacatcaggattatatattgttaatatctacaaccgatcgagtagatttagttcgttcttacttattcatgattgccgatcgattcacatatgacatcggcccaaagataaatgatatgtcatcggcacctagccgatgactatcgtttatagatttaactgcggtttctttgtttttgcttcttgttgattccaggatcaaatcaactggcacactcatacacccaaaggcaagttttggacctgcactggagttaagcagatctcccaggcctcgtgtttttacatcaagcttatgcctatgaagtttactagctttgggtttttctttgcactttcaaataaggttgtaatagtttggatctttaaagcattaatagttgtataattagtttgtatgaacaaatttgtataattaatcgaaagttgttctgtatatcaatctgtgcgtgatcgaaatcctggacgatcacgagtggatttttggggcaccaaacctaaattgggtgtcccaacagtactcatccataggggtagccttgcttaaattccgaaagtcaatacaaaccctaagcttgccattctttcttgatgactagaactatattggaaaccaactcagcatatcggcatggccgaataaagccagcatcatacaaacgagtaatttcagctttgatagcatcatatatatcggctttgcatctcctgggtggttgttggtatggccaatatcctggttgataggaagccgatgttcaataatcgatcggctgtgcccgggcatttcaaaatattccccagcaaagcaatctctatattctttcaaaagctctattaacttggttttgaattccgcggataaattcttactgataaatgtcgaccttggtctatcccctagacctatatcaacttcttccaaatcatcagccgacatgaaaccctgtcctaacttgccatcgagatcatctaatgtgcctttggtgtagaaatttgaaccctccacgacaccctcaaagtaacaatttaggctctccatcttcaattggttgtatatcacaatcaaacacttttaaataacctccttcccaaacttttccagacagtcagtcaaatccatccatcccccaaatagctaaatcggcactagcaacattaactgacctgtcggctggtgcgatctgtatcttgtcaccttgccattgaattaaacaatggtgcatggtagaagaaatacaacaattcacatgaatccaatcccttccaagcaacagactataggaacccttcccatcgatgacaaaaaacgtagtaggaatagttttgctgccgattgtcaactccacgtttaatactcctttccgaaggattgccaccaaaatctttaagaaccatattagtcgtgatgaggtcatctgcattcttacccaatttcctgaatgtagcatatggcatcagattcatagcagccccaccatcaaccattatctttggacatcggcatcccattgacaaatccataaacgtacaatggcttgatatgccgattttctgtcccctctggtttctcaaaaattgcttgttctcgtgacaaaatcaacttagcagaagcttcttccatatcatcagcatcggcttgattagtgtcgcgaccgagaaaatttgcattttcccgaacgctagtgtattaatccccttcccaggaaaagccagggtacaccacacaaacatgatacaaaaggcacatctttattatatcgataatatttatattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggagaaagatagagcaagaatgagtacaaccacagtactcagcaagccacaccagcagatgcatgattaatgcaagggggtacaaagggtaataatataggggttaagttttgcagtaaacagcatttaaaagacacttagttggccaaagtcattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacatttcagttgttaagcaggttttaagaattaaaacactaacttgggtacattgctaggcttgcccataaccgagggcgcggctattcgaataggttatactctgatcagaggtgtacagctttacccacaagacacatcttcctcacgtgtaaccacgtgccacataccaccacggcatacggacgaaagacgtgacatagttcccaacccatcctagccataaacaagagtatcgacccaaccccacctacggccggaacctccgggacaggcaggcaggattgagaccctagcagcaggacaccagccctgtgccatgacatctcgactaccgagccgcagctcgtgtagccttcatttgtcctagagatgtccatcgacccctgacttcgtccatctccatccgtgtacttttgtttataaccagactgagccacaaactaagccttacccactagacatgtggaagtacggtagtgctttgcaacagaggcccgagcttaatccttatagtgcccgaggtacgacaaacaaaacccaaccacgcacctcgagcccagcctaaaaccattttgggggttttgaatagaggtggaggtgtgaatccaatttccacaataatccaaccattccatagtgtccaagtgatgagaatattcccaatgtctagagttgtagaaccacctaatgttgcctaattaaccagcgaagcatctacctaaattcatactaggggaaccttgagtagagtgcccactagttggggtttggtttattctagggtgaacaaggtaataataacaatagcaataataatatggtcataacaaaggtaaataggcatggctaaataaaacagtgataacgcgggaatttaagtaaagcgataatgcaataatttaaatcaaagtaatttcataaattgggattcaatatgttcaaggatgatgtgccttgccttgctcgctttcccaaacgtcggcttcaacatccacgaagagcggatcttccgaagctgcagcgtctacacgaccaacggaaaagaaaaaggcttttactctaataaactccatataatgagcaggaacaaagcacaaatatgggttcttgacttcttaaggaaaaattagagacttgaacggtccaattccgagttcaaatgaccaggttatggccatttgaagtttatatgctctttaaatgaatatttgcgaatttcttcatttaaattttaatttaaaaagggtttattgcgtcagcccagggggagggggcgcgcggaccgggtccacgggagtggggcccacgcggcagcctcacggtccacggtggaccgggtgcacccgggctcacaccggccggcgccatgagccacacacgtcagccgcacccgagggcgcaggcggctgacggccgggccccacgcggcagccactcggcacgcccgagggcggccatgccggcgcggttggcgggaggcggcgcgcccgagccccgatggtcgccgccggcaaccaccggcgcggcggagcggcggccgagagatgggagggaagggggaaacgaggcggcggtccacggctcaccccagggcgacggcggcgacggaggaggtggtcggagcggagggaggcggtggcgcggctcgggtcaacggggacggcggcgctccggtggtcggcgaccgaaacggagaggcggacgaggtcggcgaggatgcggcgaagccgaaggaggcggcgccgaggtgggaggcggtccagggcgacgacggcggcggaccggagctcggcggcgacggccgagacagagagcgacgtcgcgagctcgaatccgacgaggaggaagggcggctgtcacagccagattttcgttttaggatttataaattatctaataaattattaatagaatttatattaaatgttcattaatttacaagtgaagttaaatgtgggaaataaaatttcctaaatttaaagcattgatggatttaatttttattaaattctccatgattaattatactctctgaaattttgttggatttttcagagctcaattcctaaatgatacaaagaagagttcagtaattatttaatcattaatgatctaattataattatgttaagtgcttttcttgtttaaaaatccttaatttataatttgttgtctaaaagggaattattagaaatgatcttaaaagcctagaagacaagatctaattttaatttgttaaatctcaatataaaagtgggctagataaaattttgttaaatacttctcttgtttctatagttcctagatttttctgggatttatttgagccaaggaagtatttttaataaatggaaatgcatttcatgaataatttaaatggaaaaatgtttttaaaagtcccttttggttttgggccgaaagccggcccaaaccgctctctctctctctctacctcggcccaagtcggcccaagccgagccgcccacgcgcgcgtgcgaccgccgctgacaggtgggtcccacccgtcagtcgtcgtcttcctctcgccgaaaccctagccgagctgcgccgccgccgccattccaaattcggccgcgcctttccttctccgatgaaatcgtttgaggggaaatgtttcccgagatcttctctaccttttcctttttggaaacatcgtctaaatcgctttggaaatcgccggatttgagttcgattcggatcgatttctctcctccgaaccctaaaccttccttcccgtcgccggtcgccgtgggccttcgccgccgctccctagcccctataaattgacccccgagctcccctctaaccgccaccaccctcgccttagtctctcgtcgccggtagagccctagcgccgtgccgctttgcgccgccgtcgccgccgtcgctccagcagtgcgccaccgtcgcttgggtcgtcgtcactgctcggggaggccgccgtcgtgatcaccgtctcgttgccgtcctagtccgccccttcgccgtcgctatcgaccgccggagcaccgtcgacgtcgtcaagccgaagaccgccgccgcttcaacctcgccgccgtcgtcgtcagtcgtcatttgccgtcgtccaagtgctcggtgagttcgccgcgtcatcctctacgcgtaggtgtcctctgtttgcgccgccgcgccgtcgttcgccggcgagcacgcgaggccgagccgtcaccggtgatgacgtcatcgccgacgtcatcgttgccgtccgccgtggtccggtcgtggaccgatggatcttggccgtccgttttggatggatgaatctcggccgtctaatcttatgaaccgccgccgtgcaaccggtccaccgcgaaccctagctgatgacgcaataattcccttttccttttcaaaaataattcattattgcgtcataattcaattaaaatccatataaatgctttaatccggtttaatctttaaaaattcataactaattctttgtaactcagtttaatgtggttcaagttgcaaaagttgtataaaataaagacctacatattaaaattatccataaattgaattaaatttatttaatcctttttaaatgggctttaattagatttaatcttgtaaaattcgtaataaattcatttgaagtcagaatgaggccgttcaagtctcataattcatctaaaattattatctacatgtttgtttactttttatgtattgtttatttggtttttattagtctttttcctcgttttgcgtgttagcttgtcgtttccgtcgtttcgaaagttcacgagtgcgccggaagtgttcaagaagattaattgaagaccctttattgcaaggcaagtcacacagatcccaaacaccgttcctttgagcatgttgatcctatatttaaattctctatttatttcaactgtgcatttattttcgaatgtcactgggtggtgtgaatctattcctttgttgtggcctatttgcattggttactctattctttgataccttgggatattataatttgactagttgagctttatatatattggttcagctagatgttagacataattgcttagccatgcttagaaacattagcacaccattaggataactaatgtttcactattacttaatgatggatatttaattgtagctcacgatggtcaatcgtgattggttaattaattaatgtgccaactaaaacttgataatggtgggttgtgagcacatggttttgatggtcgtgctcatgacaattaaggaccggttcacgattttcggttgtgaaacattaaccgtgccaaccacaagccagaatgggcaacggctggacactttgtataacaaggctcattgcggagcaccagactgagaagtggcggagataagcccacgggggtcgctagggagtccatgccttgtttataagggggtgactatgatccgggaacggtgcactgctttgagttgagttatgcgaggggtcttgtcacaatcactcaacatggtgacgtgtctgcgcggacacgataacatgctggtgggttgtgtcttgtgggtacagtggtacacctgtggccagagcaaaactattcgaatagccgtgccctcagtcatgggcgggtctaacaatgtctttcgtgattagtctcacacttctcaccataataaatgatgctataactggtaatattttgattagctcctggtttggaatggtatattcctggtttggagatagatctgtgcagccgggtatggttgcttcagaatggttgggcctgtgcagcatgggtgtgctgttcagtgttgattaatattgatgattaattactctattgttttacaattctcaactgtttgctaaatgctgcttttgcaaatgagccctatattatgccatcctttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagctgaagccatcgctagaccgttattccgctgctgttttcttttcttttgtaagtatgtaacgttattattatgatggatttttatattaaattgtcagtttgtgtacctaggctgattcctggacgaggattttatgcacaaataagttcggaaattactagtgaatttctgggcgtgacagcggcgagaggcggaaacggacgggggaggcacggggagggtttaaatagggttggaagggggagagggcggccagaggggaaggaaaccggcgcgggaggtccggccgccatcaatggcgccggcgggattaggggaggggtttccaaacgaatccaagggagagagggagggaaaatttggggaaagggagagggaatcacggggaataattcccccctattgattgcacgcggggacgacgggatgcggcggattcggcggcggcggcggcgcttggcgcgggcggagcggagggagcggcgggaggtcggggatgacgggtgggccccacacgtcagcaagggtggcgggcgggcccaaagggaggagggggattatttttagctttttctttttaataaactttgataattgttgttgttgcttaataaatatttttggtactctgaaaattcaagtaaaatttgagggctccttttagaccaaggagaatttaacaaaaattctccgggctacattcgaaattttcttgtacgtattttagtgtttgccaatttcttttcgaattttaattaattctattattccttttagggaatgttttttatttcgggatgaatttatcagaacgtgacaaatccacccctcttacaggaatctcatccccgagattcgaggctagcaagaagataggttgggcggtcttctcttcttgtctgacttcatccgtcgcgtcttctataacaaacttgcctagcaaaacttctccactctggactgcttggcttgatctcctgttgcagatggaatcttctcttcacctgacttgtccctagttgaacctttagctgacttcaactgggtgcggcacttgaagatggggcttcagttccagaacttcttataattcatatctttggcgtcaacctcatacaagttacccacttcacgttatgcgtcgatatcagcttgtcattactaggataccatgcttgtcatcatgagaatatcatgtttgtcatttacttctaacttgccaccaactgcctcatattagctttcctgctctccaggtgctagatactactgctattcgatgcgagggtcgataacttttgcctttgaattatgtttctcaacagaaccaacttatcccacttgacatgctttgacgtcttcccaaatggctttactgctggacttcttattgtctgatcgttatcctgccaaatctgaagcttcgttgttagatgtgattttattctgacctctgtagactatcttcgaacatatcacttggttcataactgggaatagctcccacgaacaagcagctcggattcactttctttacatttagtttacttcccactattatcttcaggttgtcattatttagcattcaacgtattcctttacacctttgaccttgatgagttccttcccattggatcatctccca

SEQ ID NO: 40361 - DNA, 2721 bp, Oryza sativa
aagatgcttatcatcggtacattgtttctactatgggttctaattaacacgaggcctcacgggtacggcgtttgctccagtgaccacaatacgattgggatgtctgcttcgtgtaaattggcggtaatgtggaggtcgactttgccttggttgcaggcagtcccttgagtaatgcccgggttctttgcaattatagcaaatcaacgtcttctttgctgagctatccgtctggggacgatcattctgacttggagttggaattggtggttggaaatccttgctaacattggcatcagtggtaccatagttgctatcaccattggagtctttctcagagtcacaattgctagggttgtcattctgggtgccatcattgatactatcgtcgacaccttggtgaatgatgttgacattgcacgcttgattcgagtggtcactaatggggcaagaagcatggttgttggtggtatcatcatcattagtattgctaatgttgttgtctgcattgtgtccatcttcttggggcagaaactcttgatgcgcaacagaagatccggtgatctgaagtggctcggtgcgctgtctttggttaccacatggaaatactgggatgctaacaatccttctcttgcagttcttcatccgattatgctcactttcgagttgtatggctttgtccacaagtttctcaaaatcttcatattcctctagtagtagttgcactgcgatctcatcctttaacccgtggagaaacttctcttgtttgtcttcatccgtttccacatcttctggtgcatagtgagccaaacaatagaactcgtgcaggtactctgtgacggtcaaatcttcttgcttcaggtagcggaactctcgttttctctgtgtgatcattcctacgggaacatgtgatctcttgaacacggctgaaaactcatcccaggtgatggtatgtccttctggccgtgatgcttcatagctatcccaccattctgaagctggtcgaaccaactgatgagttgcgaagacaacccgctcctggtctgtgcactgaatcaaccctagcttcttctcgactgtgcgcaaccaatcacaagcttccataggatcgacggcaatggcaaaggttggaggatcagttttgaggaattctgataacttgcactgtcgctggactgtaggtacttgaacgttggttgcccctgctgggttcttccgattttgtaatagttgaaatgctgttgccaacatgttggtttggttaaccacaatttggattagctctggtgaggtttcgttgatgcttttctcattcccattggcttgggttcttgagtcatcagatccatcattcccatagcctttgttaccagtgttatccatctgtcacaaggtagaggttgagagaggaagcatacaaggaaagaatagaccggaactagggacaggaccttaaaggaactaactctttttgttgatgtgttgtttgttttgcttattctgcaagttgattaagcaaacaacctagcatggttacatcacaacccaccgatgcaaaccacgcgctacacacacaagcaaggaaacacacgactaacaacactaccctagaggacggcctaggttctgcgactggttcccaagatcttcactgcttcttccacttcgctagcggatcctgcggtcttccggagctttggcaaacaattggcgacatctttttcttcgcaaagctgaccatctagtactagtcgaaaatccgaaggaggaagaagagaataaacattttgcaaatagcattagggaaaggaggaaaaaggaactttcgcaaatagtttcatttataaaatatgtccttaggttttatccacttggcttatcgtacagtcgagatggctctgataccagcttgtcgcgaccgagaaaatttgcattttcccgaacgctagtgtattaattcccgtcccaggaaaagccggggtacactacacaaacatgatacaaaaggcacatctttattatatcgataatatttatattactacaaaggcacttaaggcctgacaatcaaaaataaacagcagcggactagcgggcctacggctccatcttcagaggcgcttaactggggtataagccaggactccacctaagacttcttctccaaagcttctcttactgaagggggggaaagatagagcaagaatgagtacaaccacagtactcagcaagccacaccagcagatgcatgattaatgcaagggggtacaaagggtaataatataggggttaagttttgcagtaaacagcatttaaaagacacttagttgcccaaagccattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacatttcagttgttaagcaggttttaagaattaaaacactaacttgggtacattgctaggcttgcccataaccgagggcgcggctattcgaataggttatactctgatcagaggtgtacagctttacccacaagacacatcttcctcacgtgtaaccacgtgccacataccaccacggcatacggacgaaagacgtgacatagttcccaacccatcctagccataaa

SEQ ID NO: 40362 - DNA, 5914 bp, Oryza sativa
  unsure (1)..(5914): unsure at all n locations
tcctagagatgtccatcgacccccgacttcgtccatctccatccgtgtacttttgtttataaccagactgagccacaaactaagccttacccactagacatgtggaagtacggtagtgctttgcaacagaggcccgagctcaatccttatagtacccgaggtacgacaaatgaaacccaaccacgcacctcgagcccagcctaaaaccattttgggggttttgaatagaggtggaggtgtgaatccaatttccacaataatccaaccattccatagtgtccatgtgatgagaatattcccaaagtctagagttgtaaaaccacctaatgttgcctatttaaccagcgaagcatctacctaaattcatacaaggggaaccttgagtagagtgcccactagttggggtttggtttattctagggtgaacaaggtaataataacaatagcaataataataaggtcataacaaaggtaaataggcatggctaaataaaacagtgataacgcgggaatttaagtaaagcgataatgcaataatttaaatcaaagtaatttcataaattgggattcaatatgttcaaggatgatgtgccttgccttgctcgctttcccaaacgtcggcttcaacctccacgaagagcggatcttccgaagctgcagcgtctacacgaccaacggaaaagaaaaatgcttttattctaataaactccatataacgagcaggaacaaagcacaaatatgggttcttgacttcttaaggaaaaattagagacttgaacggtccaattccgagttcaaatggccaggttatgtccatttgaagtttatatgctctttaaatgaatatttgcgaatttcttcatttaaattttaatttaaaaagggtttattgcgtcagtcgagggggagggggcacgcggaccgggtccacgggagtggggcccacgcggcagcctcacggtccacggtggaccgggtgcacccgggctcacaccggtcggcgccgtgggccccacacgtcagccgcacccgagggcgcgggcggctgacggccgggccacacgtggcagccactcggcgcgcccgagggtggccatgtcggcgcggttggcgggaggcggcgcgcccgcgccccgatggtcgccgccggcgaccaccggcgcagcggagcggcagccgagagaggggagggaagggggaaacgaggcggcggtccacggctcaccccggggcgacggcggcgacagaggaggcggccggagtggagggaggcggtggcgcggctcgggtcgacggggacagcagcgctccggcggtcagcgaccgaaacggacaggtggacgaggtcggcgaggatgcggcgaagccgaaggaggccggcgccgaggtgggaggcggtccggggcgatgacggcggcggaccggagctcggaggcgatggcggagagagagagtgacgtcgcgagctcgaatccggcgaggaggaagggtggcgagaggcggaaacggacaggggaggcacggggagggtttaaatagggttggaagggggagagggcggccggaggggaaggaaaccggcgcgggaggtccggccgccatcaatggcgtcggcgggattaggggaggggtttccaaatgaatcctagggagagagggagggaaaattgggggaaagggagagggaatcacggggaataattcccccctattgattgcatgcggggacgacgggatgcggcggattcggcggcggcggcggcgcttggcgcgggcagagcggagggagcggcgggaggtcggggatgacgggtgggccccacacgtcagcgagggtggcgggcgggcccgccagtcagcggcgcgcgcgcggggaggggccgagtgggccgcggggagtggagagagaggggaagggagatgggccgagggggaaggagggagggcggcccaagagagagagagggaaggaaaaagagagggaggagggaagggctttggccgcgggccgagagagagagagagggaggctttgggccagacttggcccatagggaggagggggattatttttagctttttctttttaataaactttgataattgttgttgttgcttaataaatatttttggtgctctgaaaattcaagtaaaatttgagggctccttttagaccaaggagaatttaacaaaaattctctgggctacattcgaaattttgttgtacgtattttagtatttgccaatttcttttcgaattttaattaattctattattccttttagggaatgatttttatttcgggatgaatttatcaggacgtgacaattagcttcatattccgtaggtagcaaaaaaaccatgtttaccgataaagatgtaacagctttgcccttgattaacctctttgctttgtcggcttcaacctcatcggctgtcataactttactcttaacacgccattctttctttgccttcttcagctgatggttgttctcttgctgtacctcctaaaaacgttccctgtttctcatcctctgaacccttctcttctgattcttactaaaaataccagaagggcaccattgcgaattcatgtcttcatcttcgtcctgaaggtgatcctggtgtactgagcccaatctctgatgaataggcaaccttttctgacccagccgatcttctatcaatggcaatctcatcccttcattccaacaaaacctgaaaaacttgcagtcccaatgcagatcaaaaccaccatcatcttcaaaatatctttcctcctgcttgtcatgcctcctttgatactagttaataatcttaaccgagttaagctgtgaacttcaatgatttcccccatcggctgctctcccggaagtgtgaaccatgttaacaagaaaagggtgaccatccaccttcatcgatcttctcgaatcattaaactttatttttccttgttcaatagccgattggatctgctgcataaaatctttgcaatcattagtagtctgagatccggtgttgtgccacttgcaatatttcctctttcgcagctcctcaaccgatggaattatatggccagcaggaagttggatttgcttctcccgaagtagtagatcaaatatcttgtcagctttggtgatatcaaaatcatatctctcgtcttttccagaaatcttcacccactaacatgtcacaaccttcttgttccttgcccattcggctgctgctactttggaatcatcatcttcctcggactcagaggcgtaaggatatacatgattaaccttcttggagttcttcttagcttctgcaaacctttgctcatgcaatgttaccttttgagcatggtgagccaaactctcaaaatcctgagccaaaaatctttctttaattggagaaattaaaccttagaaagcaagatcggcaaactgagaatctgccaaagccaagctgtaacacctgttccgcatatccctgaatcttagaatgtaatcttgtacaatttcatcatgtctttgcttaactgctgttaaatcagatatcttcatctcatgattcccactgtaaaaataactatgaaactgcttatccagatcagcccaactctgaacagaattatagggtaatgaagaaaaccatgtgaatgccaatccagataaagacaagggaaataatctaactctcaaagcatcaatagccaatgcttcaccacactggtccaaaaatcggctgacatgcttgtaagttggtacattatcctgccctgagaacttttaaaagtctggaactttgtatcggtttggcaatggaacgctctcaaaatactctaggtatggatgccgatacaaattactagtatcctttggtttaagaccaaactgctccctcatcacatctgcaatcatatcaacccaaggcttttgctgaggtgctcctggcagttggtgctgaatttgatcaaattgattatactagggcaaaagctgaggttgaggtgatccccctggttgatactgaacttgaagtgaatgaggttgatattgaaagttcaggttaccaccaggataattctgaggtaccaatcggctgatgctgttgaataataggtgtctgctgcccgattggtatctgctgaattagttcaacaaccggttgagttggcttgaacattgctgcaatctgctcttgagtcagacgatgaatattcctccctgcatgctgaggctgttgtctgctcaagagataagggtcaaccggttgcttttgtgctgatgatgatgcacccggtctcccaacagctgaggttgatgccatcgggtgctctggggctacaccagaagtaggctgttgcttgccagtcaacaaattcctatatggtggaaacacaccctcaggaaggaaagccggtcctttagcttgatgttcagcaattgtaccatcaaccgcagacttgatcatatttattaaagtgttgactaatactcctgactagttaatcaatgcattgtagacagcatagtcaaactgatcttgcaaattcttgatctcttgagaatcttccccttctgatttgtcgtccttgggttcatcatccttggctttatcacctttagttttaccatctttagacgtgcatgagtccgaatcatcattgggaaccacctttagtttatacctctgaataactatgcccgaacgagtctgcttgaatgaatgcaagtattgattcttcaaattgttcatcatctgctcgtactctagcatctattctggtgtcagcttatccagtcttatcgggatgatgttttcggggccaacgtcagacagtggtttagcagtctgcttaatgtctatcatgatgaaaaaacgtcacaactcggtcccactgggtgtaccaaaagcgtgttgatgcgaaaaacacacactggcctaggagatctgcttaactccagtgtaggtcctaaatcttgctcttggattcaaaggcgtgctagttgatttgatcctgtaatcaacaagaaagaaaaacaaagaaaccaaggttaaatccataaacgatagccgatcggctaggggccgatgacataacgtcaaatattgagccgatgttattggcattggatcggcaataaagaatgaagcaatataaagttggatctactcgatcggctgttgatattaatgatatataatctttttctcgaaatatatttgagctaagtgattgggatagatcgaacagaaagtcgagacagtataaatcacttatacttaaaagtactttaagatgaagattatatatacatttatagcatagccgatcaaatagatctaacatgtatcggctaatactccgataccacttcatattaagatattaaaacagacaaaatatatcaaacaacaagcctaatatactttaatgcaacaagatcttaatataaagtgtagatttagcatatcaggtaagcatatagggaataaagtagctaaatcaggtaaaatcggctaaaaccccgatactatctctattgatgatcataaaacaagctagatattgtagttatgaatattacttaatagatcgaacccaaccgatgcagcaataagcataagaataaataaagatctaggcaagatgatgaaaacttctaaaagatggtagatatgctaactctatcggctactctccaaagataagtatcaaccgattgcaggttaggttgtgaaactgataaagattataaagcatatatgataacttgacgatttacataaacaagattagagtatcataaagatagaagcactaatccctcagaacgcaagccatcatgannnnnnnnnnnnnnnnnnnnnnnnnnnnnnnnnnnnnnnnnnnnnnnnnnnnnnnnnnnnnnnnnnnnnnnn

SEQ ID NO: 40363 - DNA, 8126 bp, Oryza sativa
tagccgatcagctatcgtttatggatctaaccatggtttctttgtttttcttttttattgattgcatgattaaatcaactggcacgcctttgaacccaagagcaagatagaaacaatggaaacctgaaacatgccttcccgagcaaggaaacccgagacccgacaaaaacggagtctgacttggactctgccggtctgaccgaccctttctagaggaaaccggcagagcaccaaactttggaaattttccctatttcaatcctaggtgccatatttgggtgtaaacagcgtcttcttttgttcaaatgccaactcagcatatttacgatcaacttgatcaacagtaccaagggggtgtgcaacaacaaccactggccaatatgattgctgatgtgatgaggggacaatttggttccaagcctaaagacagtgggatcatgtatcggcatccttacccataatattttgacagagtttctttgccgaaccgatacaagattccggatttctcaaaattctcatggctgaataatgtcaccacctacaagcatatcagccgatttctagcacaatgtagtgaagcatcggctatagaggccttgagagttagattttttcccttgtcattggaatgcatactttcttaagatgttacaaggagaagggtttcagagaacaatcaatgagaatactttctgagtggctggcaagatgcttaaggagtgatacgactggtaattagattatcgctctaaaaccgcgtgctctatgtttttcggctctcaaaaatggccgaaaaggcaatgagcatgtgttaacacccaaatgtagcacctaggcacaaaataggaaaagatattcaaatttggaaaggacccggtttcctccaaagggcaggtctgactaccgccattggattggtcagtcagactagcggcatgtgtttggtgagaccaactaaatccaactccaagtctaattcatcaggtcttgggttttcctgcttgagccgaggttttttgagttctagttggtctctatcccgagtaatacatgaagaatgccctatggaaggcaagacaaacccctttataagggctacagtcaattcaattgagcacacaacttccaacacaactagctaattaaatcgtatgttttaatatcacatctgaattttgcctagttttgtccatcttcgttagtttgcattgaaagccctccatcctcgccgctagagtgtgaatcctcgttataggtgttttttcctatttcatctaacttataaaactgatcttggtttagatttgtgtagatcgtggtggttgccgactccgtatccctgcaaagcatcaggtgttatcatcatgattggcggcatgacgaaaaaagttgccaacagtgaccttaacaacggacacataagcaacaaattgaagagaagaaccaaaaaaaatacagaagcattggtgcactctatatataaaagttttgaagccaaagttttaatttgtgaatggttgcgagttgtgacaaactcacgtgaacgcccacgctttttgactttggcatgacacattttttccatctactaagtttttatacttaattatatacaaaattttatatgtccaattcagatccagaaacaaagtttgttaattatgtacaatctttgtattttaaagttttttacttacaaactttttgggacaatccatcatggtggccccaacgcacatcggccggaacgaacatggtccataatgtgcaacccatggcgtgcaaacgttctcccattagacatactcaattgaaaggaccacacaaaacttccatcatttcttaaacagtgatatgtttatcatggcttgcgatatggtatggcttgtatatatgttccaaaatttaccatgagcatttaggtaggcgtgacgatttgtgttatcatgttatcactaaggcatcccgaattcaccaaacgtgaccattttacttaccaggtaccaccacttattatttagtcgacaacttgatccgaatgaatggtcttctttattctttatgatactatatagtttaatttataaatacactagactaccaaagaaaactgtggccacaagtgatactaaaatacttgcacgcatatagaggtttggatagggctgaccctgaaaataagtccactgtttggaattaaccgtataaaactatcacactaaactgaattgaagttagaagtcaaggagtagctgagatgtccataccagcagcaacaagagttgacatagtaacatggttcagaccattacattttttaacgaatataaccattacattttgcaactataaatatatattgatcacttcatcaatgcatccatgattgaatttgtgacgtgtgtgctgttcagaacgtgtagggatagcaattattataccagatgggtgtcacaatttgtaaagttgcctcttggtttatgaattcaagaatcaagaatccttgatcagaagtcagaactcttcactgaacactcaagcatgcagcatgcttacaggggatgtgtttctggacaagtgtctgttggattaccataacaaaagagagagaaaataaaaccaacagcctaatttcattttttgaaaaaaaagatgtgagatgttatggaggaactttgcatctgttattgatagagggtaaaaatggtgagaaaaccaatgcacgccctggtagcgctcctacgggttatggcaccgttcttaatagcctaacttgttaacaagctgccaacagctcttatgtcaaagttcaataccttgagatatatcaagacaaaagagcttccatcttctcgcccaatcgtcctgcttctaataagatgcatcaagactgagaaaaaaaaaagataaacttgtaaagaacatcagagaaatgcttcgtatgaacatgtaaggttggatatgtaaaaaaatagtgaaatatatcataaacttacaccatagtattacttaggtccacgatcatgttgtttacacccaaatttgacacctatggacaaaataggggaaaattgccaaagtttgagaagtgtcgggtttccttcacagcgccggtcagaccacaagtatgtgggtggtctgaccggctggaagggccggtctgaccgcaggtatgtggccggtcagactgtcagggtccgagtccgagtctgtcagggtccgagtccgagtccgagtctgttttcgtcgggtctcgggtttccttgctcgggaaggcatgtttcgggtttcctttggtttctatcccgagttgggcatggagaagggcctgtagagggcaagaccaacccctgtttaagggacaaggccggttcatagtaaacccccgaatataatctacttgaatcgttcttttaccatgttttctattttaccctagttttagtccatttttgtcgatttacgctgtaaattgtctggcgttgctgcgagagtacgacacctctttgtaggtttatcctgaaaaccttctgttttgcccacgagacgggtagttatcctcatatcgatctaaatatgcctagaggctgattttgatctctaaatcggctccgctagccggtttagttgtttttctacaaaacccatcttgatttggccgtttggctagatcgagatggttggcgactccatgtcaccgcaaggcgtttaagtgttgtgatcgtgtttgtcgacttgtcacaaaaagttgacaacacgatttttggtgactccactggggaacgatctatacggccatattagggccgaattttgatttagtctagtcgtttcgtcgaatcatcaaattagtttcggctaaacagccgaaattaacctacactttgccgccgatattgattttgttttcgagcttaattgttctgttcggtcgcagctagacattaaaccttgtgcatacagggagcagcagccggcttagataagtcgtttccttttgcttcacagggcaacgtagaaaaagatcaggctatcaaagccgatctgctactgctcacataccgaaaaaaaaatcatgaaatattgatctatataccgagagacaagcggtagtacatagtagtttcggtctctatttcttgctgtgcagggtgaccgaaaaagaaaaaaaaatctcaaaagccgttgcagtgcatcggctgttattatggaacatcaatttccaaatatttgttagatacacacagtagcataccaaggaaatcaagaccgtatattaatttatttggtcaaatatttcggctatgagctgtatggccggatttaatcaaggaattccttcatcaattacgacgagcgggaacgaaatcgataaggttacattggaggatcttgatgagaagtaatgtcaagtcatggaggagtggatcaaggcggtcacacaggtgctgttgatgaaatcatgcattaggacccatcaaggtgtggttctcaagcctggtcctcttcccaaatacgtctttgatgataaggtaacctccaattcgcccgatccaagtcttgccattcgaaaacatattgatcgttgtgtagatgcatattttagtgcttattttgacaaaaatatggtagaagatgcttgtaaaacttattctgataagaaaattggctctaaaatagccagttatcaacaataccgtgctacttctacttttgcgtctacacaacatattcataatactatggatggatcaatgggtgttcacatagccgattccaaaggaaccagttatacaaaaagcttagccaatggtcagaccgcgcatcacgccggtcagactgcactctttgccggtcagaccgcgcccgccatagccggtcagaccgtgccctatctccgcaagatagtgcctcctatggccggtataaccgcatcattgaccaccagtcagaccgggccattggccggtcagaccaggtgcttggccggtcagactgggttatgcatagccggtcagaccagcaccctggaacctcttccagagttttgtcccatgactaatagcactgacttaaattgttatttgcctcatgttagtactggtagtcatgctattccacatacacatgctattgcactgataatatagcatgtatagccgaaccaagcgacggttcggattatgctaataatttgtgcaatggtgccataataagtatagccgaaccaaatgttggcttggattgttttactaagttagataataatgcaataaccaatatagccgaaccaagcgatgatttggattgtgttactagtttagacaataacaccattgagaatatagctgaactaaatgacggttcggattgtatcacaagcaaaagtagcggtaacaccccgattttcgttcaggattaaaaataattaaacaatgcatttctagaaattaaataaaaattaaagcaatttaatcatgtgaaattatagaggaaattaaaattttccttcaaaaatcattggccgagaatattttgtaatattctttgtgccctaaaatactctctgaaatttcccataaactttgggagctcaagaaataattttaacaatacaaagttcattttatcaattaaaataaaaagaaaacaaatttaattctccttccttgcccttgcgccattttcggcccggcgaccctacctgtcagctcctccttccaccttcggcctccagagccgaagcggccatgccgcccttttgtggcccacgtcgccgccgattccggctcctcccgcttgcgccctcgtgcccaaaccgcatgaaagcggttcctctccacctcatctacactctccccatgtttccccctaaaatcgcgcctagatcgagctccacttcgcccatgatgtcgtccatgtcgccggccgttgccacccgtttccacccctctctgccatgatttcctttcccgcgcccatataaagcatctcccagttctcctctaccgtttcccctcctcccccgagcttcccatcgcctccctcaccctccccacgccgtgatgtgcactagggtcctgatcttccgaaaggttctgataaacaacgatttgggcggagtcgcgacacaaatcgatccggcttcttgaacgcgcacgctcttgagccccgcaatcgcaacaccacgtctcctctggttatcacccctgtcgaaacgcggatgacctcgccgagaaggctaatccctgtttgccaatcgaagaacacaaacaagaacgagatagaaacaaccaaaattgcagatgaatgattaagctcacgagttggggtcttacaaactgatctagcggcgaaactgttctcgacagaataatctaagcaaaacccaaaaacctaaagatggtggcggtattgatatatagagtttaggatcgtgcaatcccctctcgatgcaaccctaatgggttccaacatgatacacggcacaaaggcccaaatacggtgacgcagcaccgggacagattctggacgtcaacttgttcggtcgattcccattgactcggaaagaatttggacatgagaccaaaaccattggaaaggttatctccttagctttctatccatataaagaacgccccaagccgagcatgtatgcaacctgggcgcctgttttagtgcagattggtcctggactccgaattgcacccgaggtcgaattggtttgggcctccaccttgacttggacgtcctcgatgatcctccatggctctaagtccttctccaagtgtcttcttgtcccctccattgttcctaatcacaatataatcattaggtaacaatctattctcgaattcatacaaagaagaacataggaacgagctcacctctaaattcaattgtcgcgcacgagctcttgttatcggtcctggaatgaccgttggaggattgttgtgtgtatctgaggtagtgatgtccgcatcatcctccccctcttgaattgaagtcgtccgcgactcaagctcatcctcttctcccaagtatggcttcaaatctagaatgttaaatgtgcgactaaccccaaactcgggaggcaactcaagtttatatgcattatcatgaatcttctcaacaattttaaaaggaccatcagcacaaggcatcaacttagactatctcaattccggaaatctatcctttctcaagtgcaaccaaactaaatcacccggttcaaacttaacctcttacttacctttactaccaacaattctatacttttcagtcatcttttcaatgttgagtttggttgactcatgcattttcaaaataaattcagcgcgtgccttagcatcattatgaaccctctcactagtaggtaaaggtaaaatatcaataggagcacgagggttgaaaccatacactatctgaaaaggacttaccttggtagtagaatgtgttgcccgattgtatgcaaactccacatgaggcaaacattcttcccacatcttcaaatttttcttcaaaatatcccttaacgtggtacccaaagtacggttgactacctctgtttggccatctgtttgtgcgtgacatgttgtagaaaacaacagctttgtacccaacttgttccatagcatgtgccaaaaatgacttaagaattttgcatcacgatctgaaacaatagtagaaggcataccatgcaagcgaacaatctcatggaaaaacagatcagcaatatgaacagcatcatcacttttatgacatggtatgaaatgtgctatcttagaaaaacaaaaatgttatccctccccctcttagttctaggcaatcccaaaacaaagtccatagaaatatccgcccaaggaatacaaggtacaggaagaggcatatacaaaccatgtggattcaaacgagacttagctttttgacaagtggttcaacgtgccacgaacctctcaacatcctttctcatcctcggccaaaagaaatgcaaggccaaaacatcttccgtcttcttagctccaaaatgtcccatcaaccctcctccatgcgcttcctgtatcaacaaaagacgaacggacccaactggaatgcatagacggttagctctataaaaaaatcca

SEQ ID NO: 40364 - DNA, 16007 bp, Oryza sativa
aatcccgggggtatctcagctggaaagacatcctcatactcctgcaaaaggttagtaacaacaggaggtatcgaactagcaatatcatctagggaaaccaaggcttgtttgcatatcaaggaatagcaaatatcatcatctgaaatttcagcaatgtcacattttgttgcaagcataacaccacccttcaacttaattccctcaaccttagaactaggtgaaagcttatcgtttttaggtgaaaaaactgatttagcaacttgctgattctcagattcattaagtttcaaactagcagctcgctctttatcagcttctacaatttcagcaggggtcaaaggtagcaatgtaattttctttccattatgcacaaaagtgtatttattcctcctaccatggtgtgtagcatcattatcatgttcccaaggacaacccaacaaaagtgaacaagcttgcataggaaccacatcacaatcaacaaaatctgcatatgagccaatggaaaaagaaaccctgcaaacctgtgttacatttgctcttccggaatcgtttaaccactgaatatggtaaggatgtggatgtgtacgtgtggtcaagccaagcttcttgaccaaatcagaactcaccaagttgttgcagctacctccatcaatgattacacgtgcacgacggttgttgatgacgaagaaaatctgaaacaaattatggcgttgtaacctctcaggctgctgtacctgcgtgctgagcacccgctgcacaatgatggtcctgtaggccgttgtgtcatcacgaccaaagacttcgccatcctcatcctcaacttcttcttcctcctcttcctcttccacgtcagaggtggtaatgtagccatcttctgtagcaacatatgcccgttgactagggcaatctttctgcacgtgcccaaacccttggcaacggtggcactgaatgcgtcccgtggagatggttttggggcactcttggcgggtacctgcaaagaacctttacctaactctgctagtcgtggtggagatggttttggtgccgcagaagcttcggatgcagctggtcgcttgcttgctggctggaaaggcgcccgaaatgaaatggccttgggcagtcccgcagatggcatcatgcacggagtgtatgtactcgccttgttcttgccctgttgctcacgcccctgcaattccttctctgcaagcatagcaaactgaaacaactggttgacagagttaaattccttataatcaacaatgttctgaatttcctccctcaaaccagaataaaaacgacaaatggcatcctcgaccccctccactatgcctcagcgtctcacacccttttgtagctcaccatagtaatcctgtacagacttatacccctgttccaaacgcattagtttctttcatagatcctatgataagatagaggaacaaatctaccacgcatagctaccttaagttcttcccaagtagtaggtaaaaccccctcatcagataacccagcccaccacatgatagcaaaatccttgaactcactactggcttgtcaaactctatgttgctcaggtacaaggtaggcattaaacttctgttctaccgtcatctcccaatcaaggtatttctcagcatcataatatcccgaaaacgatggtattttaaacttaaccttagcataaggatcgtcgggcacacgattattattaccttgttggtggcgagtgccacccatacctgtgcggtttgtgcgtaggcgacgttgtagtggtgccattgaaaaaccattgttacctggggactctcctcaccttcgttacctgaaacactaaaacagcaacaaacggtgaaggttatccctaataatctactacgcaggtgtagtggtgcctctcaacgattctcagcaatatggagtacctaaccaagctcttgtaaggttcttaccagcaaagcaaaggatacctggaaggcatagtcagcgattgcagggatcaagaacctgtgctgtccagaagtaatatgtggagataggaaggccaaatatatgtatatgagtggtacacaatccaatgacagatagtaatgctaaataaaaatcccaagtcacttgcccttcgttgctggtctactcgtgtcctagacagtagtggtaacaacaatcgctcaaggaaaatgacaccagtaaacagcaaggaaggacttgcaggcaagcttcggcgagtttcagcaaaaacaacaaaaccgaactggcagataagctcaacggagcgcgtcgtgagctcaatgcactactggaaatcaacttcactttttttttcttttatttttttgatatttttttctttttccagaacacgagaataggcacacctccaagttacagctcaatcggagttgatatgtggcgtatggaattttctgaaaccactataaacaatgtgcaggaacttgtgagctcgagcagacaattttgcaagccaaattttggaattttggattcgccaaacccgccgaaggtagggagaaacggatgtaaaatttgcctgattccgagtccgtatgcaaaagttatggctgtttgaagtttcggcttccgtctaggtcttcgagaggggatataacctagtctattttgcggtggaactgggatatggtggcagcggagtttgtagggtgttctggtgatatgtggtgatctggatgggtgtttatgatggctgaaacggctctcaaaggataaaccctaacacacggtgaaggtggcggctagggttacaaaggaaaaacagacgactagactaaaacacgcactagaccagcaacaggaacttaaactaggactcaaactcaacactacggactctgaaaaagaatcatgcaaaggctaaacacggtttaggttaaggtgactaacgactaaattttttttggcttttctgtagaccccaggataattgcgaaaaacaaaaactaatctagggcaaagaaactgagcgaacctgacggtgaacctagagctctgataccacttgttgtgcactagggttaccgatcttccgaaaggttctcataaacaacgatttgggcggagtcgcgacacaaatcgatccggcatcttgaacgcgcacgctcttgagccccgcaatcgcagcaccacgtctcttctggttatgacccatgtcgaaacgcggatgacctcgccgagaaggctaatccctatttgccaatcgaagaacacaaacaagaacgagatagaaaacaaccaaaattgcagatgaatgattaagctaatgtgttggggtcttacaaaccgatctagcggtgaaactgttctcgacagaataatctaagcaaaacccaaaaatctaaagatggtggcggtactgatatatagagtttagggtcgtgcaatcccctcttgacacaaccctaataggttccaacacgatacacgatatacggcaaaaaggcccaaataccgtgatgcagcacggggacagattttggacattaatttgttcggtcgattcccattgactccgaaagaatttggacgtgggaccaaaaccattggaaaagttatctccttagctttccatccatataaagaacgccccaatctgagcacgtatgcgacctgggcgcctgttttagtgcagactagtcctggactctaaattgcacctgaggtcgaattggtttgggcctccaccttgacttggacgtcctcgatggtcctccatggctctaagtgcttctccaagtgtctccttgtcccctccattgttcctaatcacaatataatcattaggtagcaatctattctcgaattcatacaaagaagaacataggaacgagctcacctctaattcaattgtcgcgcacgagctcttgttatcggtccttgaatgaccattggaggattgttgtgtgtatccgaggtagtgatgtccgcatcacgccatcccccacctccgtgctttccggcgagttccagccgcgcgctaccaccgcatcgcgctgccaccaccactggcttcggcgccgcgagggcaaacccggccaccacttcccctccccaaaccaccgccaccaccaacccgagccaccgccgcctctagcgggctcccaccggtgagcatcgcctcgcctggccatgccgccgccacccacagtgccgccatgcccagccacaccctgtccaccgctcctcttccccaatccattgccgaaacgccaccgccacgttctccatctctctccgccaccattgccgcctccagctgcgccgcgtcgcctctctggtccacctcacgctgcgccatcgccttccccggcactgcagccatcgtgcgcagctcggcttccactccatctccctcctcaacccctgaagcactactcccaccgtgaacccgagccgccacttccatttgccacctccggctgccgctcgtcgctgctcccgatcatcccaagtcatgccacgaccaccattagctccaccaccgtgaggacaagctcggccactgtcacgcccagaatttctatccaaaattccaaacgcttacatgtgcgttaaaccctcgtccaggaatcagctgaggcacacaatgacaaattgataatagaatactatcaaacagctaattaatattcgcaaaataaattattacagaggtggatagttcctctcaaagaataaaattctatgcagcggaaaataaaaacaaagactaaatagctatggcgactccactccacaagcaactcgacctgaccaaagcctaatcctcctgaaaatcaccttcactgaagtactcctcctctgatgaataaatattgcaagaatgagcatatgacatactcaacatgctacacaacaaatatgcaagtgcacaggataacaaaggatagcataataaagctcatttgcataaacggcatttaataaacatttgagagaatagtaaaacagttgagtaatttaaacaatattaaataaacaccatacaacacacccgtgttgcataggcccaaccacatttgaacaaccaaccccgattgtacaaatcaacctccataccaggaatataccattccaaaccagcagtcaatttaattatcacagtattataattaataacgagtaatgtgagactaatcacgaaaaacattgttagacccacccttaaccgcgggcacagctattcgtatagttttactctggccatagatgtaccactgtacccacaagacacaactccacaacatgtcaccatgcgcctcagtaccaccacggtaccttggaaaggaactatgacaatacctctcacacaacacaactcaccacattgcaccgttcctggatcataatctccccctcaaaaccagaggcaatggactccccagcgacccccacgaacttcttgccacttcacagtctggcaccccgtaatgaatcatgctatacaaaagataaagccgttgcccacgctggcttgtggttggcacgttaaatgtttcacaacagtagctcatgaaccggtccttaattgtcatgagcacaaccatcaaaaccatgtgctcataacccacccttaatcaggttttaattatcaattaattatcataacacgattaaccatcgtgagctaccattaaatctaaccataactaataatgtaatatgattcatcccattaatgaactaatgtttctaagcatggctaagcaattatacctatatagcacacttagctgaaccaaaccaatatataaggtccaagctaaatcaatttattacccctaggaaaataaagtcatcttcggccattaattaattgggaaaggctcaccccccgatgacattaaaaaataatgcataagttgaaataaaacattagctttaaacgggttcaacatgctcaaagggttgtttgggatctgtgtgacttgccttgagcttcttcaaacacttccgaaccttcctcaatgaaaacgctctcctccggaacgtcggaaactaaagcaaatgaacaaaatcaacaaaacagtacaaaataaagcataaactgatgtgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtatttgatggaaagctctcggagtcctctttccaatgcatcaagcctcattgccaaattccatctcagtcggcagcaactgaagaaacaatgtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcattggcaagatcagcaacccacggagaggtgtatcgatcgctaaggcgcaacacaacgtctcgtacggctgtagtcagatcatcaacgtttcttccaaatcgtagttatcgcaactcaccgaaagatcgggccaataacagccttgagtgtcgagaggaactcagggttcatcaggtggtatcagagctttcgttgctcggtgagtttttatcttcctataaccagaaaatagccatacaaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacgattctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcgccgagtcccactcgcccctttggccgagtccgaccccctccctcaattccacggttccgagttgtgtcaaacaccttggcgaatttttgtttggtgtcggtttcgagatctgtttggaaaaacggaaccggcataaattcagcattccattttttgtataattttaattttgggtttagacttttatatttgagtccctgtaaaatttatatttatgtttgagtccctgtaatcttacattaaggtccttgagtcagtttttgttaaaaaaaatcaatcaagaaaaaagtgagaaaaaaaaaggcagaaaggtgcaaaaaaaaaaaagagaaaaaaaaagccgcaccaaaaaaaaaacagaaaagaaaagaaaaaaaagaaagaagaaagaagaaagaaagaaaagataaaatactgttatgtttgagctaaactttatatatcagagttgtgcatgagttgctcctagtgctatcttgtggtatcgtttgtgtctaggctcgcgtctctagtacgtctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggctaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggaagtgcgtaatcacgaaaaggaggagagagacatgaaagagccaccaattccattgttcacactcaagttcgagacacctccatcatctaaagaggacatccaaggtaaagtaaatggtactgaaattaatcaaggtgagtgcattgttaacgaagtaaatttgtccacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcatattgttaatgaagttgaggaacgtaaattgctatcttctttaaatactttgggctatgttcagtttgatgattttggtgagctcgataatttgaaggagaaattatttgctaagtctgatttgccatgtctaactaatgctatttttcatatctttggcaaatataatgatagaggaatatatttggtgcatagagttttcatttgtttggatttagagaaacatgttattgctaatcacactatttcgagtttctctagttttgattggatgaaataggttattttgaatggactatatgaagaacaccatatggaaaaaccgaggacggttttccgtgaagaaggggataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccaatgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcacattgtttcttcagttgctgccgactgagatggaatttggcaatgaggcttgatgcattggaaagaggactccgagagctttccatcaaatactcatgggctgaaaacggaggtcgtatggagcttcggtggccgtttgaagtcagcagtatagcaggtggccgaattggattttggcacttggaggactcgaacttgatatcttgttgttcatccatgatgtgagcaacggatgtatccgtagtagccatggtcacatcataaacagtacatgtggatatttttaacatgtagatctcgattttagatgaatttagcaacttgcaccacttgaatccgagttacgatgatttagttatgaatttctgaagtttaatcgattttcaactaatacagaaaaactaataaaaaggatttatgacgtcatcgatgacatcatcgccagcataggctcggctccacatgaccaccagcgatagagagctcggttgggctatccgaggacacctacgcgaagaggacgacgacgcgaactcaccggtgcaagaaactacggcggacgacgacgaacgacgaacgacgaccggcgacgagctccgacgacggcacggctcggctcgacggcggcggcggcgctccggcggcttgcgatagcggcgaaggggctgccgaggtgctcctcctccgcaagagcccaacggcggcgaagtaaagcggcggcgacggctacaatggcggcgcggcgcggctggagaggcgccggcaatggcggcggctagggctacgcggcggcggcgctatgggcaatgatagagctcgggacttgaggggaaacatagaggacgactaggggatgctttatataggcttggattagagagatcggactccaaacgagaggaatcgaagccagaaaaatctagggttagtttggagagagaaactcaaaacaaattcgattcggtttatccgggcaaaattgatctccgaaactttaggggaaagggagaggataaggaggagatgatttcccctcaagcaatcgaactcggggacgatcggttagggcggaatcgaaggggaggcggcggcgctcgggctcggctcggccggccggaggtaggagaagaccccgacatgtgggccccacatgtcggcggcttgagaggaggggggccggctcggcttgggctggcgtgggccgcaccgccatgcgcgaggaaaagaggaattgggccggaaatggcccaatgacctaggggagggttttaaagactttttcaattaaaataattcatgaaatgatgtttcatttattaaaaaatactttccttgctcaaataattcctagaaaaatctagaaaatagataaacaagcaaagtatttaataaaattttatctagctcaattttatgttgaaacttttcctagattattagagtttaacttgtaggcttttaaaataacttctaaaaatgatttaaagaatgaattattaaattaggcgattttcagggcgtgacagccaccgctccactggctccaatcaccgccgtagccttcttctccctgttgaggtgagcttcgccttaattcaccagcctctagccgcttttccccgtctcgtcgtgcatttttcctttctcctaaccctaccaccgcatttcccaggttcttctggccgtcgtccgcctattcctgctcgcggaacaccgccggaccgccgttacgagtcaccccgaggagcccgccgccgcctctccttgccgccggccgcctccttccgtcgtttggccgctcggtgagctcccctccttcctctctgcccactcggtttcctctcgctacctctcgcgccgttgccactcgccaccggcatcgtcaccggtggtctcgggcctggcagatgccgccgctcactgccgctcgttgctggagcgcttgtgccgtccggctgcctcggccgtccgatcggccctcggccgatcagggccgtccttgtgtccgcccacgtggtcgccacgtcggtgacgcgtcggcgccacgtgtgcgccacgtgggccactcacccgagccgcacatgggcccggtccatcgtgcgcctgagccccttgagtcaccggcgggtggggtccacttgtcggcgccacctcttcccccctcggctgatgtcataattcgttattaattgtgtaataaatcgatattaattctagaaattcattcaaatggctcaaaacttctaaaattcatatctaattcatacgaattccgaattgagccattcaacttgcaaaattcatttaaaattgagacctacatgtttgtttactttttatgtactgtttccttggtgtttattagattttttcctcgttttgcgtgtcagcatgtagtttccgtcgttttggaagatcgcgctcacaagaaaaagagttcggaagatcgtttgaagaagcaaggtaagtcacacattccccttgagcatattgatcccaatttataaatgttttaccatttgcaaataaatatgcatgttttgttaattacatgggattagggtttacctatctgctcgcttgtgccatagtatttgatatccatcatttgtctacattgggtgataattcgactagcttgtgttacttatgttaacctagctagatcatatatgcttagccatgcttaattaccactagctcataaaatgggataattaaatcattagacatttagtatcttgacgagctgcgttctcgagacatctggccatgtttcatggtcgtaattatccaactaaaatgcgactgaatggtgtgctatgggtgcatggttttgcaggtcgcacccatggcaattaaggactggttcacgggaaaccctagaagacttacagtgcttaccacaagctggagtgggtaactgcttgatttgaagtatagcttgaccctttcctaggcaccggtggcgagggtgggcgtgatggagttgggtcggccggggtgtccggttgtctagctgtcggattaaccgcggcgcacgagggactgcccaccttcgaggtaggggtgggggtgaaaccttagagtggtgtggatggttaggggagggttatatgaagggtcttgtcacaatcactcgacatggtgacgtgtctgcacaggcacggtaacatgccggtggattgtgtcttgtgggtacagttgtgcacctctggctagagtaaaactattcgaatagccgtgcccgcggttatgggcgatcgaccagattcaccgtgattactcccatccttaataattggttaatgaactggtgtacttcaggtggtttggttgggcctgttcaacgtggtgtaccgttatttagtggagatataatattactttaattactcaactgttttaccattttgctcaataaatgttttacaactgcctttatggaaatagccacaaacctccctttttctccccttgcacagtggtttggttggtgtggcttgctgagtacggtggttgtactcagccttgctattgttcccccttttcagaagtgtagtgcttctgagctgaagacgaagttagaagaccaaggctcagaccccagttgagctttgcatgtggaatagagatgaagccccgttaggatcgccttttccactactgtcgttctcttttggtgtgaggactaagtgcctttgctgtaagtattttacgctttatttacgtttggatctgtttattacttgtcattttgtgtacactggctggtcctggacagggatttaatacacaaaatagtctagaaatcagggctaaatttctgggcgtgacaaagtggtatcagaaccaactcaactgtaggttgagccaaatggtcaaaccctaaggacaagttttctgaaaaccttatttgcaaaatgtctcccctccccctttggcaattctttgcgaagcggtttattaaagttcttgtccatgtccctccaattcttttagttgtaaaacctggacgacaaaaccatcagcctcatgcctgttcggaagtcaagtcaagtctcaagcttcgtgcagggagcaaaagatcagttcagagtcgtcgttccgcgaagatcaagcgaagttttcccgaagtttaccttaacccaatctttcccggaagaatagtttcgttagctgatagatcgtgtgttgtttgcttgtgcgtaggggtatggtttgcatcattggtggggatgcgaccatactaggttgtttgcttaagcaacttgaacaataaaagtgtactcacaacagatcagaagtggtttaaggtcttatctttagcaacccctctcttccatctatcttccatcctggtagcagatggtcagtgtcagggagaagagcaacaatgacagtgtgttaaagccacagatcaatggttcagttgaaagctacaaggtaccccaatgccagaagaacccctgctcatgatcaacttttggtgtccaagattagaagatgggtgtattgatgtaggagatgcaaagctcgatgcaaggtcaaatgtagcggaagtaattccagcagcaagtttgttgaggtcagagccactagatcagtccaagacaacaagctaccagttgagtcagagtccctcgctctggatcggaatctggttagccaagatcagatggtggatgtgtcagttgttgatgcagcagcagcagagttcgatgcaacagttacaatggtagtgtcaccaacaacaaatccaagctcagatgcaagcccggaaccagaacctgagtcaaagctagtatatccaagttagcaagcatttgcaacttcaaccaatgtatcgccaagtccctagcagacaagcacacctatgcatgctatggttatagtttaaaagggtagttcttgcaaggtgttcaaccattcatggaagacgtacgacatgtcacttctcagaaggtcaaggcgtcagcgtcatcacatcaacagcttcatttgcaacaccctagctcctcaagttgtgccagttccaatgcagagtcagtcagatcagttttgagaaataaactatgcaactcgacaccgaagtcaggccagaagcagaatagtcatgttagccattacagctgatgcagaagttaattagtagccaataagttcacgagctgaataagggtcacttttatgtggattttccaatcgacaactgagtgttaagtcccaagcatggtcagattggaagtgcaccaccttctgtcatttgaattacccggtgaagtatctagttttcaaagccaaggtcctttgtaaatctaagaagtgttggttatttttcaaggacaacagttcaattgttcccggtaaggcgaaagtatgactactcactgcaagtggggtaggtcttagagatgagttttggctcacctcgtcgccgtttcacttaaaggttcaacccagtgtagcaaattggttagtaattaaaggagtcagttgcgagccattagcagagttaccacaatctcaagtcgacaggttcaattctaaggtacacccgtgaggcaggtcaacagttcggtttagagaagcaacattagggacagtcgcaatctaggcaggagataggtcaagcaggtttcctggaattacttgtgattcgagtcaagaccagttcaagcggacatagggtcaatgagtaacaaacgccagatgcaagcttcatcctcttctagccagcaaggtgaattgtcaggttaccaaaattgtcaatatcaacaattcggtccaaggtaagtaagctccatgagcatccgcagtcctggtctgggtcagttcaagcagaaccagtcagttcatttgtttgtagtgatgaggacacaactagctcggatataaccatgaccaccttatgtattgatcaaccaaaggtgcatatgttctatattcgatttacttgttatatatttgaacaaacgttgctacacattgagtttcgtgtgttttcgttcgcagaggtacttgcttgggtgaaagaaaagagaccgagtgtaaggaatgcatggatgattgaagaggttgattggggactaaaccaagaccttctccagttatacttctacctcaccacatcacttttggcccatagaagacaagagattaagttgtacacgttttggattcggattcggacctcctgacagcatcaacttcaaacggatttagccgctgatatataaggaatttcggggcccatgagtacttgttggaaagcttattgagtctactttcagatatttttggtcccatgtcaaaattccaaccgagctgccgggaatctgcaaaacaagccatgtacctcatccagtccgaatctgatttggg

SEQ ID NO: 40365 - DNA, 889 bp, Oryza sativa
caccggagcgtcgggagagccggaatctaagcgacatacaaagcaaacaatacaaacaggctataagactactgaaacagagaacaaaaccatttttaatggattctttgcatttttcttgatttattgagacttgaatgggcttaaacggagctcggatgaattttctatgaattttagaagattcactgtgtttttactaaaaacatgcgggccccacatggcactggctcgaggtggtggtccgcggtggaccgggtccacggaccggggaggcggcggcgcaccacgtggcgctgacgtggcgccgacacggcggccactcgtcagccacgcgggcggcgagacggacggccccgatctaccgcccggtagatcggacggcggaggcggctcgcggacgggcgggcccgggcagctcaaaccggcccggcggccatggcacgcggcggcgcagcgcgacgcggcggcggcgcaaggcggcgagcgggcgccggcggagagcggcgacgacgcgacgacgacgcgggtggcgctggcggctgaccggctaggcagcgatgcaacggctaagcggcgcgggggagagagagagaaaagggaggggttcctcaccgacgacgatcgacgacgatgagcgacggaaagaagatggcgacgagcggctgagcttcgggatctcctaaggaaccaaaagagggggattagagagagagagagagagagaccatggatggttacgacaccggccgaaggcggcagccatggcgaagctcaccggcgtgcggtgcgaagcgggtgccggcgagggaatgcgacagcgaagggctggacggagcggcctgcacgacggtgaatgcgacggcgtcgacggcacggcggctagcgg

SEQ ID NO: 40366 - DNA, 1105 bp, Oryza sativa
ccgtctccgagctcgccaccaaccaccccaaatgccaggacgccttcctccagagcaacgtcatccgcctcctcgtctcccacctcgccttcgagaccgtccaggagcactccaagtacgccgtcgcctccaagatgtccatacacaccgtcctcatggacaagaagaacaacggctccacctcctcctcgcaccaccacgacgcgctagacgccgtcgaccacgccgccgccaccaccaccaccaccaccgccatggcggccaagcccaccggaggcggcgccgccagctcgagcggcgcaggcgcaggatcagcaggaaccgggacgacctcgagcagcagcgtcagcgtcggcggcaccgtcgccgggacgaagcagcacaacgcgtcgctgtccgggacgagcaccaaggcgcgggagttcgaggacccggagacgaaagcctacctcaaggccaacgccgccaaggcgctgtggcagctcgccatgggcaacgcggccgtgtgcaagaacatcaccgagtccagggcgctgctctgcctctccgtcctcctcgagaaaggcgtcgacgacgtgcggtacaactcggccatggcgctcatggagatctgcctggtcgccgagcagaacgccgacctccggcgatcggcattcaagccgacatcccccgccgcccgcgccgtcgtcgaccagctcctccgcgtcgtccacaaggccgactacgacgagctcctcatcccatgcatcatttcgctcggctgcctttccagaaccttccgggcgaccgagacccggatcatcgggccattggtgaacctcctcgacgagagggaagccgacgtcagccgggaggcggccgccgcgctcaccaagttcgcctgcacggagaactacctccatgtcgaccactccaaggcgatcatccaccatggcggcgccaagcacctcgtccagctcgtctacttcgccgagcaagccgtccagatcgccgcgctcctcctcgtgtgctacattgcgcacaacgtccccgacaacgaggagctcgcgcaagcggagatcctcaccttgctcgagtgggcatcaaagcaagcggccatggtgca

SEQ ID NO: 40367 - DNA, 11552 bp, Oryza sativa
ttgtggtcagttaatcatgatgctaatactactttaggaatgacagatatgtataggttgcccttttgtgctgatggtagaatagcaatgtgtctaggttcctgaatcgaatttgaatgtagttgaatggacctaatactacgtgattttttttcccatgacttttgacacctttattaattagcttcttctaatcaaactttttatctgttctgaaagggccatatagatgcttttcttcctagatgcatgcattaaaggaggtttatattctgttggccgaaatgcagataaggtcacgggtccgacctgtttcaacatattatatctccatctaatacacacaatttctctgaattttagggatttgaattatttcgtgtaaattacatacaaaaatctggtaaaattcatgtcttttatataggatgtaatcattgtccttcatataggacgtaatcatgtgaacatttcaaaggttggtgaatggtagcaaactaaaccaaatggttattatttatgaatgccttaccattcacgacataggtgctgtaataaaattctcggaaaatcgaagcagaagatcattacaaattataatccagcaaaagtgacattaggacgaaccggaacctaccgatcggccgaaaatggcaggtgcaacaccactgtaatactccactgaataacaaaagtagattaatcaaaattaactagtactccctcgtcccaaaatgtttgacgttgttgacttttttaaaagtatttgaccgtttgtcttattcaaaaaatttaagtaattattaatttttttcttattatttgatttattgttaaatatacttttattatacatatagttttacatattttataaatttttttaaataagacgaatgattaaacatgtttaaaaaagtcaacgacatcgaacatttagtgaaggagggagtaattaattactagtagacaccaactagtggtactccaccttacaacttgggacaaaacaaggcatggccctcttggtctggaaggtgcttgtcgccttgtcatgtcggcaattaatagcaactgcataaacaaatccgccttccggatcgatccatctatgatgatcatctaccagctacctgctcgatgatcttgacagtgtttctgttcttccatctcgtgcttattatactaatatcctgatgaagaattaattaatcatgatacgaatcagttactaataatcagtctgatgtctgtgttaccctgaaaaatttcagaaacagagaatctgagctcatccctgcgtgctgccctgcaaagctgcaatgcacagcagctaattccgcaatctaatgctttttttctgttcatgtgagaaatgaaaggagtccttaattatgatgcatgaatcagttattgagcctgatgtctgttaccctgaaaaattcaattcagaaacagaatctgatctcatccatggagaagggtgcaatgcaaagcggcgcctggagcaagttgaggcagtgcaaggcctctgcttttttggcggcaacagcaacagcaacagcaccatctgaccctgcaacttgagatggaatagtaaaagagtactctctccgtaaaaagaaaaacaatctaaacacgaatatgtcattatatagtataacgaatctagacatatccagattcgttatacaatgtaatattatatccgtgtctaggttgattcttttttaggacagagaaagtatggagggagtattcagagataggcaggggctcacactgttgctgaaaaaaattaacgacggcgacggcagaaaggcagcagcaactttaccgaactagccggaggcactcactttgctcagtctctcatctcatgacctgtctttgtagcggttgatttcctcctcgcgcttttatcagtacactagttgttattggcgccaacccgtttgggacggacacattcatcgggtcctgaagaaaaaggtgaaaccctttcttgatttccttgagttttcggtagtacagtagactgttacaaggcgaccaagtacagtagattagactctttttgctcctaattcagagcaaatctgcatcttcagtacagttctccggtgtctgcactctgaagcagagaattgtcttgaagctgctctgttcatttcagactttagacttggagggatgcaaggaatgtttctgatttacttctttatttctttattgagttactgcatctagtcttgttcgtgaaattagtaacaagaattttcttctcggcaaggcatgacaaataccatagattttcagaccgagaacaaatttacatccaacaacctaaataaccatatcatcaactgaactaagtatgagtggaacagtatttacacaaaatggaggaagtgatcaacaagatcactgatcatctccccaaaggaagtattcctctatctgatcctaattaagaaggactaacactaagcagtaaccaaagctagctaagaaatcaagaacccaaaagagaagagaaagtgtaacgatcatggattggtttgcaggatcatttcatttcatggggaggcttctgaagtcgagcatgccagccctgaggccgaggaagttgttgccggcgccggcgccggcgccgccgccgctgcacttgcactccttctggaggccgaggctgcagccgaagcagaggccgccgcggcggcgctgcagctccggcgccctcacgatcatcgccggcttcgcctcatagtcatcgtcttcttcctggcacgacggcgggctgatgcagaggtccaggttgaggtcggggcacttgggcggcttgctgagtatgagctgctcctccttcgtcgttggcggcggctggggatggaaggagatggtggcggcggcggcgttgacggggcggtgcgtgacggggtcgatccccctgccgagaagcttccggcggatgtgcgtgttccagtagttcttgatctcgttgtccgtcctccccggcagcctcgccgcgatcagagaccacctgacagatgatgaaaatcgatggatggaagagaggcgaggtgaggcagaaggcaagaaaagagaagcgtagttacttgttgccgaggaggctgtggagcttgatgatgaggtcgtcctcgtcggcggtgaagttgccgcgcttgaggtcggggcggaggtagttgatccagcggaggcggcagctcttgccgcagcggaggaggccggcggccttggggagcgagcgccagcagccctcgccgtgggcgcggatgtaggcgacgaggcgctcgtcctcctccttggtccacgcgcccttgttagtgtgctccttctcgcagcacggcgacctccccatcgctgttggtctcggccggcggcgagtcgtcgtcgtcgtgggtggcgcacggcgggtggatgaggaggggattatataggcggggagggaagggaaaggcgccaacttagtttttggttaggttgggttggttggtgttggtctcgcgttggcgttggcgcgcgcgggagaggcggtgggtgccgccacgtcggcgcgcccgtgggatgggaagagaggtggattaggtaggtgcaaagcggaagcgggggcggcggcggcgcgtgcggtggccacacatgtggcggcggcggggcgagcgacctacccgccgccgccgtcgcgctcgctcgccgctgtaataaaatcctgcgcgcctcgcctgacacctagcttagctatgggctactatactactcgtaactgattgtaagagcaagtttaataatatagctaactagtagcttcaaatcttctataactaatgtaataaccaattcatataatagtacttgctatattattaatagctgatcccacctatcatacacatattacgttttggagtttgtgttacagctggctatagatctatagtccactgcttttctctatcttcttttatttctctaaaatatatttatagtgggttacagtctactactgtacatgctctaactagctgctgctgcttaggccctgtttagttaaaaaaaatcacgcggtcacctcgaatgtttagacacacatatggagtattaaatataaaaaaacaattatatagtttgtgtgtaaattacgagatgaatcttttaagcctaattatgccatgatttgacaatatggtgctacagtaaatatttgctaatgacggattatttagacttaataaattcgtctcgtagtttcttggtagaatctgtaatttgttttgttattagattacgtttaatactttaaatatgtctctgtatccaatgtgataatcaaacttaaaaaaatttcctcaactaaaccaggccttagccacgaagagttcgtggaatagtcacaattgcatccggtgattgcaatttcggttctaaatttgggaagacctcaccggcaaatcaatgcatcgaccaaaattttcggattctctcaatttctttttgttgaagttggtcaaagtttatttaactccggtcaaaatctgtcaaaatttcaaaaaaatggtacgagaactgccgacaatcaccgaaatttccatcgaaatcgaaagtgtaaacgttgattgtatctgttttagcagacacgtgttaaattgaatatatgagctttatttgattattggtggaataaagttatatttatggtataggtaaaagtggcgtcaactgtctaacctagtctattgttttaaatacagagagatatcacgttgtaaccatgataatatttactttcctattaagtttataactttatgatctctttccgaacacaacactttcgatttatttggttttcacgctcccttttttatttttatttttttctatggctacttccatttttttcaatagaaccgataagaaactactccctctgtcctataatataagggattttaacattttactctgtttgaccatttatcttattttaaaattttgtgtaaatataaaaaataaaaagttgtgtttaaaatactttggataataaagtaagtcaaaaataataataataatttcaaaaaaaattaaataaaatgaatggtcaaacagtacaatcaaaaaatcgaaataccttaccttacattttggacaaatggagtaactaactattcatagttggtcgaccgtcgtcaataacagcgatatctctgctaaaattgtaagtcgatgtagggtaaaatgacttacatcctgtagtagaggtagttgtatttagtagtatgttaatattagggaaggagcatatacaattagtgttccgaggattgggatcacctacagtatgaacagcgacggcaagttaactactgcatgcaattacatccattcattttggtgatgaatggaccaaatcatcagctacagtgtcaacgcaaaatactgaatattttttgctagtgatctacagtatccgggtgcatgtggaccgttagattcggatctaacaggtggtaatggactgcataagttgcagtcacagtaccaactgcacctgatccaaatccgtgttatgaggattaggatgtgttaaaattctcctgttattaaatattatattttaagtgtcgcgtcaaataatctcgcatggatatctcgtggatcaattctgctcgatgggaagatcatttcgcacaacggggcgatttttatgacaaattcatgtttttcttgcatggaattatgtttgaaattgggatacatgttctcgtgattaaaaaaaatcaaaatcaaacctgctttagttaacccatgttcccgaaggggagagatttgaacacgccgacctataaccatagacttagttgctcgttattgattaaactaaacgatggaaaatgacaggttttaaaatagatttgtactcgtgtatttagcatgcggctaattaatcctcgctggggatctccatttcgtggatagttcgattgatctgtcaaaggcgtaataaacgttgctaaattaatttcagttttggaagtgtgcctgatacattcctcacatagattggtagttcatgttttggtcagcatactggactaaagaaaaaatctcaccgaactcagtcctttttgaattgatttcaccaaacccatgaaatgatgaaattccacacgtgtactctgcgaagtaggatcacaaaaccttgtgcacgccaaattatgatgatccgattcttggtaaatagtcatcaggacatcaacacgactgggaaaaacacacctgttacctactccctcccagtaccatagtgtcaattgttgtactcaatccctgctcttctcaaagaacctcatggttatgatgttttccacctgtattaaaaaacaatctgaactattgatctcatttattaaagagttatgattaaagagttaagatttatttatatttttagtaaaaaaaagtgcggaaaggatataatatttatttagcagtgaatatttgtttttctttttttagcttttaatgtaatatgagcgatgccagcgcaatagatgatcatagatagatttagcaaaaaaaacataaaggataaagtaactctaccattgtattagaaaattacaaatttacccataataatattggtagtataatactaccaatagacaacatcatttcatttctagcagtaaacggctgtgattacatcagcttggcaacaactatagccgttttagcaccggtatgcttgtccaagcacactttagtaacatttgagatagattattcaccgaattattgttatgggttataattaaagcaaaggttctaactcctgttgcactccattcctttctccgagatccattgacacttaattaggtttcgactactgtggaaaagaatctagaagctaaagccctgtcaaagtttgatatgaacaaccatttaagtaggggacaatttcgtttttcccccactttcatctctaatattggttttacccctactttttagggttttcgtttttaccctcacttctttgaactgaaagaggcgtttacccctggattggatggaatttagtgggaccggatttatggaaggaaatatttgaattagtgatttacctttttacccctgtgaaatgttaacaatacagagactcttccttctctcgccgagaccgtaaagacccaggcagcgcaggcggcggcgagtgggcagcggcggcggcgatagaggaaactgggcgtcggccaggggccgctcctcccggcgcgtgtaggagagcggccggggagagggcgccgcggaggcctagcggcgcgcgctaggcagcggcggcggcggctaggggccgctcctccctgcggccggggagagggcggcggccaagcggcgcgctaagtggcggtggggtggaggggctaggcagcgacgttgaggtgctaggcggcggtgggaagaggggtaggcggcggggtggagggggctagtcgagcacggcgtcggcgcgacgcggcgtgccccgtcgagatccccccggtggacgaggtcggcgcacgcgaggacaagcccccccggcttgccgcccaccgcgcgcggcgacaatggcgactgctcggaggccaaggccgcgaccaagtgacggtgagcgttggcggcatccggatgtggcggcgtcggccgggcggcgaccaggcgacggcaggcgtcggctaggcggcggcggcatccggacttggcggcgtcggccgggcggcgaccaggcgacggcgggcgtcgggtaggtggcgacctgcaaggggcttggagatggtgccgagatgttgttgaaattttatcaaaaatttgttcaatttgtcaaaatgctgctgaaattttgtagaaattccatcaaattcagaatctgtgcaaattgttatgttaatgtgggtttatcaaaaatttgttcaatttgtcaaaatgctgctgaaattttgtagaaattccatcaaattcagaatctgtgcaaattgttatgttaacgtgggtcatttaaatatccttttgccaagaatttaaatttccaaagccatgcataaaatgggggcaaaaacacaactaatgaatagagatatgaaagggtataaatatcattttgacaagaatttaacaccgttaacttctccatccaaaacaggggcaaaaaaaaatttgttcggttcaaaaaagtgagggcaaaaacgaaaactctagaaagtaggggtagaatcaatattggatactaaagtgggggtataaacgaaattgccccaagtatatagctgtagctgggtaggaggaactaacaaatccatggcgacacatctgtactgtatgggctaataatctcttttgattaatacttgtgtgctaccgatcgattcgatgggcctctcttattggtgggtgagtacaatggcgatggaccattttgattgctcctgtagtagagtgtaccttcgagaaataaaaaaggcgtacacgtggccggtttataggacggccacgtcacatgtttatctacaccgctgtcctacattctcagtgactcattgtatgcagaaagctccagagcaattactgtgcacgactgtagggtcacctttttaagtacgtgtgtgatgtgtaatgatcaaataccaaacattagtatttaatttttctgattctcccatgcagattagtcttgggtgatcatgtgttaggttaggtagcagtgtacgattgttccagcctcacaggacttgaaaaatcaagtctgctactgctgtagtgctgttgcattccaattgatgaccttgaattctggcttaagaatcttaataccttcgagaactaggacccattgtacatggcttgtctaaagaatcgaaactgaagttgatgagccacatgatattaacaaacagtagacaagaacacatgatattttcttccacatgatgtgctaccatgtcaatctctactctttccttccaatttaattatgtcttcacaaaacagtggctagttccaaatcagttggtgggcgcaaatcctaatcaattggtcaataaattataacaattttgcctgaattcatcgcttgcctgtgacacttcttgcaaaagttgcgattgcttagaagtacaagaatcagtattgaataggtatagccgtcagttagccacggtcgtgtgttgggtcaggttggttcatcagcatgctcgtgaatactataatgaaaaacacacggtatgacattatctttgcacgtgttgttgtaagttgtaacaactactaccaactcctcatgagttgattacaattacaagcatccctctaaaaacgttatcatgtacgaattgttatcagttgccatcatatgactggaactttacgagtaaaaaaaaaaggaccttcagagccacgcttacgtaaaacataactggttggtctccggtataaaatatcccttcaggcaagttaattacttattccacctttggcgtctatcagttcttgaactgctagctagtgagttgaccaaacattcgaaggacacaaaccactgttcttgtagatattagagagcacacagaagacggaataatatatgtccaaagtgcttttaaatagtgaagctatgtcatctccatataattccccatgaaatattgatagggtatatgtagacatgaaggaagtgttcgtatggctggatcatcactagaattctgttatttgaccctgatacttactatgaggccatgctgatgaagaacatagcaatcttacttgctcttcttagaagcctcgtataggtagctcacgataactacagctgcagcaacagctaccccgacagcactctgtgcgagtacagcaccagttgaaagatcagatttcgtagatgcagggccgctgctccgtggagtgaagccaagttcagaaagcttcttgtgcgattcagcgtagtccttgaagaaggtgtcttcatcctgccatatgaacagaagaaatggttctgaatgtaaaacttatattatggagcaccgcaaggcatagtacgtcggcatgaaatattcacagttcttgtagcattttgaaaattattcacttccaattatatagcagtaaaagttgtaaaaatataatgctccgaaatcatatttgacaataaataaatctattaattgcattttcaactaacaaattcaaatactttatagtttgttaatggtcctatagtcctaaaaaatggatgaaagggcatataaaatgggggagttttaagtgcaaggaatagaaaaaaaatatatatataaaagatcctttttaccctggcataaagatccacatagcgtctaaatgaaggatcttccaacaatgccttgtcagttgggagcttcagaagcccctcagattcccccttcagtagctcactgcagttaaataaaatattacactgttatcttctaacctcaaatctagtgcccagaattagtacgtaaatgacccagttttgtattcaacttacagaaagtacgaattgtcaaacttcagaggctcctgagtccatgcgccttcaaatccagacctttcaggatgtgcccttcccttgaagtataaagcgagttgttaaaactgtgcttctcatgaagaatcaggattaccattacacaaattctacattaattagagcatttaccagagtgtgacccccagataaagctactatatctttgtctgataagcccatccggtaaaagatgtccctcaagtgcagtgcacctgctcatgaaacaaagataaaatgcagatatacccccataaaaatagatatatgattacgattatacatatcaaaacaggattctggcaccagttattaaaatactaaaataggaactggcaccttgcatcccagtaaatgtaagaaaggaaaacagacttcggcagaaggaataggaaaacagataaataacataaaacaaattaccagacatacaacagcacctgctggtatgacacctaaatgacaactataccagatatgcaggaatataagataaatgaaagacgaggctcccatctatgaagagatgtatgtgtgtttaagataatgtacatattacggtatgtattgcatgaactgggttgtctcaagcaacactaagtactaaatgccagaacatgagtactagcagacaagtacaggagaaatgcatgggactaaatgtgatacatgtagaatactaacacatattttgactcattgcttcaaacactaggagtcaggaagcatgattataatgacaaaagaaaaggtagaccagttcaaagaatagtttgtggcaattacctttcttagcatcaggaagacgcccttcacgggggcaaactgacgaatcctgattcaggtcaaaagaacttaataagtgtgaatcaataaaagatgcatccattcataaagaaatgttatttcacgtacacgtcttccaggaatgaactcaacagttgga

SEQ ID NO: 40368 - DNA, 14924 bp, Oryza sativa
atagctgatgagtggtttaaagggaactagagccattctgacaatgggggaaaagtgaaagctactttcgtctaatcatctaggaacacattggggacaaacaatacataccgagaagatcaatagcaatctttagaccagcatttgaaccgtgagtgtactcttcctcgtatctaattgaaccatttgcaccaccagtttttgtgttcacgtcataagtgcccgcgtcatgccatctgcaagggagtgcacaggaactaagttttagtccaagagtaatccaagagcacgcagaatatcctccatgataaatgagaaaaactcatagtacattacagaagaacactgtatacaacatataagataaaaaaaatcacaattccatatataaagtactaattaattagcaaatacacgctgcactatctgtaatggtgcgttaaatggtaatgcttcttctgagtccattcgtaattacaatatacatagaacatttgcagcagtagtgcaaacatcccctttttttagataatgaaacatcacttatttgttccagtttgtaacactggtctctcatcagctccacaaatgtaacacgaagctcatggagtggaacacctactatagacagaaataagaaattcgtcttagcttcctgcgatattgccgttatgacggaatatggggagtgattaaaaatgctcgctctcccctgctaggttgctagtttcctgactagtatgagagaaccaacggatcaacagaaaaacgcgtgcactctacatgtgaactagcgaactaaacatcgtccgccgttcctcgttaattccaaaggcgcagtcacacaatcaaaaccaaatctgggagccatccaaagcaggcgcgcacgcactcaaggtgttcgtcgaattgcctcgcccaacagccacgccacggaccagcgcaggtacccgccgcaagcaactaaccaaacccaatcatacagtctcgcaatcgcaagcgacccatctcaccaccaccagcagtaactcatcccaccactcgaggcaagcagagccgagcgggctccaaatccaaacacacgagagctccctccctcgccaccgccgcgcgaatccatcacaaggattaggaactaggggagggttctaggaggagcaggagatggggggtaggccggtaggtacgtacgcgaggcggagcatgatgggcgcgcatcccttggaggagatgagggcgcggaggtggcggcgcgccctgtcgacctggcggaggtactcggcgtccacgaccggggcggccatggcgtggcgtcgcgtcgccggcgaggttggaagccctagagagatcggccgcggcggcggagcggagcggaggcgtgcggcgtcaagccaagcgtgtggtgtgactagtactcactggctactgtgcgtgtgggggagaagagataacgcggggaggcagcgattggttgctccgccccctcgagtcgtcgtctgctgttactgtagttttacacctactgccatgactgtattaaggcgtgtgggccctcattgtcaatttttttttccttcaccttctttatttacttttttgacacgtccccttttattttctctcaaatattattttctctttttgtttgtttgaaataaaaaaatattgttttgttttgttttgttttatgtcttacaccttttcttcttcactttttttagaattacacagtacaacatagacactcacaacacacacactcactcctataaacacacgctgacacgcacgcaaactctacccctatgatcatctttgaagattgggccagcaaattcatcatggagattaatgaagtcactacaggtgtctcgctgtcaacgggtacgtcaaacccaggacctaagatgccactgaggctctggtaaacattaggctacatatcctttcgcttttcttcttcacttttaacaccgaggtatatactctgaataagaggatctctttaaactgatttgatttttgttcgcagatcatttacttgaattgtatcgtcgattcatggttggatttaaatattccatgcaatacttattttggactcaagtgtgcaaaaccaaaaaaaaaatcttatcaatggcaatccaaattactactccctccgtattttaatatatgacgtcgttgactttttaaccaacgtttaaccattcgtcttattcaaattttttatgcaaatacaaaaatacttatgtcatgcttaaagaacatttgatgataaatcaaatcacaaataaaataaataataattacataaattttttgaataagacgaaagatcaaacgtttgttaaaaagttaacggtgtcatacattaaaatacggagggagtacagattactggaccgctgcaatccagcaactgccttacctgttcatcttccaaactgatttggtttgtgctcacaaaccattcatacagattcatagttaaatctaacttgatcatatttgaacgagcactaatttgctgcagttgcatggcatccctgtcagttccttccaaaattaggctcctctcgatcttgcaccaccgcgcgccaaatccgcgtgcgaccgcgcgccgttttgacagcggccatggccgtacggacggatgcccttcgttcccgcgcggccactccttccaccaccacctccttctttaggagtagcagcagcgccaccaccaagcctttggtttctttcacgcgcgctcgccaccgccctccttgctcgtccttccttccttgcatgacatgtccgcggccgcggtgctcgccgtcgtcgccgccgccgtcgcagcgctcgccgcggcggcgtcgggctacgagctgaccaagaacgggaccgtcatcacctacgaccgccggtcgctgatcatcgacggccaccgggagatcttcttctccggctccatccactacccgcggagcccgccggacacgtggcccgacctcatcagcaaggccaaggagggcggcctcaacgtcatcgagagctacgtcttctggaacggccatgagcccgagcagggcgtcgtcagtacctcatcccctcctcacacattgctcaatttgcatttgatttcatccatctaattaaatcgtgtctaaatgaatggctgtttaatttgtttctaagtacaattttgaagggaggtatgatttgatcaagttcttcaagctgatccaggagaaggagatgtacgccattgtcaggatcgggcccttcgtgcaggctgaatggaaccatgggtttgtttgtgtggcttcaccatctcattcagacatgcatgcgtgttcatctctgcattttgcaactcctgtttatatttttgcctcttcttcttcttgttgttgtttttcttcagaggtctgccatattggctccgggagatccctgacattatcttccggacgaacaatgagcctttcaaggtgacaaatctgacaacatcatgatccaattttcttacgcagtatgactgagacaactaattgctccagtttctgaaaacttgtttggtgattgtccgaaatactggccaggtgtatttgaaatgcaggaatgttctaatatgatgattatctccttttttttgaacttcatgtatgcagaagtacatgaagcagtttgtcactctcatagtgaacaagctcaaggaagcaaagctcttcgcatcacaaggaggccccatcattctggcacaggttcatctttcaaattgatccctttcttcctgtttcttagaatctggcaatgtgctaaggaataatgacattctgaatgctgatggtgattcttggttacatgatcataacagattgagaatgagtaccagcacctggaggtggcattcaaagaggctggcaccaagtacatcaactgggcagctaagatggccatcgcaaccaacactggtgtcccgtggatcatgtgcaagcagactaaagctcctggtgaagtggtaacttcattaagatcatacatacattttatagcaagtgcaagtattctcgatggaataaaaacttgatactagactgttcatggccaaagaacaaaagtattacttaatttgttcaaacttttggattgacagtacctttcatgttcaggatttaccacgatttagccattaaatctgaattttattttatccaacagatccctacctgcaatgggaggcactgtggagatacttggccgggtccagctgacaagaagaagcccctcttgtggactgaaaactggactgctcagtaagttactacttactactacttgagtaaaatccaattcatcttgttctgtaagatcattgtcaatgttgtcagtgagagaaaaaaatatatactacttatgcagacttcttagtgattaacatgttctattcctttctggggggtggttcttgatctctacaggtacagagttttcggtgatccaccgtcccaacgttctgcggaggacattgccttctccgtggcgcgcttcttctccgttggcggcacaatggcaaactactacatggtagtactgaacagcaacagtaacctgttcttgacaaagaagagagatgaaatttctgacagaactgacactggtggctttacttgtgtgaataatcaacagtaccatggaggaaccaactttggaaggaacggcgccgcgttcgtgatgccgagatactacgacgaggcccccctcgacgaattcggtatgcaaccctgaacaatccatccacagtacccaagaaatgtgtgtaagatgaagcaccatgagttgtgaagaattcagtttctaacacgcaatgagcaggcctgtacaaggagcctaaatggggccatctcagggacctgcaccacgctctccgtcactgcaagaaggccctcctctggggcaacccctccgttcagcccctcggcaaactctacgaggtaatgccatggcaatggcagtgacggcaagaggaagaagacgtaggacgccattgttgatgatgatgatgatgatgatgatgtgtttccatggtgcaatgcaatgcaggctcgggtgttcgagatgaaggagaagaacgtgtgcgtggcgttcctgtcgaaccacaacaccaaggaggacgggacggtgacgttcagggggcagaagtacttcgtggcgcggcggtcgatcagcatcctcgccgactgcaagacggtggtgttcagcacgcagcacgtcaactcgcagcacaaccagcgcaccttccacttcgccgaccagacggtgcaggacaacgtgtgggagatgtacagtgaggagaagatcccccgctacagcaagacctccatccgcacacagaggccactcgagcagtacaaccagaccaaggacaagaccgactacctctggtacaccaccaggtacgtaggtagtagtcgttgtctttctggatggctctgataccatattgagatttataatacggtcgtctgtttgtctcagcttccggctggagacggacgacctgccgtaccggaaggaggtcaagccggtgctggaggtgagcagccatggacacgccatcgtggcgtttgtcaatgacgctttcgtaggtaactaacttggatgctttcttccatcttcctcttgttgttccattgttgttgttgttgttgctgctgcttgattccatccaccgtgtgcgtttggatgaattgaaatattgcagggtgcgggcacgggacgaagatcaacaaggcgttcacgatggagaaggcgatggatctcaaagtgggcgtcaaccacgtcgccatcctctcctccacgctgggtctcatggtaataaagctttcatccacccaccattttgatgattgttgttcttcttaggatggagcttggtggtgatatgatcagggttttaaatcttccgctatatctgtttgataagagttccagctatttgctctcatgtacaatttagccactatagccctatttagcccaatatagttatcgctatagttgtctgagaaactaatcgctaaatgttttaacccgctatttaaaacattggatatgatgggcaacaacaaccatggtggttgttttttttttgttatttcaggacagtgggtcatacctggagcaccggatggccggggtgtacacggtgacgatccgggggctgaacacggggacgctggacctgacgacgaacgggtgggggcacgtggtggggctcgacggcgagcggcggcgggtgcactcggagcaagggatgggcgcggtggcgtggaagcccgggaaggacaaccagccgctgacgtggtaccggcggcggttcgacccgccgtcggggaccgacccggtggtgatcgacctcacccccatggggaagggcttcctcttcgtcaacggcgagggcctcggccgctactgggtctcctaccaccacgccctcggcaagccgtcgcagtacctctaccacgtcccgaggtcgctgctccgccccaagggcaacacgctcatgttcttcgaggaggaagggggcaagcccgacgccatcatgatcctgacggtgaagcgggacaacatctgcaccttcatgacggagaagaacccggcgcacgtccggtggtcgtgggagagcaaggacagccaacccaaggcggtggccggcgccggcgccggcgccggcggcctcaagccgacggcggtgctgtcgtgcccgaccaagaagaccatccagtccgtggtgttcgccagctacggcaacccgctcggcatctgcggcaactacaccgtcggcagctgccacgcgccgcgcaccaaggaggtggtcgagaaggcctgcatcggccggaagacctgctccctcgtcgtctccagcgaggtctacggcggcgacgtccactgccccggcaccaccggcacgctcgccgtccaggccaagtgctccaagaggcctcctcgttccgccgccaccgcgcaataagctagccagccgccacatctctcttcttgtctctcatcagattctcagatagttaaagctttgacctgctgctgctgccgccgctgctattgtactttgattggttccatccatcatcgatctcactcacttcactggggaattatttaggcaaacaatcaattcatgctcagctccttgtatgcaccatcgtccatggttttatatgtaggtaactgtagattgattaattgttgatgcaaataaatactagtccattccatttggtgaataacaacatataatcatcacaacatcatcctaagtcctatcctatagtgtgcaccatttgctctcacctctagttgctttgcaattaatataccatcattttgatccctgatggaaggtaaaacattccaaatttcagtatgctgtcctcggacagaaacccatacacatcttgcatgacaaatcttacaacaagctctccttggactctttacctatacacatctcacatgaatgacatatcttatgctgcatcagagaatcttacatgtgcttgccatcaccaatggccaatgcacataacctgcttgttgagaccattgcccatcgtattcctcacctcacccattcacaagttacaggttgcaacctcattcattcacatcaatggaccaaccacaccgcgaggtaaatcagagtgcaagataattgccattgaactgtcccaatagcttaaggcactttttcttttcggtttaaaattattataatctagattattgagttattataatctgtagtaaaataagtggttagttgtttctttactagattattagagcctagattattgggtttgcaagtctaaagagggagtggggtagcatggtgggtaatttttcacccaataatctagaaaaagctcacctaaatgagcttatcagattataataagctacttcaataagttgtctgtttttttcagcttactcccaataatctggattataataatcccaagctaaaagaaagagggcctaaatactttaattagtattattacggcacagagggcaataatcttgagaacaccaaaccatcaagtcataaaaaaaaaaggcgataaggatacaatcttaaaacaacaagggctggcccaaggtagaagtagagctagtttacgagcttcaacattgtgatttgtgcatatcaagatgatttcgcttcagcagatttctgctcaacaagcttgtcgatgagtgcagcggcatcttcaaccgttgcaattgactgcgcacttgactcttcgacgctgatgtggaactcctcctcgagacccatcacaatctcaacctgcaccaatccaacaattgagttttactacttgcaattgaacatgtaatcctttactcaaacaaaagaagatacaggcttctaccaacttataactgaattagactaaacatccaaacaaagcacatgtgcctgaacttcatagattaaacatcttgtttgatcattttcacacctgatgcaacagttatcacacttcatgtggcaacttgggaattccaatgcatctgatattctagtcttaaaagtactgaagagatttggaaaacaagacctacatgaagagcgagcctcaccaataatcactatggctgtaaagccattccacatctctaaaaggacatagatgccacttgtaaaacgagagatgctaccaaagcatccctcagatattattttgtgagccaaattgattacaaggatacaactattcaggcccccaaaatatatagaaaatttaggtaaggtgctgcttagttcaaaacaaccatatgcatgacatcactcaaaaaattatgggggagttaccgtgtccagtgaatcagcaccaagatctgagaacttggatgcaccagaaacttcagtgccctcaggaacagcgagttgcttcttaacaatgtcacaaaccttctccactgtctccttttttgcctattgagcggaaattaagaaggggttaggagacactctttagattgtagcaggaaaacacacgacaacacaaaatgcaaaagggaaatagcgcagtcaacagtgccatacatttaaaaacggagtatagggccgttttggattagtgccaaaacggtgccctaccaatattttggtagtttgaacagtgtatatggtggttttggtttgaagccaaaccattggcattgccaatgtctagtttgatattttctatactctactcaaggcttgttctaaattggtctccaaccaaatacaactttaccctaccaaaaaatcaatgatacaagaaacaaaaaggtccttctagaatggaaaggtgaattccaaacagctaaagcattaaaccctccctggtcataaaggaaagggttttggccccaggtgaaaattttcattcatccagaaataacacaactgctagcggatatctcatctctagcatagcaaagcagcgattgatggggaaaaaaaatcatgcatgacaagaaagtatggaactcacggcacagcaaacagcaaatctcataggcactggctgcaggcggagaaatgcatttcccttccttgcgctggtgaaagatatcgaattagtcttgactgcctgcaattcatggaacaagtttatttagacaacagaagtaatgcagaaaaaggaatagcatactatccacaggggaaaagaacatagcatagaaaacagtgttattgtcataattctactgttctagtatcacattagctgtatgtcttgaatttgtctcagtagccagtatggggtgttgaaatgagtaaagatgatttcgatgagaaataatctccaatgcatagttgcaaactcatcagagtttttttttctttactttctgtaagagattttattacaatttccctatataccatgaacataagaattttgcgaagccgtatgacaaaaatccaggctagtaagccggatggtgacggggcgaaacaaaaatcccttttcgtgccaagggaaaacaagatacgcccgttctttattaggtggtagtacaacatatcaatactagaaccaacttttttatggagaacccaaaggaccaatagttttgttaccatccaagtagaatcagtaaatcccagtaacgactaacgaattcatcatcactatgcggaaatctactcgtagcctaacaaggcggaaatttcatacggatacaagtatattgcagccttttcaacctacacaaaaggcagatctgctcggatctgctatacaaaatggatcagtaaacgcacacaaaagcacttgtgccacccacccgaaagcgaaaagggtaaaaaaaaaaagaaagaaaacttttcgccgttctcccatctgaatcgctccaccaaagggcacgaagctaaacccacagatcggccaaagaaacaggcccgagatcaagccgaaagctcaaaaaaaaaaaaagaacccccagcacccagaaaccagtcaggcacacggatcgatgaatcgatggatcgatgtacggcagaacaaggtggcgggtggggggatctgaccttgacgggggtggcgaaggagagggcggatccggcgagggaggaagccatggcggggggtagcacgaaggtggaaggcggcgagcacgaagcgcgtgacagcgactgggaggaggagagaggatggccggctcggcgaggccgcggggtatttatacagctggcgacgccgccgcatcgagtgtatcgacggtggggcccacgtggcggccagctgtccggcgcgggccgacctcgcggatgggccgttttgcttccggcccgaggtgttggtgggctgagtagtaacttgtcagtacgacggtccatttctcttctcttttccggagtgtaagatacgacggtccatttgtcttctccggcccatgctgatttaagggacacagaggaattccctcttcgaaaagaaaataataagataacctgatacgttcatccttcatcgtccttgttataaaagttaatcgatatagcggaacgataactagcattctcgatcgttttatccatcaatcacccaaaacgtgtcagatgataactataatgtagcgtaaatactcagagagataatagagacgaggccatggactcgtagcggttaaatgttagtatgttgattagggaggagcacctataatcagagctccgaagatgtaggctttcactaaacttcattataaatatcgtgtgtttctatatatcatcatcatctgacatgttttaagtaagcaatgattgaacccgatcaagaaaattagtcgtttcgttatatcggctactttgtataacaatcttagtattgtttttcactagtgtgcaatgcttttttttccattttgtttgtgatttttttttttgcgagctaagactgaagaggcatggatgatgttgatagatgtggctcatattgtcggacataccgttttcgtgaggcaggccaagaaaacatgcatgcactttcctgcaagtaatcaactgaagattctattacgcaacatccttcaagcttgctcaaaaagtaaggagctgtttggttgggctgttttcggcccgtatcagataccagcgtgaattgattcccttacatctgtttgttttagatggaccgtaatcggttagcccgcaaacgaatcccagcccaatacaaagttgattacgctccagatcgggcgttacgcgttaccgatacggaggcggagcggagcgaacatgacctagccttgagcgccgccaccttgcagcgcaccgtcgccggcgccgctccccctgcccggcgtgcgtcgtcgacaccgctgccccctgccccgacgccgctgcccctcccctcgcacgctccatgaccgcccggagattgcccgcctcgacaaggccgacaacccactgctctgctaccttcagtccctcctccatctccctcgagttccacatccctgacgactggatctgcgagaaggacaaggctgttgagcatcaagaaggcatggcaaagatcttgaggcacacgaagaaggcaccagccaccaaggaggttcttctgtcgtttccgccgtcgccggtgagaaccctcccctcactgataccaccactctttatgatgatatacttgtgatgctgatgattgatgatctttttcttttcattaacaaatcatgaagtagtttatactagtgaatcatttgtattcttgattggttgcatgtattcctgcctcagttctgtttgctttataagtttacatgagttttgtagaatctgtttttcccgattgcaggaaaaatctggaatagtagttgatggttctttcatatttgttttcgagtgtaggtaagttccgaaattttgtcggaccaactcattttactctctagattttgagaattttgattttcattactgccaggtgatatattattttgcagagtgtgagattggaaaaaaaaggtttgtcgtgcattgccttttcgacagaattgtcatcttgcacatatataatcaatttacttatgtttcgcagcatggactgttccaaaccaatctactcgctgaatctgagtctactaatctagtagtttcactcatgtcaattgttcatccatatatttcctcagtactttatttagacagatcacaatgtatcctcttgttgtttagttcattgaacttctgaagttctcactcccagcatgggtcttatatttactcttgagtattcggaagctacatctacaagatcttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttggagttccactgctctcatcgtgatccttccacaaggattcaagtgccaattattgcttacctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttcttaactttggagtcaatgccctttttagaatgaagcgaggacctgcccgattattcactttcagtagtttctggatgcatgttgtccaattatatcacttgaattctaaagccacatgaacttttcttgaattattcctatacatgccctagctagagtgctatcaggtattaaaaaatacacatttcccttcttttctttattttgggccaggaagcatgtcacaaaatttaggagtttgccctatatgagagctactattgcatatcttaatcactgcatttttagattgttgttggatcacttttgaagactgtttgtgctagactcctttaaggtgtttttagacttttttttaaattattgcatataactgttcggtcactaatttctgaattatttcattattaccacagatgaagcaatgaagaataaccgatgtattagctcagtcacaatatttggagcttgttcattgttatatgaccactatccataatttatacttgagattattaaactgatgttcacattttcaagactgtatacacttcccaatgtgtgatagtatcaaacagttgcatgttataaaattgtgaatatttttacatagctttgatgtgctacacgtgtttgagaacactgctgctatgtagcttgtaatgtgccttagctttgagctgcgtcacgttctaagcgctccctgcttcggaagcagccgttacctgttaccatgttccatccaaacaatgtaatgcaaacatgagacgttacagcggccaaccaaacaaaacctgtaaagtgatacattttcttcccttaccgctgtagctgatcccatttacgtttgcatttcctgacctcaaccaaacaccacctaagatgtgactggtaagcaggcggcaggcggccaacaaacttcgaagaaattagggtgtgtttagtttcacgtcaaaattaaaagtttgactaaaattgaaagtttgaaggaaaaaagttgaaagtttatgtgtagaaaatttatgatgtgattaaaaaattgaaagtttgaagaaaaagtttgaaactaaataaaggcttaaggacaatacgggacactaatttcagctcagatctgtagcatatactcctaggcctggtttagttgccaaccttttctttaaactttcgacttttctatcacattaaaaattttctacatatacaaacttttaacttttccgtcacatcgttccaatttcaattaaacttttaattttgacgtgaactaaacacacctgtagaatcgatcagatttagcaatgcaccgacggaaagtctcaaaccttaat

SEQ ID NO: 40369 - DNA, 12775 bp, Oryza sativa
agactcacagacatcagatattatacgatataacggaaactctatccccaccgagcaggactttggaaatcacttgactcgtggagatattttccataatttgtaacagattccaacagcgttcacgggaggtatgccatatccgtatattccataaatcgtagaataggaggtataccatacccgtatattccataagtcgtatgatatgaggtataccttatccgtaacgctgacaattaattattaattattccaaatgaccatcacatcgacgatcgattaggtaccaagaatccaaaatgcacatcggagtaagcgagataaactggttaagattcttatcgtgtaaatctgctcacctagattgaaatcttagactttgatatgggtgttcgcatttgcatctagttattttttcaatgataggtgacatattcgtcgatagcgacgcactcgtgttaactttgtcggtcttaagatatatcagcacaattttccaaagatgctcatatgggtaatgtatatataagtatgtgagtttatagggaagagtataagcatgttgtaagcgtccgcatttataatgtgttttaaaaaaaatccaagatgcaaagacaatcatagaaagatatgtttttaaggtgatggtaaattaaggttgtttttgttcctacaacaaaaagaggaaaaaaaaccttgttttcgcacgtacgttgttcaaaccgctatacagtgtgtgttttttagaaaaagttctatagaaagttgtttttaaaaaatatagtaattcaaaatttaagtatgaactaattattacttaatcaatcatggttaatagctcaactcattgtacatatcttctcaatttctactttctacctctctcaaacagacaccctaaacttccatcgaggaagatcggaatctgatctgttagttacgcctaagtgcacttgcgcggctttgttgatatctttccaaatatttgtagtttttttttgttaaaataaacgagtaattaaagtttggaaaagagcactaccaaattcagctattaaaaaacgcgagtctcaaataggctccagattcttcagttggcaacgggagaagctgatatggcgtggaatctttgatgtggaaaactgagctgtcgcattgtgaaagccattactactcctatcccaaaattttgacacattaacccttaaaaaaaatgaaccttagcaaaagttaacactccctccattccgtattataagtcattttctcctaataaaaattcttttatttgatcaagtttgtagaaaaatttaacaacatttacaacaccaaattagttttattaaattatatatatatatattttgtaaatttgatcaaacttaaaaatatttgactatagaaatcaaaaccgcttattatatgaatatttaatcttaatgccaaccccaataacattgatgttcatcatcttaattagcgtgagtaaggccatctacaatgggtaacccctaggtcgtcccctcaccgacgggcgttcgcttttccgtccgcgtctgctccctacgatggagcgcgtcccctggctgatggacgcgtctcttgccgctttttagccaagcaacgtagccaagagacgcattggggggagggggggcgggggcgatgggctcctgtggacatcggttccccagctcgtattcctattccaccccttggcagaggtagagtctctgccggacgtcgacgatgaagagggagagaggagcttcgtcgcgaccaccgggaccgggacggcgccgaggcggacccacaagagagagagagcggcgagcggcggcgtcgatggatccgcggcggaggcgacggatccgcagtggagtaggcggctctccttgtcgccctcaccgacgaagctccggcagcggcggcggtcctcctcgtcgcgcgacccgcgcgacgctcgctgtccgctgcctcgaccgccgcgacatgcgcgccctcgccgtccgctttgctgagagagagagagagagagagagggatagagcagagagcaagttgagggagtgagagagcagagagaaaggcgacaagaaagagggaggagtgagagccgcgttgccgacaggggtaggagaggaaattaatatatgtggctttttggttgggatacccactgtgggatagagtgttttcattcagttgcttcgagtttggaagaacccacttagctgtggcctccattgtgagctgagttcccttacaagtatcctcagttagtaagaacactttagaagtagctcatattgtaaatgccctaagatagctgccacctaatcggattgttcgagttggctagctagccaacgtggtgggcgcacgctagctaaccacccgtcacccgatatcaacgctaggccttttggtgccgttgaaatatatggcccttaagcaccatgtcagtcctgttggcgttgagatctatgatcgaacgtgatatgaatctagtattagatgtaacacgaatctaaatatatctacccttcagatttatagtacaagcatatattttttccgctattagattgctttacaatgattagattgctttccaatgggacggggagtaccatataaaggaccacacgacctagcttgtgattgctatgttccaaagcagcttgcatgtggtagctagctagtgtgaaacaggccaattcaaagtcacgcgagcaacgcgcggccaatacaaagcgagagagagcccaacttgctatctgccatttttgccaacttgctacctgccacttccagcgagcatggagcgagcggctggtactggtagcggcggcgacgatgacgagctcgtgctgccgccggcgtcgtttcaggacgggcttccgtcgtcccgctcctacccctcctgcatcggcggcggtagcgcagcggcggcgtcggcgtcgctggagcgggagctgctgtaccgcgcggagctgcaccagcaacagctgggcggcggcggcggcgtagagcggcggaagaggcgcgcgatgaagaaccgcgagtcggcggagcggtcgcgcgcgcggaagcaggcgtacctgcaggagctcgagcaggaggtccgcctcctccgcgccgagaacgccgccctgcgccaccagtgccaccaggtacgtactaccctatcgtctccttccttccttcgtcgtcagactctgtgtgctcatagatcgacgtgttgatgagatgtgcagctgaaggccgccgcggcggaggcggaggcggaggcggcggcagcggcggcggcggcgaagaagccgacgtcgtcggcgacgttctgatcggtgtcagcatgcaagtttgttgggggttgtcggccgggctatggagtgaaatttactccactcgtagattaatctgcaagaatattagaactcgtaggtaggtttagctagctagctagctacctcagcatggagaatatgagagcaaggactagaactactagtccattttaaagccaatatatatactctctctagtttttttatatgacgttggctagttcagatttatactagccaacgtcagacatatatgtacggaggtagtaatagattagttataatgttggctttaatttttcttctccactctctctcacttatgcatttaatatatttgttttgaattaatttttcttctcatctctctctcacttatgcatttaatatatatatttgttttgaaggacgtataaagctagctcttatataaaaaccaacaccctgcttttttttttctctctctccttccgtaagtttatattaagcttacttgctattatccttgcgcggaggggagtgtgcctgcctgcctgaaaaaaaggcctcccacaagcacatcatattttgggtaaggaactaattaaaactgctgttgtagttcccagttttatttatgtgcgtagagaacaattaattttaattgttatgaaaaccgttagtaaatttttagataatggaatatatttttagcctttactaaacgagttacagccaattagtattatacaaattcgcttattagcatttacacataaagagtcaaaaaaacacactatcttaaaataaaaacaaacaacctaacaagcaccaacacaattaatgaatcctattaaaactgtcatacatctacgattacggtagtaaaagtgttccattaagggcatgttcaatgcgtacccctagcccgtgtccctgctcacgccgtcggggtttgccatcgaagccatctcccagcagagggccgcgacccctctgcaagggacgtggctctacgagctcctcggctgggggaccaagcaagaagccgcactgggtcggccgtggctaggggaggagcctgtggacaccgctctctccccctgttttcccccttaccctcgccggctgccagagagagagagagagaggcgacgacgagagaaagagagagaggccattgctgcccgagtacctacgtctccgcagccggcgtcgcgcccgtcactgccaccatctcctcctcaatgcggcgcgaccggcgccgctcaaaccggatctggccgtgtgggggccagatccgcccaggacgatgctgaatctgtcgcctccggccggtggcggtgcaaggcggaggagccgccgccgccgcccgagtaagacgacacctcgccgccgctgccctcgccttgcgctcgccgccgagggagaggaagagagagagagagagagagaggaggggcgagcagcgacggcgacgaacgacgggcgaagggagaggggtggagtcgacggcaacgaacgacaggcgaaaggagagaggcggagtcgacggtggtgcgacagccctcctcatcgccctcgccgacaaagctctggtagcggcggcggcggtggctggggaggacgaggagggaggcgacgacggtggctggggagggcgaggagggaggcggtggcggtgattggggagggcgaggagggaggcggcggtggtggcttgggagggcgaggagatcggcgacgcgcgagagatagggagagattggcgacacgtcggtgagctaggggtggaggagggtagtataggaaaatacccaccgtgggctttttggttggaacatccattgtgggtttaagtatcttgacccaattacctcatattttgaagagttcacctagtgtagctttcattgggagatgagtgccccaaaaagtatccttaattagtgaaggtactctagaaatggctttgtttgtacatgccttaacgtgacagggggttatatactccctccttcccattttatttgacgccgcaagtcaaaaaaaaattagtgtcacaatgtttgacgccgtaagccaaatcaattgaagcattccgtctttgcccctgtcctccaacaccgtgggagatcgagcatggagctgggatgcgcttccctacggctgcatccacaactccctcatgccgtcccctccggctactgcttgctatcgaagaggtgatgatgtcgctgctcgccgacgatggcctcgtcctctgcctcggtgccgtaagtcgtcgccgccgccggcggcggcatggcggacgtcgaggccggtgcccgacgacgaacaccatatggtgcttgtgtagaatacgatatgcacgagagaggtaagcaactcagattgagtgttaattctattgatgaatttgtgtttgaggaatcaaaagaatcgatttctgagccgtaattggaattcaatccttggttgcagttgtggatttcgatttctgagccgtaattggaatacagtcattggttgtagttgtgggttttttatctctaccctgccaatggtttatggttcacattttcatgtgaggaccgacttttttcaagattaggagaagctgatttctgaatatttcagaccagcacccagcagcatcaagttcagatcagaacgcagcaacagcagcacgagcaccatttcggatcagcaacaacagcaatgctatgggttcctgctcttgtgtggcggcgacggcgtggggagacgacatgaaagacaaaatcgagacgacgagctggaggcctcgtgcggcatcaaggcggcgaggcagacggccgcctcgtcgccgagccggcggagcagcagtatgtactccctccattccaaaatatttgacgccgttgactttttaaaaaatgtttgaccgttcgtcttattcaaaaaatttaaataattattaatttttttcctatcatttaatttattattaaatatacttttaaatatacttttatgtatacatatagttttacacatttcacaaaaatttttgaataagacgaatggtcaaacatgttttaaaaagggaatactagatatgaacaaagaagggcaaaatcgtaacttcattgcttccttaatcctgttgaactggtcggaaacgtccaataaaacgggaaggagggagtatattgttcgtgccgtgaacgtcatcaaaactcgatccatccgtgaacgtgaaagctctagacaatggagatcgatcataacagagagttttggccagctttattcatgttcactgagaacgttttcagatcacttttgctgagattcgttgtttgttttctcgcaacttgcaatctatcctgtatatactggacgagcacttcagcacatctcacatctgcacatgcatcatgcatgtattctgttccatcgaacgtgacgacatcaacctgattttttctttttctttcttaggccgtgtttagttctcccaaattcccaattttctatcacatcacatcacattgaaaactttcctacacatataaactatctttttttctccaaactaccatttttcttctaacttcctaactttttcaccatctaaacacaggttgcgtttagtttctgaaaaaagttagaaatttgaagaaagttaggagtttgaaaaaaaaagttaaaagtttatgtgtgtaggaaaatttttgatttgatatgatatgatggaaagtcgggaataagggagaaaactaaacacggccttacttataccttgaattgttgcagaaaactccgtactgcaaatggccagagctagatcgatcatctgaggatgtgtttagtttttggatgtaaagtttttgaagtatacggacatacatttgaaacgtagactaataacaaaataaattatagattctgcctgtaaactgcgagacgaatttactaagcctaattaatttgtcattagcaaatagttactatagcatcacattgtcaaatcatggcgtaattaggctcaaaagatttgtctcgcaatttacatgcaaactatacaattggtttttttctcgcatttaatgccccatacatatgtccaaacatttgatgtgatgtttttggccaaaattttttggatctaaataaggcctgaattaaaaatattaccctacgatccatcgctttttctcgaaaaagggtccagcttagctatagtcaagccaaaacaaccaaaccgcgctacctgacaatgttcgcaatgttatgcattgtaccatccaatataggagaaaagaggaccaaagaaaaaaaagagagagacagcaatgatacgtgcatttgctgagagcgggaatgccatccaacaccaaaaagttaatttgacaatgtttgatataaaacagtttggtagagccgtagaggtatatgtagtgtaggcatatatgctgtttgattttatatcttactaccgaattttttgtacggagtgatcatgtattcatgtgaaaaagattagtactatgtgattgagatggtataatgtttgaaactttggatcgctatggttgaaggtaacaacaagctagccagacatgcccagagagttgtcagcatcatcagggttagatcggagcggtccaatcaaaattcagtggcttgtttggtttgttaggggtgtttgggagagaggggaacacccccttaccataccaaaatattgacaatgccaaatcataggtaaattttggtagtaccaaatactttgacaacttatgtgtcttattggtatattttggtagcaaattaaacactagccaaactactattcaaaatgccaataatttggtagggcacgttttggcatcaaaccaaaatggccttcagtggcttaaatcatactagtagtactcatgtgtgcgaaacagtccctacccaatatacgtgtgcttaccagagtaattaagaccgccatatactactccatcatgtagtatatatatatacttaaagacagtcgttaccgtgcgcttctacagtacggcatcgcatctacacccgatcgagcgagagtagctagagtgcaaggtgaaatctaataaatagcgtatagcaggttagtaggtattattgtggacctaagttccaataacgaaattaagaaaaataaccataaatttatattgtatatcaatattagcatcaagtttcacttaaaaattaaaatgtaaactgcatgcttaattacttctacatttaataacataaatattatgaaatagcatataaatatataagaaaaagaaggcacacagtgctaaattattttatccatatgtgaataacactgtttagcattatatatagtgattcaacaaagttaataatgggttgctattaaggtcgtgaagcgctatagcagacactaagtttcaatacgctagataaagtccactaccttgtagcggtagcagtagaggttcgttaccgctatagcagccgctacgaatgctatttatcaccttgctagagtcataataatagtcgtggttaaaatggtaatgagtactagatttatggagagtggaggttttgtgctcccgtaaaaattttagacttgttagatcataaatgtaatccattgttcagatattaataaagcttctctctccttagactaaaaataataataataacagtcgtggttaattaagtctcaagtcacgcatagcttaacaatggcgtgtggctgttggtggtacgctcgtgcatgcatttgtgccccagcactgtcttcgaaggatcgatcattctagaaggatcatatgaatcgaattttaatttattagacatttagtcaaaggaactagcgtcaaatcacatcgagacaacatgcgggctttctgacagtggcctatctccatggggccgggccgtgccgacgtgtgagcacaagtagtgttgggccatgacaggcctctccggcccattatcgagagcgcagcccggcccggcccgaagccgaggagccacatttcgtccgcagaagatccccaccgtcccgcgatcctcgacttgcgagtttgcgacggccatcctccgcgcgcgtgacaccaacgccacccacccacgcgtccgcctcccgttggcccaccaacgctcgcaggccgacatgtgggctccacgtcacgggcgtccgggcccacgcgtcagcgaggcgtggcaccgtgcggcccaagtcggtttcctcgcgggtccgcctcgaaggcgctatataaacctcggccttggctaatccggagatatttttgcaaatcaaccccgcagctctactgttttccgcttccatcttcttcctttcttcccaacaccaaccgcatcatcatccatcacccatacgcgcggcggagagatcgttccatcgatcgatcgatcagctcgcggctggatcgaggcgaagacgcatcagatattgatcagatggaggtggaggagatgaagccggccggcgccggtgggacgacggtgggcgacggcttcttcacggaggccgatctggcggcggcggaccagctcgtgcagctcagcgtcagcggcggcgggtgcgaggacgatggctacgactcctcctcgtccaccacgctgcagtcggtgaacaacgccgaggcgtcggcggcgatggacgacgacgacgacatggggctggataggagggtcaggaagaggtaccgccacctgtcggagctctacgccgccacgctgccggtgaaggagaaccacggcggcggcaagcggaagaagagagaggaggacatggggaagaagaagcagccgcagccgcagccgcagccgcagccgcgctagaggaatcgggaacgcacggatggatggacggacctatctgtaaatattttcttctcgtagggtgtttgctttcactttttttggttaatttagttttctccttttgccacctgcgcgtggaatggaccgagaaaaagaagaatttgtacaaagtttgagttttggttttcaaacaatcgatgacacgcagcgatcggtcggcttgcaagaggttttttgtacacgctgcctgtgaaatgtatcgaatttttgtttattttttcgaattgaatgctttggttgcttgcttctggaagattccagaggtggctaggctatagctagcctaacgggtgacgccatcgtttcggcagcctgcaaccaagcatggcaaagcttggtcggcgcgcaaaaacatacgctgttattcgcaccaaattaagacacgtatatgtgtagagatcgctcgatcatatcgtgtcccggtaacaaaatttaattagctttcaaaatctcatataaaatagtatagcaactttatttactttaatttatttatcgatcacaactaattactattatcatgtcttatttaatttcacttttagccaatcagaaatatttctcaattagctttaccctctttagttatgttcggattttgggacagaagggttacatgtttcagatcgattacttaatgaccaatcaagcttcatgtacgtaactaactgatttagctagctgcgttgatcggtcaaacgcacgcatacagctaaaataaaatgtactctgaccgacaaaaaggagaacaaacgccatcgtcgctacagatgtaagaactaaccacagttacataataatactcaggttgaacaagactagatcgtcagcctccgttctagttcggttctctgtgtacaccattggttggatcgatcgaaaaaagtttgatccgaactgtctaattcacagtagagataaaagaacaagcctgcaaaactttcaatatatctataattatatttggatcatggaaaagaaagtaaatcacaaaactaaaaaaatactctagtcaaactattgaaattattacaacagatttaagacgatgtatcattcaccaaaactatcccaaaatttaagtttggatattaaaatcttagcactattgttctgatagagttgtaaatatgtagttctgcaattgtctgcttaaatacataattttatgctaaagtttatactatatttgtagttctagaatatatagttaaatatgtagcttttcaataatatctttggaacataatgggctgtaatgctgctttgcagccggctgcagcagtagatgggttgtatatatagtaaagcaatattagctgccgcgatcgtatagccacatcaatctctccccaacactccaaataatcttgagagatggggctgggtgaatgtcatcatgtctaagctaaggtagagggtggatgattgagaatacatgagaccgtgatatactcttttcgttcgaaaatagatgttattttagaatttaaaatttgtttcaaaatgcttgttactttggaattgtgccttttttccatcccacccctaaatacataatttgataaagaacgctataatagttcttctaaatattagtttttaacggtaattatattaggacagagatatacaaactggcttgtgtactgatccatccaatcacctacatatatatgatacatacaacacgcagctacgcacgcattagctgcctgaaattaaaggtctgaaattaaaggtcgcgagaggccaacacagtacaggaacactacacgcgtaccgaccatgtacagactttaatttacatttctctcgacttgttgtgatttaatttagccgtgtgattattaacataacacaccccctacctggatggctggatactacggagtataaagcaaagctaagctggtacgtgcatgcagtctagctaagccctgcaactttgacttttctatgaattaaccggcggcaactaggagccacgtgaggtgcgccgtgatgacgtgtctcatgcccaccttttaactctttctcctcctccgtcaaattactctaatctcccccgcacaaaaccgaaattacacacaactccttcactccgttaacctagtactcctagccattttctcacatacccccctgagaggaaaaatcgagtccagcgcaggcagactcatcacggccacgcaatttcccatcagcttttgttcccaaccaagaatcacatttttcacaaaaccccccgtactttttctgttttacacgcctaggcgaagtcggtttccgccgagtcacgccgcacgcagcaaccacatgaccgattaactcccttcttcttccatcttaacccacacccacacacaaaaataaaaaataatactaataaaccaaccaaaaaaaatcgaggaagaaattagagagagagagagagagcacacgaaattaaccggcggccaacccatccacgccccgccgcctcgatccaatcagccatggagggatccctagcccggcgccgg

SEQ ID NO: 40370 - DNA, 4471 bp, Oryza sativa
cgtcaatactaataaaactttagccagaaaaaaaatgtttttatgctttggtcatagagtcatggtgtggttttggggttacaaaatccattagctgaccagaacaaccaactcgctagtgttcgtgtagataggtacaagttgacgaactgacgagcgtttagatgtgtggtaggccggggcaagccatctgatctgctgattctctaataatctctactgtattgcctaatcaaggtctccggtatttgaccggcccggcacgtatcgtttattaatgcgcctcgtggagtggagaacggtgcgtgaccgcgcaggccacgacgacgacttgtgtgagaaacaacgtatcgcccggggcctcttgaccttgggtaatgggttccagcgagaggagagaaaaaaaaaaacgaaattccggcagcgagaatcacgcctgcacgccgccgggatggctcgccgtacgtcgccggcggcccccgccgcaaaatatatgacccgtttcgatctgggccgttcagatgagatcgagcggtccacactgggcgtcgtcgctgggcaagacgtgcggggctgtgggccccagtttttatgtgcagcgagggggtgcgtggtccctacgcaggccgtgcaactgggcctcggttccccactgtggccccacccacgttatctgacgcgatacggcccgcacgtgagttacagcccatatagtacgggcctgacgtgaatcccgttccggcccatctgctacggcccgcacggtagcgccgaatcccattcggtacggtgtgttgggctggtgaatgacctgttgtgcatgggctggctaaggggattgatggatgagctttaaaaggaaaacagtatactttgactccctcaacgatggcccgagtataattcatgccctccaacacaaaaccaactatatcaactatcaaaactggtgccccttggtgatttgggaagcagtattggctgatggggtggtgttgatttagtcttcgtcccacgtagctctagccctggcggttgtcccttctcgtcctctttatcttcggcaccgctaccttagccatcactgtgattatcgaggttaaaaccgccgataccatgtccttctcgctcatcctcaagccattgttgggtgactttgtcgtgcacaagcggtttgactctcccgctaactgaggtggcttggcgccgatgatgtcgacccccaccgcggttgctacatcggattcggaggtgacgatgaggagcgccatcccggtgtgaggcgatacggtagtggtgcgcgtccggtaagtgttgacaatacctgttgagatgaccaccggcagggagaagggcgcgtctgcgctggcgatgcagaggctgtcattcttagttcttggcgaggtaatggtcgagaagtggccatcgccaacatcgacggcggtgacgagcgctaccgaggcgcaaaaggaggatacaatgatgacggtggagcagacaaggaaggagaacaagatgctgacaagggagttggacgagcttcgaacagtagcaagggggaaaaggaaagaggaaaaagatggggagtgaggaaagaggaaaaaggaaaggagacaatcagacaaatgatgacatgtgcatcttatgtcaatgggtcccatctttttttttgggtgaatgatatatgggtctcacatatttttcttgtttttgtttttattctaatgccacataaacaccacatgggacagatagtagatcaacaccgccacgtagatgctacgtcagccaaaactgttttccaaatcaatcagggtcaccgtttatgctcgttttaatagttggagaaatcaatatatccggtatttgtgtgttcgaatatgaattactcataccatagttgataccatagtcgagggtgtcaaagtatatcttttccgctttaaaacaaatcaccacccttattttgctctttttttttacttttgctacatgaacaatttttatttttcattcggatgcatctctttcatatataacgaagtcaacataggaaaaattccaagaattcatttttttatttacccggtcagtccataacaattgaataaaaaaatgtgtacctttaaaagagtttaggcctcttaaaaaaaacataggaatttcgaagggatttaaggtggaattgactacgaaattcatattccctctgtattttcatatttgacgcttttatatttatttttaaattaaccaacgttacatataaaaaaggatggagggagttcattccaaacaaatccttattgttttctacaaaaaacaatctgaactttctgaaaaagacaggagttcgccctccagccatcgccatccaacgcactgttgtgttgcgccctcgtcaatggcgtccccttccaagcgcgggccgtacgccctcccctccgacggcgccctccccttcctcctccggtggtgggggaagggaaagggtgcgaggtcgccgtcaccgccacctcggcgaagtccgcgcctccgctcggtcagtgtgcgcccgttccgtccattaccaaccaaagattccactgcacttttgctcgcttcgctttctagtctcctgtacacatctcctcgctgcgatccgtgccctagctttccgatcttgccgcgatcttggtgggtatacttgcttgtcttactgacacacatggtcgcaatatctgaatgcgtcgcccttgtcttgtccccccatgagatgaaccgatcgatgcatgttgattttgggggtggaagaacaactttgatgtaggccaaatttagaggcatgtgtctcctctcacactagtttttagtgaagtgttgttatatgtgaatgacaatatgtgaaacaccttgcaaccttcagtagtagtcctctgcaatgacatgagcagatacgcgaagtcgtagagtttggttgcagcaaggacccatgagggtgtaggttttgtacagtctagtcccttcttctggtacttttgtcttatgatgatatcttggaagaccaatacttccgtgtgctcatgtaattcagcatcggcaacaatatagcttgagactgaatcgaggaatgcacacaagatctccatgctgcgttgggtcgtattcgggaacgatgccaatgaatgaacaagaggagcattccagttctaattgttagcttactattagcattgccaatttgtcatgcatatgccgttggtacagcctgctagaactaattccatgctctcattatctgtcagatagagtgatcaatcttggatgattttgtaggtagacaagctacacttcctagcattttttaattatatttttgtctgaagaggcaggcacaacattttcctttaagcccagtcatttctttcaaccttttcagaaagtcattgtgctaattgctaaataaagcaagagggataccttactgagggtaccttagttcaaaacgcaaagtggccatgaagatcaatattcaaaacctaaatatataaattaccctctaatcaagagtacctttaatgttaagcggcatcgattacgcgttttcttagctggaaggttggtaatccaggttgttattcagtgcatttagctgatgtagtgatggaaatactagacccattctctttttcatgcattttaaaagctagccacctccgttacatgagcagtaatcaactaaccatatccatcgaatgtataccaaatccatgtaatctgtctaaaaccttgcattttaatggaatcatgagcctgttggttagtggttactgcacaaacacgagatggtagctcagtggttacttctatgtgatcttatctataacattgactagctcaaccattggagaatcatggtacggacttgaaagtgtcaggtcttttacttgaaagctgtaactcagatgggttggtgaggactgaggagcctaaatattggtagtctcacttacatgcacatgtaattttgaagggtttttattattaaatgacctcatatatagataatgtcacttgttcttttagtaatatcttcctatcctgtcaaggtatagtcagagcttcagggaagcagccagaagttatactgaaaggacacacagacctcccactaagtcctactgtacaagcttgcttgaagttgggcactgaataatcaactacccctctcacataagagggggaaaaacaagagaaaaatgttgaagttactattcccagataatccctcctgtttagtttttttcaggaccaattttgcatgataataccaactggatgatgtcagctaaatcttctcatctagaaatgcagtccattgattctaactagtacagactacagatagtggaggcaggatggaatagaccaaccgactagaaagaaaattactcccatgatgatgggagtttccttctgggctgcaggaatt

SEQ ID NO: 40371 - DNA, 15308 bp, Oryza sativa
  unsure (1)..(15308): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaaagagaaccttttgcttaaaatctgaaaatttccacaacatataggtagcaaccataactatacagtaacaaagttgcagagattaacttcctcttaggggaaaaaaagaaatccttctaattaatctctgcacagagtattcagataagtgaccatgctgagatatccaaatgacaagttgccttttgaaaaaaaaaatcagaaaagaaacctcaacttcaatacggctcatttagacattcaggcccaacaagcgggctccggcctctgggcctgatctgagctgtatttgggccttacaaatgagctgttaactcggatgggcctaggcccacaccgtgtgggctgcttgcagagaaaccagaagcagaagcagacacagacctcgtcgcctccagatcgacggcgactacggcggcggcggcgggtgccaccgccaacgccgaggcagagagcggcaatggcgatgagccgcgcccacccgtctgcatggggaaggaggcggtcaggcggcggaggagggggaggagatccgcatccgctccagcttgaccaggcaagctttcctagacgccctcccctcccatcccctccgccgccatgcgtgtcggatcgaactgcttctccgtgagatttacagaggaacgccattttctggaggatgcatgtgagatgctgcagtgcagatggattggaccacaaggtacattggcgataagaatttgtcgaggaagttgttcaaatcgaagccaaccaaccaacaccttcctaaccctaatcaaatttgatgtgggcgaaaagatctgcggctagcctatcacccatcgatctcttcctacgccattgaagttaacaagcaagctaggaagctacatgctgtcctcgtgtcgatctctttattatccacagtacggtacggaccagtatacagttgcatcacttgcatgatcattgatcaaacagctcacaacctcactcctttcccttgcaggattggtctttttttatggattgctttgcaattgtaattgacaagaaaacacagcgaggtatagcaaagaactcttcagtgtagttcttggaacaactctttacagaagtgcaacctgcagcacattgcgagttcagaaaccagaaatgcgcaagagttcagaaaggcatgtaaaatggagaacatatggatgccacatctgatgatatcacatcatcgtagaaatatggagcacataccatatgcaagttgcttgtaatgctagtcaagtcttcctcaaccaacccctaatgatcagataaggaaggacacacgaagcatcctaagaaatctcacttgatgtggctctccatctgatgtttcggtgtgtttcttgtgttgacagatgctggagcttgaagtaaatgcctctgcatatgcttctatcctacactgaaccactgctgctgtacgtacccaatcatctgaaaccagttcagtactatggtctccacaagaggaccccaatgcaccaactgttgcctccattgtagccaacattgcactaccagattcatgaccctgctgctcgcaccaactagtgtcattgatgagtgcgtgcatgtcatggaccaatttgttgctcatctattcaaagcactaatggatatcctctggaaagtgaaaagttgatatattttcttttaaagatggccatgatccaaatcagatccaaggaacacatgcaacgacttgacttggaggcagcttcagtccgtacgtagaaataaagctctctctctctttttgaatgaacagtgttgacgaaaaaaatcgaatacaccggcctgggagatctgcttaactcctgtgcaggtctaaagattaatgagatgcgggcgtgccagtcagtttgatcctgcaattgaaaagatatgcaaatagtgtcacaccccaatccggcaccgccgcacaacggcacctgatagggggcatgtcgtaggaaaaacggcgcaaaccgcttcctacgaaaccgcgatctcggtaccagtcccaggacatagtgctggtacccacggtgacaaatatgaatcattgcaaatccttaaaataaatagaggacttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcacttcacctcatcttcaacttcagggcggaggaactatatatatttatatagagcaagggtgagtactttcgtactcagcaagtcacgggaatttaggtgtttaatgcaagcttggaagagaggcaatgttgttttgcaaatcttttatttgaagacattttgaaatcactaagtgatttatttctttctaagtttgggccgaaaagagacttgcgtctcgattcgactttcagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagactatgatgcccatagacatcccgaatcacacagattcgtttcttgaccactcaggtcatccatctgccacataggctgattctggttacgattcccacaccacaacaacttttcacaaagcacatgcaaacaaatctacgcaacgagaaccacctcacatccgcccatgaccatgggcacggctgttcgaacagttagttaatcctctgcagaggggtacactttacccacaagatacgaacttattccgaacacccgtcggtatcggaggttcgcaacaaagcctttcccaagccgacccagggatacctcatgccacatagaaggatcaaatcctcacataaatataggccattttaggcgttcacaaatcaaactccaaccacctcgatcggtaattcagcaagcttctcgttcttgcattaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacacaggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagggcacgattaccgaggtaccacaagggtggagcgacaaggaatcagggtagtatgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaggaccaaaataaagatcctatttagactaattagtagtgccattaaatagatctcaattttacggaattactggaagtggaacggaggcgatcggagctacggatcgagggatatgaattttggaggtctaaatggattttctggacaaggaaatgttttgtcgaaatttatggaaataatattctcaagaatattattgacagtcactgacgtgcggggccaagggtgtactgtacatggggggggattaagtggacttttgttcatgtgtgtgggcactgggcttggacagagggagtaaaagtagacttttcattttcccctaggccgagaaggggggatggttgacgggccaagcccacgagcggggagagggaggaggggggctgactgggcgccggcttgactcggtcaagctggcccggggttgaggtggcgtccacgtggaagccacgtcggatggggaggcagaggaggccgggcaggctgatccgatggctagcgatgagcgacgcgaaccggcgaacggcggcgaggtggattggggggttagcaccggaagagagaggaggccaaggggaatcgattcaacggagcggattagccgggggaagaacgacggcggccgacggcggtggccaatctcgccgacacgccgatgtggccgcgcgtggaaagagcgaagggcgcgcggtctcagggtcagctgtcgtggaaaaggggttgcgacgcgcacacggtgacgcgggacccgaaggtcaccggcgacgcacaggcggcggcgctaagcggtggcggaaggggcggcacggcgcgagagcgagaggggaggccggcggccatgaggcaacaagggggagatcaaggggatccccgagagcgtggtggcaagagggattgacaagaggggagccgacggcggcggatttcgacggcgatcgtcggcggcgagcaaagggggaaaacttcaccggggcaacgggggttcgattcgttgaagttggagcatctacgcgaggtcgcgagctcattccaccggtcgagagggcacgggcgacgccgagagaggccggcgacggcgagcgacgaccaggacagagcaagggcgcgcggcgagatgtgacgaacggtggcgggcgcggcgcggcgtgcgacaagggaaaaggggttcagtggggagctcaccgacgagagaaacggtgtcgacggcgcggatggagtcgcggcgaggcggtcgcgtcggcggggtggcgcggcaccgagagggcgcggccggggaagaagagatggagaggtgcaaggatggggcggcgcggagctccttgtcgactcctcgtgctcgctagctccccgacacgcacgacggcagaggagggcgagaacgacgacgaacggcgagacggcagtggtgtgatggaggagaggaagcgggaggtatgggagggggtgtgggttttgtaggtggcgatgtcggtttgagagaaccgaccttggggcggtcaaggagatgaggcgggtggcgcgagcggtcaagcgacacagaggtggtgacgccggcggtggtcggggaaaaggaaaaagaagggggggaaaggaggttggtcctttgccatattgaggagaggggaagcagctgcttctcccattcttggacgatgtggcgtggagtggcgggggccatggatgacgtcggcaatgacggtggtggtcggtttggcatggagcgggggcaaggcggcagcgcgtggcgtcggcggtgcaagggctgatggcggcggcgaccgggcggcgagcgcgcgcgcgggaagggcgaccggcgaattcaaacggcggcggcgggaatcggcgccgaggagaggagttcgacgagagagagagagagagagaggaaggagacaagagaggcgctgcttctctcgctcggcgcgtgcagcgcacgtgtggggaggaggaggagcggccgagaggagaagatgggccggaaaagggaaaaacggcccaacgaccaagagggaggtgaaacggctgagggagggaggtgggctaaggggaaaacggcccacaatacccgagggaggtaaaatagacttttgcagagaagactgatttggagtggattcgaattgaggttttggatttgaattcaaatttgacattcgaactcgatggtttaggttggaatcaagggagactcgaggagaagtcaagaaagagattcaaaacgaaaacttggatatttttttttagtcggagcgaatattcggcaaggattcaaaggaagggattgactttcggaatttgatttcggagacttgaattttggataggaaatcttgaggtggaggatttttgatttcgatgagggggaacaacgggatttgaaatgagatcttggcacgacttagactcgcacacaaagaacgaaaattttcgcaattaggattttgccgagttagtttttaacgactcatgaaaagcggagcgttacaaatagtagatcaaaacagccgatcggctgacaagccgatggagtagttccagccgatatccaataatagccgatgccgatactagctgatagcgatagggtttaagcaatcggctatatgtccaatgtagatgatgatataaaggcaatcggctgatgatgatgtaataaaataacaatatagtccagtataaaccaatcggcaaataatgatatgataaataagcatcgatccgaaggttgaagcacacatcggctggaggtccgatgtcatgaaatccacaagattagattaaacagcgaaacatttgttgtcatcggctaaatccaacttatatgtatatgcaatccttatgagccgatgcaacgtccagataactcaccggctgaaaccccgatgaaacccttattggcaatcaagaagcaggctagagattatggttctaagcacgacttagtagatcaaacttaactgatgcaacactaagtatgaaaaaaaacataatatctagacaatcaagccgttgactgagttttcagggtggtagatgtctaagctaatctaatctagcaacgcgatttagccgataccgacagaaaccctaaaacgagaagcagccgatagagctaaattgatatgctaagactagattaacagagacatgataaataggtaggcaaatatatcatctaaaccagagcaatccaagaggttgaatgtactgatgcagccttgaacgacgccgacataaacgatacaactacctaggccagtggaacattggacttaccccttagccagagatcgaacaccgatgcagccccgcgtcaggtgccaagtcccgccggacgataaaaataaagtagaaaaggtaaaaggtggcgatgcgccgaattgtattgattgtgaagatagattacatagaccccgggtgtacatatttatacccatgggttgatacaagtccttgttggaccaaaaagaaactttcataaagataaaaggaaaagataaagtctttataggacactaaacacactttcctaaagataaaaggaaactaacaaactattcctaattaatagataacttgccatgccgcattctctttgaactcggtctcttctggataagcttcctttagtatatcaatttccttaaccgaatatagcaagaatccgacaactgacgacttgacaactctcatcagctaatctcaagacttcgaagccgatgactactccgggcttaccaaatttcactgttaacaaaaagcagcatatcatgatcataatgtttagcagaatttgaacttatacgctaactacgttcaaggaggttttaaatgtcttccatttgtcaaatttctcttagtgagttagtggtaggatttagcgtcggaaaccatgaaagatgtacttcttttcctttgtgttgtgaaacatgtacatgttcttttcctttgtgttgttttttatgtgtgaacctctttgatctcaatgcaataatgatacacattcccaaaaaataagccatgaaacctataatcttcataaaactacacttttttttttgcgaggaactacactatttcttttagaaccactctaatactatctgagataataagccagtagttgggttcaatgtatgtcagatctggcaaatgaaatatggctccaccatgggagaaacaatgatcgtgggcattgaaatcctgtaacacggattgcaacatctcaccatgggagttcatggccttgtcccttgccagctagctacttcgtgtttggtactactgaaaaatctgaaactaagttgcatatctccctatcacatatctcccctgtaaatacattgccattgacacaaaccatcaccaattcaccaaaaacaacctgacatttcctctctttttttccctgatcacttccttggaaagcaaagcaaaattaagcaatcatgatcagctccaagaagctagttcagctttccaagaagtggcagggaatgggtgccatcgggaggaagagggtgacggcatcggagaaggagatcatccaccactcatcctgcagctcatccgtcgccgggaagggcaactgcgtcgtctactcgtgcgacgggaggcggttcgagatcccgctggcgtacctccgcacgccggtgttcgtggagctcctgaggatgtcacaggaggagtttgggttcagcagcgatggtaggatcacactgccgtgcgacgccgcggtgatggagtatgtcatgtgtttgctcgggagagaggcctcggaggaggttgagaaggctctcctcagttccattgtgatgccctgcagccaccacccaagcaggatggcgcagcaccagcattttgctgtatgcagcatctgaagtctgaagaatcacacagcatctgaagtctgaagaagagctccagggatattcagcttgttcttcctctttttttccatcttttttcccaaatgtacctttggagcacagtttttttgtgcaatgtttttccaaggtactgcgggtgtacagatggagcatgtaaaaataatcacagcattgtgattagaaaagaggatcaggctaaatttccatgcagtggaataataatggagttgtgttgtgttaagatctttgcttttccagactaaaacacgcagcttttaatataccttccctatttatggttatttgtcagtaaggtttagcttatgtcgtgttttaaaagtctttagccaaatgagtataattgtttcgggagtgacatgtttatggagggatgaacacctatgtttatggagtgacatatcagtatatcacatgttaatctatcttacttttctattaaaaaaatgatattttaagcgacatgtaaacacgatagaacatctccttgagagatgaatggactttccctatatgaaacaatactaagtctgtgttcgtttggtgtgttgggaacaaatatcttttgcacgaaaaacgcaatagtctattagtatgtaattaataaagtatttattatttttttaaaaaaggatcaatataattttttagagcaactttcgcatagaattgttttgcaaaaagcgcatcgtttaacagtttaaaaaatatgtgcacggaaaacgagggatgtgagttaggaaagttggggaaagaactcagccaagatgttaacatttgttgatagtcaaatttagcactagatcaaatttggacttaaaaaatcttggagatgtccacatatggtaagaaaaaaaaagttagctctaagaaattctagtcgcagaaatctaaatatacacaagctgttgtgtcatgtgtgtaataacctattaataatcttacaacaataattcttatgacgtctgcgtgtcattgcttgatcactaccgtgtgctgctgcatgacgagcaccgagcccatctccagcgagtcgttggacgcgaggatctccgccgcggggcccatctcgccgccggcgtccgcccaccgttccagcccggccaagagctccggcggctgcctccctccccggccgacgatgaccagcgagaacatcccggccatcccggccagcgtctcctccacgtcggcgggcctctccacgaccttctccacgtacatggccatctccgtcgccgcgtaccttttttcacgaacacacaaaatgattgtacgtcaatatactaaaagaatagagtttttgttacacgacgtcctcagccagaccggccctcgccgcgtacctctcgtagaacctccacaggaagcgctcgtcgacgtccccctcctggaacgccatgtccagctcgtcgaccttggcggaggtgacgctgtcgtacgtgctgcgcttcacgaagcggaacaccgtgaggccgatggacgggtgctcggcgaggcgggaggcgagcgacacggcctcgcggtcgtcggcgccgccgaagaacacggcggcgacgacgtgcgtcaccgccctgtcgctgcacgggtggaggagcgtcctgccgccgccgctcgtggccgccgcctccgccgccacgctgctgggcacgttgaagctggtgccgctgttccggtaggggcggtcgacgaggagccccacggtgcacggcgcccgcgacagcacgccgtggttcagctcccgccgcccgccgaggcggcaccacatcttgccgtcgtagcgctgctccttgtggcagggggcgaggaggaggcgggcgtggacgccctccgccgcgcggcagacggcgccggcgtcgtccagggccgcgccgccgcggcacaccacgtcgatctggcggaaccagatgcccgtggcgcgggagaagaggtcgacgatcgtgttcatccgcgtgacggcgtcgcggccgccgccgcgttcgtctcgtcctccgccgtcgtcgtcgtcacggattcgctggtggtacgggatccggacgacgcgctcttcgccgacgtcgaacaggtggaggacatggacggcgggctgctcctgcggctcgctcaccaggagctccaccaagctgagcatgcccggcgcggcgtgcgcgctgtgcacgcaggcgagcatgtggagctcctgctccgcgcccaacgactccatggcctggtgcctcgtcctgtacgcctcctcctccttccgccgcaccaccgccaccaccggaccggcgacgagggtgctgatcaagttgccgatgatcatcgcgtacagcgcttgctccgcccacacctgcgccgcgcaaacaaataatccggaattccgatgagttgctccattgccgacgttgtcatggcgcatcaagtgttcgaccggttacctaccccttctgatttggcgaacttcatgttcatggtgtcgacgtggcccttgatgttgaggaggacgctgaagcggagcgcgtcggagagcggcatgctgaggtaggaggcgacggcggcggcgccaatggccttgccgaaaaggccgagcagcgtaatgagcacgccgggcacgatgatggcgcccgacatggagttgaagttcatcctcatgccgatcgtcgcgaagtagaagggcagcatgatgcccttcaccggcggcgcgagcgcgtcggcgacggacctcgccgcggcgccttcccgcgggaacgccagccccagcgcgaagctcgtcggcatgccgtcgaagccgaggaactgcgggatgttgccgacgaaccagatggccaggagcatgaccgccaggtcgcggacgccgacgtggtgctggccgacgttgcgcttgttgatccgcgtcacggcggggcgcaccatccacaccgcgccggcggccacggcgagcgccaggaagcctttcctgatctggtgctcgccgcgggcgacgccctcgatcttgcccttggcgcgggtggtggacgacaggacgccgtcgccgaggatgcagatgaggttggtggcgatcccggcggcgacgacgaggcggccgttctcggtgacggtgagcttgagctcggcggcgatccgcgcgacggctatggaggaggtgttggtgagcgccagcatgagggtggcggcgagcagctcgggcgtcttgaccggggagtgcatcatgctgccgtacatgccgctggagacgacggcggcgaggagcaggctggcggcgacggtggcgtaggtgaaggcgacgcagcggtgcgtggcgtgacgcagcgcggcgatgtccatgtcgaggccgacgaggaacatgtacaggatgcgcgccgcggagatgtagccaccgtacatgtcctccacgttgtccacgtcgacgtgcacgatggcgctgcggagccccatgccgccgaccacaacgccggcctggacacacacgatccgatcgattatgaattcaagaaatgtactaggaggatcaatgagccgagagagtattacgtacgaggatctgggagatgacgctgggctggttgtagcggcggaggaagaggtggaagaacttggagacgaggatgacggcgagggcctggatggcgacgaggaagagcgtgtcgagggcgatgccggggatgggggagagagcgagggggtcgatatgggagcaaatgtagtaggatcttgccatcttgcttgcatatatgccccggccgatcggcagccggccgcaccgccgccgaggaagaaggctacggcgatcgccggctcgccgtttgatcgctcggcaaacttagttccggcctcctgcaggtgtgtgcagtgtgtttacgtgctagctagctagctgcgccggccgcgtgttcatgcatgcacgatagatgcatcatgcaaaaggtagaaattggagggacggccatgagtctcgtggtggcggtggccggggagacgatgcctcgccccggaataggcaggtggctttcgcatcatgctccgcctggctccatccgcgcgcgactgttgtctgttgcattgcaatgagccatcttcttggagttgggctgagcagtgagctagtgaccaaggtgaaaactccattcatccctcaaggttatcccctcatttttacatgccacttaaaaaatcatcaaatttttttaaaaaaatttagtaagatagatcaatatgagatatgttgctttcacaaacatgtaaattcaaattcaacttatacaagtagaaaaaaaacaataaatttgactatgaatagaacgcgtaattcacggtcaaatttatttttttccaattgtataagtcgaattttaactcgcatgtttgcaataagatatattatatattaatctatcttgataaatttttaaaattttttgatagctttttaatgacaggcacaaaatgagaggatgtcccctcgagggacaaaaatccacttcccagccaagcgtaaattaaggagaagatgatgaaccgcgagacataggcacatccattcatcctctttgagacaagattaccaatggggaattggggatactactcatcgcccaccgcggcggcaccgtagcatggacgagggcgcggagctcttctccgattctcctggcgagaaatttaggattataccatcgtaaaagagtggtttcgctggattgccatcgcttcaaactgattcattgtaatgtcacactaaattgagatgtgtttaccaaaatgccattttagttcttttttgtgaatagaaagtttttgctcaattttatttttttcccgaccaaaatacccctgacgtgggcccatccgtcatgctctctcccacctctccctctctcccgagacctctcctctcaaggacgccgtcggctcgcgggcgtggcgggcagtggccggtggcggcggcgggcgtggcggggaggtgggcgtctagccgtctagcggcggcggcggctgcggctgcggcatgcccctcgcaggcggcgatgtgcaattgtgcatcgccgtgcggccgtcggagtcgcggaagttggggtctgctccgccgcaccggcgacgatgctcgctcgccgtggcccttggcggatgcagatgaggggaacccgttgcctcgcgggtgtaagtacgtgtccccctcctccatcccccctcccttcctcattcgcgttcccagggctcacaccctctttcatccaaccagtccgggggtcataggtcttactcggagctaggagagagagattcctcgatctatgacttgtgtgctagcaatgccagccagggagtagtttactgaatctgagccccatcgagtcccagtcgatccatcgcacaaatttcattctgattttacatgtcatatttaggcaatgggagttctcaactatgatggtgtgattgagatttttatcatactttgctatgaattgtcggcttcggctaatatagttagaaaacagtttgaccctatgaggagcgaatgaattttcctaaaaatccattattctggggctcatgatttttgtggactttactatgatggtgtgattgagatttttatcatactttgctatgaattgtcggcttcggctaatatagttcgaaaacagtttgaccctatgaggagcgaatgtattttcctaaaaatccattattctcgggctcatgatttttgtggactttagattgactctaatcttgggctaaaagctgagttcaggaatggaatgatccttttgtttcttagagtaagtcactttggtgcatttttctcagctgattgcttagtcatgactcgagttctgtaggttgtccactaagttatagataaatcccacagattctacttgaattgatccattacttgagaatgatttgtgcggtattattcaataattttttgttcatttcactatttttatttgttccaaactttgcaacagtgctatttttccatgatttgtctcacaacatgtaagaagtgatttgtacatcatgtctcacatcacatgtttgttaatatatgttcttttgttaataaaaaagagtaagacttggggtgatttttcacactctatgtcaagtatgtccaacaagttctttatgctgtgttttttcatgaaacaagaaaaaaaaatcaataactcaataagtacctagcatattcctcccttatgttaagttggattatcatttttcaactgtagtttgctttgcatgtattattcttcccttcacatggagatgttatccaacttaaaattttctgaagttcagttggctgatgacaaacttgtctatgctgctggttttgctatgctgttagtcatcaagaattagtgaagccaacatctgatagagtaacattgttccatgtgttgttaactt

SEQ ID NO: 40372 - DNA, 2392 bp, Oryza sativa
  unsure (1)..(2392): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgattaatagtcatggaggcagactggaggtttgagatttgacaaggataccgtgtgcatatgactttgacgctcttggttaaattcagctggttgagtattgggcacatatagtcatttgctaattagttgtatacaaaaataatctcaattattttgttgggacgccaatactgatattagatagcaatctgtcatactatctatgctcctttactttcagctttagaaattgatatgatctgtagcacacaccttcgaccatcattttttctcaatcaagatttcaagtataattatacgaagaagttacatgaaaaattaaaaatctagtaatctcattttgaaataacaaatccaaacagtttgatgcatattagtggtcaaagctttatgagtttgatccataaaagaaacagagggagtgatgtatcactatgcatcttgtaataattaataaatgcatgcatgcatacatcatgttttttgttcatatacatagtaaacatactacaagttaagtgctcatacgatctttagaaacacaaatgcactgcttctaaagcataccaagagattgatatgtaactacacactgctacatacacgatgcacacactaactgcatgcaatttggtttttgagaagcattgtggcaccactgctcattaccatgaagttttgctttacctatattccgtttttcctggatgcttctaaacttaatcaaaaggaattcactcatgggttcatgcccaggaatgcatgcagatagcattttctagcatagcaggaggcagatggatcaacatatgagatgccctatatgcaagcttataagcgtgctacaatatatcatatcatatcatgagatatccatgcaagtaggcgtacctgttaccaagcttggcatggaggtccacaacaagctgctcctcgtctgcggtgaggaggccacgcttgaggtcagggcggagatagttggtccaccgcaaccggcagctcttgccacagcgcagcagccctgccaacttaggcactgctcgccagcagcagcggccatgtgtcaggatgaaactgatgagcttcttgtcctcctctgccgtccatggccccctcttcaccttcttcttgtcacagcacggctgcctccccatttgctagttactgcagacttgcaccagatagatggaatcctgtataaaatgaacacttataaatttctagtgcttgcacatgtccagtgagctgcaaaactcctgtgcacaagcgtcagatgaaagggtggtgacagctctgttgcaactgcaattggtgtctgtgcttgcatatttataggtcagctcctcacttcctcagtttctcgaaaaaaatgtgtctttcatgaattttgtgtggtggtgatgatgatttggcttaatttagtgtgcttagaaagcaaggcctcaatccgtgctacagtagacttgcacccaaaaatccacatatatgcattgctgcaacgtggtgcatctacagtttagttgttgatcgaatttacaaattaagtataaaaaatatgtactattttattagcacagcagcaatttggtcgcacatgatgctacaggaaactcagatgtgattttctctggaatgaagttgcattttaactagtatttttaaagcttttgctgctttcatttcccacaaggctacacatttatgctgcctttgctacccacctatgtagccatttcgtcatcagctgtgaactatagctaactgctaaccaaagtaccaaaccatttgaggagcccccctaacttcatgtgattgctgtgagctgtaactcatcgtatggaccagaataatgactttgagcacatggtggtgtatattttgctacagtaatatgtagaaaaataatcacgatcagtgactccagtggtgaaaattgtcatacaagatacaggcaatttaggatgtcatagcactgaatttcatgacatcagctttcagtaggcaagaactcaaccaagtgatttcttctggcatacatgtacaggtgcaaattgtttttctagggcttgttcggttaataccgaagaggaagggattggaggggattaattccacacctcaataggtgtggaacaaatcccctctaattccccttcaatccccttctaagagggattaactgagcaaagccttaaggaaccaatgctaagtctgttggggaaaaaaattacaagtatacctggggctggg

SEQ ID NO: 40373 - DNA, 5063 bp, Oryza sativa
catatcaacttgatatatgttaaactgagtatttatctagtttgacaccttgctatagctaagattgggaggagagaataacttagattacggcagcggttggagaaacaatcggtgaattgagtcagccgtcgatagacggcctcacatcaaaagagcaacatagttggcagtattattttctgccagtgttgtttatctgttgcaatcgttgtccaatggtgtaaatttgatggcaagagaaaatgtgcgactctcatgtcaagattttagctcagctttactgaagatatagaacaatatgttattcatataaaatcggaaaatttatgttctttctgagaaaaaaggttgggaaaattccatcctgtctgtagcaaaagctatgtaagctccccccttcctttccttcttgaaagattaaacaactcttccttacagccgagctagcttatggtatcccgacggtaagcgcaataaccacggtgactgtcacaagctatgaaaaaccggaaaaagaaataatcaagaaattcaaaactgtttaaaattgtttaaatttggtgggattatcacgcggttagcattaaccggcgcccggcggcattgtcaatcctgttgaagccaacttctgtttttgccgatacaaggcatccacagttccataccattgtgtttctcccttgcacacgtctctgtcatggtgtcattcacccaaccacccgaaaaccatttgcccattcaggtcttgcgtggaacattgacaccatatattagagtagagatgccttcaccgtgaatccttcacctgcatatgttgctcatgctgaagaaagaaaaggtacaacaaattgcgatcgagacgcagctcgcaatcgccgtagaaaaacctgtggcacacctcccctgttggtggtaatcgcctaatcaatgctccgttgaaacaattgctcgctgcagctagcagaaattgactcctccctacacggaccgctgcacccgtcgcccgggcatcataggagaagtttctgaattcgctttcactcgcctcatgtcatgaggggctctctctccatttctgcacttgtgtttggtcttgtttagctggggaaaatttctatgtttgtttgtcgcatcggatatacggacacacatttgaagtattaaacatagtataataataaaacaaaaaacaaattacagattcccagcaggcagcataggagaagtttctgacttcgctttcacttgcctcgggtgtgtttagtttacgctaaaattggaagtttggttgaaattggaacgatgtgatggaaaagttgaaagtttgtgtgtgtagtaaagttttgatgtaatggaaaagttggaagtttaaaggaatagtttggaactaaactcggccctcatgtcatgagctgctctctctctctctatttctgcacttgtgcttgtgtgtagctgagagcatcagacagagacacaggaagaagagggatgtagaagaagcttagccgttaagagagagagcgaggcaaggaaagaattaaggaagagagaaaggagaggagaaatgctggaggcgtacgtagctagccccaaccactctggccgcgcgttgccatcaacgctcccgcgtggtcacccgtttctgcagcggcacgtctgaccttatggctttaagctcacgggggtgccggtggctgtggatggactcgttcctccaaccacctggtgcgccaccccgatagagggactgtgttagtactccctctccattaagcaaacgtagtacatggcgtgatatattaagtatctggacaagagcacatcccgtattagattcgtttattttaaggtgaagaaagtaggcccttcaaagtgccttttggcttacgggttaagggcccatttgaatcgtaggaatgaaaaaaaaacagagaaataagaaaaatacaggattctgataggaatacaattgtaaaacagagaattgcaaaacacaggaaaaatacaggaatggccgttttgattggaccacaggaaaaaagcaggaatcagatgaaagagatagactcagaggaaatgttccaagaggttagacctcttgctaactttcctccaaaatgtgcataggattacccattccatacgaattttaaaggaacgaattttaaaggattggatatgattcaatcctttgtttcaaaggccttcataggatttttttttctataggattgaaatcctccaaaaatcctatatttttcctacaaatcaaaggagccctaaatgctgaagagatgatagattatctgattttatgatagtatatttgagagtgtaaacgaatgaattaactgttacgaagttgaaagttatttatttttttaaaaaaaaccattctaacaaatttatgcagagaacttttgtagaaaccgtactgtttagaatattggggagactgtctgtcagtctgtgatactaatatgcaaggaaaaagaagtgcccgtacggttttttcattaaaaaaattcttaacatttttaagaaaagtagtaagatcagtgtttaaggctttaagcttgcgtggcagcctgtcaggcaagcggtgcatggctgagctggcaagccaagtgcatatgcttcatatcatatcatctcatgcgtaccctttccctcggctaatccttgtgaattatacacgcgcttgattcattaattcatatgtgtcgtgtactactaatcaccattcaccaagcaagcatatttatatgctaacaagattttttttagagacgtacccaacatccacaaagctagctagctagatcctcctcttctctgcactctgctagagcaagctcgatcgatcgatcagtgatatttccccttatccaaatccagcacaaaccaacaatatccatggaggccgtagcagtgcacgccagcttctcgtcctactcccctccggtggtcgccggcggccgcgacgacgccggcagcagcagcagcagcaggagcatgtcccgcctgccggctcgcgtcgccggcgccgtagctcgcggcatcgtcaccttcgtcttcgccacaggtaggtggtggtggtttcttgcttctttttgtttgcctcgattaattcgagctcgatctgtttcatggaagtaattaacttgagtaattgatcgattggttgacagtgggcacgatcctgggggcgatcaccggcgggctgatcgggctggcgacggagagcggcatggtgcggggcaccgggatcggggccatctccggcgcggtggtcgccatggaggtcgtcgactcctccgtcgccatgtggtgctcccacgactccgggatctggagcgttctctacgtcgtacgtttactaatctcctgccaaaatctgcatcccctactgcaattacagttccatctcgcagctgagacgatgaatttgcattcattcttattactaatccaacttatcgtaccaattagcaatccaattaagtttatttgctgtactaaaaaaagatatgattaagctttccttgttctactaattgatagtaccaatttgcaagctaattaagctttttgcttgcttgctctaccaaatttgggagctaattaagtttggttgtgtttgtgtgttcagcttgacgtgatctggagcctcctgacggggcggctggtgcgggagaaggtggatccggcggtgcagaacgcggtggacagccagatgaacgccgccgacgcgcccttcagggagagcgcgccgacgctggcggagatgttcgacaccggcatccccggcgtcgccgccgccgccacgggcatgccggcggacgccatcgccgcgctcccggtcaccacgttcgccgccgccgccggcggcgacgaccgcgccggctgctccgtgtgcctccaggacttggaggacggcgagcgggcgcggaggctgccggagtgcggccacacgttccacctccgctgcatcgacagctggctgctcaggcacgcgtcgtgccccctgtgccggcgcacggtggtcgccgccgccgtcgccgtcgacgacgtcgtcgtcggctgagctggcgcgagctcgcatctggttggctcgttcgtggttaattaggcttaagctagaagattagtgagaagggcgtgcagtgcacggcacgccgccggcgacggcgtgaggatcacgactgacgtgcgtgtgtgtacctactacctcaccttcttttgataccttgattcgttttggcgtagtacatatgtgtagcggatacttgcattatactagtatatacacacacacttgtatgtattgtagatttatatacttgtacatggagaccttgtgattaacataatagagagatccagattttgtctctatcttagttattaatttcatcactaattttgggcctattcagattactaccaaaatcaacctccaaaatttggcaatgctgaattttttataaatttatagaattgccaatttttgataggatggaacaaatatgttgtgccaaaattttctttacaaatatttggtaaaattaaatgcaaccatatatttgtcaactttaccaaaacaatgatatagttaaaatgacaccaatctaaacacacgcttgttcttatgcaagatgcatattgtggtttgctatttgttttaagacaagtcataatcgatcattgaagacagttcagaagaataataatccttagtgcaatgctaaacagagtaactggaagcactgaaccatccttttccaaatgaaaggctaagggaactaagggagtgtttgaggagaaggggattgaggagattgggaagatacgcaaaacgaggtgagccattagctcataattaattgagtattaactattttaaattccaaaaatggattaatatgattttttaaagcaactttcctattgaaattttttgcaaaaaacgcaccgtttagtagtttgaaaagcgtgcgcgcggaaaacgagagccaatctcccctatcacccctaaacgaacgatgcctaaggaa

SEQ ID NO: 40374 - DNA, 4689 bp, Oryza sativa
gtttattgttgagttacagattttggtgtgaacttcattgaactcaaaggatttttaagagttcttctgcgagatatgtgttgtggtttgctcgctggagtacttttttaaagacaagtctcaatcacaaaatctcaatttactagagtacttattgtaagaagacagagtttagaagaataatcttagtagctgaaagtattgaaccactttttttcaaaagaaaagcttaactgaactaggaaaatatacttcctaatgaaatctaacaatagaaaaaaaagaatatcgatagggagctgcggcgttgtcacaataataacatctgtaagtctattttaatgcgcacactgcttcacaaactagtgatcgctttcgtctgcctctataaaaatagcataattcaaaggtttgttgttgagttcattattgaatctgagaagcactaactacaatcctaccaactagagctacagaggtgatatgtgctcaacccaaacggcgaacggtttaagttcgaaagccctcctcctcaagaggataccggtttcctgattcctatgaggtcacctacataaagggccatagttgaaagcccatcaattgatttcagcgttaggcccactcacatcgccgggtggtgggccgtgtaccatatgatccgcaggcttctctgggggcttcttctttctggcttaattgacttggttgggctaattgatgggcctcaattccatcccatttatgtacatgggctgagatttcttttagcttaatttcttgctcacaagagcagagattaaaatccatccgactccaaaagaaaaaaaaaaactgggagagatcggctgtagtgatagatgatcagctagcagctatagctcttgattgatatcaccaccatgatggaatgcttctaaccacaagctgtactaaaataactttcaagagaaatgtcatttgcatgtcgcagttggttggttggtcggtcggttgatcgtgtgagaacgcagtcatgatcgactgctgctactgtttggcttggggacgcacagtcaatgctgcatgaagcacgtgatgtgacgctgacactcatcagtcatcactcatccaaccttccgccagtctgtcccttctcttcactgttaacgttgtctaatgactcctggctccttttgttttaaatatagtaatctaatattatcatttcgtttttaatataatccgggtaaacatcagatttaatttcaataaaattaggattaattgtgatactgttatctcttcctcacatgaaacatatgcatggaaataaagacattaagggcttggcaatttggtaatattgtcaaaattttgataggatttcggatattctgatgtaattaaactaaatggatgtatatatttgacaactctaacaaaaaaaaatggtatggtttgaaatgacatcaatctgaacaagccctaaacctccaaaggtgaagatttccccatatatcttataagtgaaaacgctcctcacaagtttaaggaaaaccaagtaaaaaccaataactttttatccgtataaataccatctaaaaatcccctaaaagaacaagctactcccattgatttttacagacggtctcggtggttttgtaaacattagaggatctccaaatcaccaaatgtacgtaccagctgctgcgtgcatcggtccaccgaggtggtcacgtcgccgtcgtcgttcgtcgtcaaatttttgtggtagtgtcgtagtagctgccacacgagaaccatgtcgtgattaaacaataaatactgacagtccttgctatatctagctacttctctaattaattaatcagcctgcgccgatattgttcttttcaaaattcgattttaaattcagtcatcaacagcgctccagctggttttaatttcaagtaggtgaagttgtacttgacgtgttgtatataatactctcgtttggtaatcgaacagtacgtacatagcaaacgtgatatctgacaatgacagtcgcaactatataattaacgattactcctcgatcgaattattcacaaattaaatcgatcaacgcaatattgataagagatcgcgacgaccgtggcaactggcaagtggcaacccacttatatattgaccgtgtgctagatacgcactattaacgatcacactattgtgatgcgaccagagtttatagaaccatataattatcacgtagttatatttacgataaccttctcggttttaaaattatggtatacctcataataatcgcatatttttcacggtaaccaccaaatcgtgaggtgataaacatgtttttttttcttattaagttatttttagataattaatggataaaatctgacattggcttcaacaaaagctacaactactcgttacaaaattgtcgctcatcatgaccaataacaaaagaaagtggagtacgtagctaacaaagggtaaagagaagacaaatataaatccatattggtcacagttcagcaatcctcctagctaatgaatctctatccaaaataatatattaattcatattagtcataactaataactttgccttacacgtgtgcaatataactagtatgtgtatgaagtggtcatatacatcgatcttctaatgaaaaagaaatgtagattaatttgcattatttaaaaaaaataattatgaaaaatgaatcgggcaagatgcaatggtccattgtatgtattaagtttgagagttattgcaccagtgtcttctagacccagttgctatatagtaggagccaactcatatcgatcgtcgcgtcaaacctctccatcggtcgattcagagagagatcgagatcagcgtgagagagagagagagaatgagcagtacgagtggatctgcatgggatcacagcaacaatggaggcggcgggtcgccggagttgagggaggcgctgctgctgggtgacggcgggtcgtcgccggagtcgagggagattaaggggattgctgtgaagaagcaggatgacctggaggagatccggagcgtgggggagctgatgcggctggcggcggaggagaaccggcggctgtggtacctggccggtccggccatcttcacgtcgctggcgcagtactcgctcggcgccgtcacgcaggtgttcgccggacacctcaccacgctcgagctcgacgccgtctccaccgagaacatggtcatcgccggcctcgccttcgggatcatggttagtcactcactagctagtactccctccgtttcataatataagacacaactatattttttatatgttacataatataaggtatgcatgcatgcatacaattaattagaacctcttctccattaaactattatttttttaaattctccatcctcaatatctctaattctattggatacatgcattatatttattagagtgattcaaactaggagataataataattatttcttggtctttgggttaagagcggttatgccttatattttaaaacggagggagtagggagtagctggctggctacttccttaatagttactccagttacttccattcatctattcctacttacctaccacctccgtcaaaaaaaaatattaaatatgatacattctaatacttttatatatatatatatatatatattaaatttatagtactaagatgtaccaaatttaatattgattaattttttagatagagcgaagtgaggggagtataatataattaccctcgttcaccgatcgatcgtgtgtattactatctccatctcaaaagtactgtcctttttttaatttgtgtaaaaatttactgtctttttaactatcaacttgactacagtacacttttcgagagaccttggaagtacagtagttaattttgcttgattagcttcccaattttttcttcattatgtctaaactttatcttaatcacaggattgagttgtacatttttgcgcttatgtcagttatttggatccaaagttttattaaatcttagtctaacttccttgtaattagttaaaacttgttttcttaagacaaattttaattttcttcatccaaattaacaatcactgcaaatattttttatacgaaagttatttttaaaaaatcatattaacccatttaaaaaaatagcatatatttaattaattacacgctaatgaatcactccatttatgtgcgcgagagattggatcccaaacttcaacatacgaacttaggggtgaaaacggtacggaaacggacggaaacaaactttatcgttttcgttttcatatttttttcggaatcggaatcggaaacaaaaacggaaacgaatagtatcgaaaccgaaaacggagcgaaaacgaaccagcgcggatacggtaacaaaaatttatcggaatacaataacccctcaaactgagcttcaaacttttgtcaagtccaattcgcaagtctcaacagtcaacaattcatcataaaacacaattatatcaagtctaattgtttagtctcaacagcaaaaatatattcttctataacttcatataatttgcataacaaatattctaaaagaatacagcaaaacagaatggtataagtctataaggtatacacaattcaggtgctatactgctatcagcctatcactccagccaatgggttt

SEQ ID NO: 40375 - DNA, 7102 bp, Oryza sativa
gagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcggtgaggaagagactgcagtggtggtgtcgtcgtcgcctcgtcggtgtggtggttgttccgtcgtcggcggcggtggtggcgatggtgaaacggcgagacgcggtgggacggcgccttgagatggcggggaccgagcaggccggcggaggtgcgagatggtggcggcggccggcggcgaaacaacgaagagcaagggcggcgcgaggacggcgggggccagccagccaggcgaccagcggtaggcgcgagggcgcgccggcgccgtgcgagatggtggcggcggccggcggcgaaacgacgaagagcaagggcggcgcgagatggtgggggcgaggacggcgggggccagccggccaggcgaccagcatagggcggtggggggccggcgccacgggcggtgggcgtgagggcacgctggcgccgcgatgccgcgatctggacgccgcagccgccgctccgcctccaactcgcgagtcgcgtctgagttctgagtctgacggtctctctcctatagggttagccggttagggtagatgccgccgcgatttgggttgggctgggaagctagggatgaattatggactattgaatctatgggctttttaacttcggaaattccgacaatttttctggaatgtttccgatcgtttccgggttccgacggaaactgctattatcatattcgattccgtttccgagaaaatatttccgttttcgattccgattccgagaaattccgaaaaaattccgactggccgattcggtttccgaaaacatgaccggaatccggaaaattccgtactgttttcacccctaatacgaacacagcgatagttgcagtagagagttaagtgcacatgtcttttttattaattccttgttttctccatcacctgcgcaacatttttttattacatggacgcgtatgcacacactactgtacacacaacaccatatgcacacactcgcacatgatttatatatgtttatgtatcacttttgacccttctagtagtatgtcttttttatttataaatcatgtgcctactacccagattaggaggatcgaattcaacttaagaacgaatggaaggctatgtaactttaattttggacatatttaaattagttttaactaaaatttcaaaagtatgttagaagattttttttgggaaatcttgcttgaatttctgacctccacttgaagattcccgcaacacgtgttacccgttctctaagagccagattattataagtcggattataataagccgatatagaataagttgttagatgtttatttctctaaattgttagctgtttgttagttgttagccaccaaataatctaaaaaagcacctttcgaatggattatcagactatagtaatatggtttataaattgtaataatctatcataataatctatctgtttgttttagcttactcctaaaaatgtgttgtgtgtgtatgaatgtgtgcggtgcagtacgggatggggagcgcgctggagacgctatgcgggcaagcttttggcgcgaagcagcatcacatgctgggcatctacttgcagcgctcatgggtgatcctcaccgccatgagcgtcatcctcctccccatctacctcttcgccaccccgatcctccgcttcttccaccaggacgacgagatcgccgtcctcgccagccgcttctccctctacatgatcccccagctcttcgcctacgccctcaacttccccatccagaagttcctccaggcccagagcaaggtcatggccatggcggccgtctccgcggcggtgctgctgttccacgtcgcgctcacgtggcttctcctcgtgccgctccggatgggcctcgtcggcctcgccgtcgcgctcaacgtgtcgtggtggctcgtcgtgctcggccagctcgcctacatcgtcatgggctactgccctggagcttggaacgggttcgactggctcgcgttcaccgacctcctcagcttcgcccgcctctccctcggctccgccatcatgatctgcctcgagttctggttctacatgttcctcatcgtcattgtcggtaacctccccaatgcccaggtcgccgtcgccgccgtctccatctggttagtgaaaactcaaatcatcccttagagggatatctctttatttttgtgtcactaaaaagtcataaaaaaattgaaaaaaatagtaggatatatcaacatgtgatatatcaattcacaaatatgcaaattcaaattcaatttatacaagtagaaacaaaaataacaaatttgactataaagtgaacgtgtaattcacagttaaatttattatttttgtttcgaattgtataagtcgaattttaactcgcatgtttgtgaaagatatatcatatattgatctatcttgataatttttaaataattttttgataattttttgaacggcatgcacaaaatgagagaataaccccttagggacaaaaacccacactaatcagtaatcactcatcgtcttcactgttttatgctcggatcgtagctgatgtcgatctcgatctgtttgcattttgcagcacgaacctgtttgggtggcagatcatggtgttcttcgggttcaacgcggcgatcagcgtgagggtgtcgaacgagctgggcgcggggcggccgcgggcggcgaggctcgcgatcgcggtggtgctcgtgtcctcggtcgccatcggcgtcgccttcttcgcggcggtgctgctgctccgcgacgtgtacggcgcgccgttcacgggcagcccggaggtggtgcgcgcggtggcgagcctgggcgtggtgttcgccttctcgctcctcctcaacagcgtccagccggtgctctccggcgtggccgtcggcgccgggtggcagtggctggtggcgtacatcaacctgggctgctactactgcgtcggcatccccgtcggctacgccatcgcgttcccgctccgccgcggcgtgcaggggatgtggggcgggatgctcactggcgtcgggctgcagacggcgatcctggtggcgatcacggcgcgcaccaactggaacaaggaggccagcgaggcgcacgccaggatccagcactggggtggcacggccaagctcgccgtcgacgaccccatctagttaagcgacagcgagcttcatcatccatccatggcgtaagaatttgtaatgtacctgcacaatgcaagtacatgtacatcctgttgtcggatttggtttgagattcgtgcgcgtagcatggattgcaataagaaaatgcagatgtgttgatatgtcgtggttttgtgtatccgagaatgtcaatccacgatgcaattatgcagtgtatgtgcaccttgttgtttgtttggatttgattggagattcgtgcgcgtgtagaatagataaatatcatgaataaagcatgatattatatactagtatctccatttcatacaatttttttctaaatcaagtttatagaaaaacataacaatattttcaacataaaacaaataatgttataagtgttactgtttttttaaaaataatggtcaaacatttaaaaattgactttaaaaaagttaaaacgaattataatattaaacggagtgggtaaaaagaaatgcagttgcgttgatattgtggttctgtgttttggcagtttggtctcagattctgtttgtcaatggcaatggaacttgggcaatggatgtgtatgatgtaacgcaagcaacattcgttctccagtgacttactcacggaaaattttttttgacagaattggcttttggtgctactatataaataaaactaaaataagtaaagatatttccgtgctataagaccatttttttttccattggattttgatgaaataagacaaaatgacacttgcatgaagaggtaggagagcaaactgaggcccctatcgtttagccaagtacggataatagcaaaataataatatttataggtaagatttttatttatacgttcttagtgatttagatgccaatactgaaaaataaactttaaataaaagattttaaattttggcaacgagcgatgctgtatggaggaagcgatgggcctgaatcctaagccgtctaggatgaacaagcccagtttaaaaccaacacggccctcacacagacggcccagctcagcccagcaaaatataaaacaaagaaaatacaggaaacacaacgaaaagcagaggagaggtagcccaagctcggaagggaaggggagcgaccttcttgaggcagaagtcacgaaccaaccagcgccgccgccgcgatgacggacgtgcagatgagcgactccgagccgcaggcggcgcctcccgcggcgccggcggcctccgccctccaccgtaagcggtcctcccccatcccccagaaaccctcgggtggaattcctcagatttgtttctgatgtggttgcgcgctgttcgtcccagatctgaaggagatcgcctcggtgatcgaggccggctcgctgtccaaggaggtgcgccggatctcccgcgccgtccgcctcaccgtcgccctccgccgccgcctcgccgcccgcgacgtctccgccttcctcgccttcgcgctcccgccttcctccgaggcctacacccgcctcacctccctcgtccccaaggtgaattacttctcatgcgttcttcttctgttactagtataactcagcgtaagagcaacttaatattccatgtgatgcaactaaactatcagtgtttagatatagttgttggcatggataaacttactagacatgcttgcatgatgtgtgtgattctggaaagtttcccgttggtaagtaggtacctctgacaaaatttccagcactgagatatttgcattgagttggtttaatttaacatagtgatcagtaattctgtgtggatctgggttttctatggcaaaactggaatttccaaaccttggtacctgtgatgctaactgtggatatttgatttatcatcactgcattatcaaccgctctgtagttattttggaattctttctttaaataagctaatcatatggttaaaattttaaattaactggtaaacaggaattttgggtgggtgtggtcttatttttgttgttatcaaaactggaattattccattggtactactgatgtaattcatagatgcttgttatttgatttatcactgtggtgtttgactttctcatggctgttttggatcgcctgtgtctgtcattccatgattagcaacctaaatcgctgaacatatagcatgggtcattttctttcatctcttgataggaagcacttgcaaatagaggttaagtgagctccttcactgcgcacttcgactttcaaaaagatcatattttcatgtatcgtatatttgcaacgttgttcattatcgttatgttatttctgcatgtttatgctgaaatctatttttagaacatattagaaagctattcctagaagtctagagctgtaacgttaagccttatttagcagtatctctatgatacccaagaaattgattaccagtatgagatactgcactctacttgtttttttttttttcatttgtgatgactctgttatatgaagaacataatatgctgttgcactatggtcggcgtagtttctgtttttgctacttgttttgtaatttagggctcaggacctggaagcctaactttgttgtttcattgtgtatacaatgatataataaggagagtaaggtaaaacatactgttatcatatgcacggtgtctgatgtccttatttgttgctttttaggaagatgacactgagatggacattgacatggcagctccagcaactcagatttcgatcaagcatggcctccctgagattgaaatatattgctatttgcttgtcctgatttttcttattgaccagaagaaatacgacgatgtacgtctaagactactgattttatcttctgctctcagtgagacattctaatttaaagttctcacctgtctctaggctaaagcatgtgcaaatgcaagcattgctcgtctgaaaaacttgaacaggagaactgttgatgttctggcatctagactgtacttctattactcatatgtgcatgaactcaccaacagccttgctgaaatccgtgggtacgtcaaggtcttatttaatgcttagttgctcactattcagtgtcttactaccatgtttatcgacttttcctgcatttactctcttttcaggaatctgctagccttacacagaatggcaactcttcaccgcgatgaacttggccaggtagttttggtttctatatcctcattgatttattaacctttaagtcatctaattcttgtaatctgtgtaaatatacctgttttcttgattgcaggaaactttgctcaacctgcttcttcgcaattacctccattataatttgtatgatcaagcagagaaacttaggtcaaaagctcctcgttttgaagcccactccaatcaacaagtatatatctgcttgcaccatttattactctacagcttgtgaatttattgtgttttggatgttgctcatgcgaagtttcatactccacttaaatttgtttctacatgttgttgttaagacaccttcattttagttaatgctttatgattattgaagtatgagatcatccttcagccaactgaattcacaggacagactcttgggcatatgctaataagtgccttttattgcagttctgtcgatacctgttctacttgggtaaaatcaggacaattcagttggagtacactgatgctaaggaaag

SEQ ID NO: 40376 - DNA, 760 bp, Oryza sativa
gcctgaggatgtccttgtaagaatccttgacagtctcaaactcgatgtttttctcatacaggcatgcaagcactctggacacatcaggcatgatcatggatttctcatggtataacttcacaactggagcacctgctccggtgctaagccctgccatgacagcaagagctcaggtttgctggttgaagagttgaatgatatggcatgcaagtaagtatggtaactccaccctacaattttttaatataagaagcttatctgcctccaacgagaagcaaagagaagatgcttaaagtgagaacctagaaaaaagttgtgacaccgtgacatgatgtagtaagaaataaaatggaattaaagaaaaggaaaaggtaaagagaacaaaggggagggaaaaaagcaaaaggtaaagcaaataaaatatggagatttgaacagtgatgatgttctttagttattccaacccttgctgcgatatctatttccagcacgttgtgattttaaagagcaaaggtaaaataataaaaagctacttcttggacactacctaggtacaaacattattatgctgccaactgaacgggaggatagatcgtatcagatgtactcccctattagctaacatcgctttattcatccgttgcccctttaaccaaaggagatgcaaggtgctctggtgcgtaaattcacatgttttgtcacagaaggcaagtataaaatcagagactagcagcagtccagcacaagcctctagcagcag

SEQ ID NO: 40377 - DNA, 4531 bp, Oryza sativa
gacatgacaaaatgacaacccagcatgccaagacttatctggatatagaacaggaggcaaaggcaaagctggtaggtatagttgaagaagtgagaactgagaaagattcaaatcgggagaaggatggcagatagaattcagatagaccatagatcgattcagcttcagcaagctgatgctgttggagttggcaaaaatccagcaccaaattttccatctagacaaggacattctcgatccattttctcaagtgtggtggtgctatgctccaaccatcctgctctcatctggtccttgttactgtagtactgaaaaaataaaagtgactctctgcaacagcgatggatttggcacattggtcacagtgaattgaacaatgcctagtaaagatagcaagttccagccaaccattcttctcctgcatatccatcgatccaatcattgagaacacaaccaaccaccaagaaattagatcgtctgaattcacacttgcgtcaggtggttcagtgatctgccttatcatcacaaattttgtactccgtttcggattggaatgatccatttcggattggatagcatgactgcaaactgaatcagctggaacatgattcgagacaagatttggtttggtgtgaaatgtcgttagataaatgatctcatttccaccaactaaccagctcgaaatgcgcacctctctccaatccaatggcgagaggagagagagacagggactttttataacgacagcaaccacctgcatcatccacaggcatcatcggatttggagccaggtgcttgttcatacgcgtatttaatttaattacaaagagtatatttcctcctctaccttacacttttactccctccgtcccataatataagagattttgagtttttgctcataatatttgatcactcgtcttatttaaaaaatttgtgcaaatataaaaaacgaaaagttgtgcttaaagtactttggataataaagtaagtcacaaagaaaataaataacaattctaaattttttttaataagacgaatggtcaaacagtgcaagcaaaaactcaaaatcccttatattattagacggagggagtaacatttttcagccctttatactcttaatttttgaaacacccttacaaaacacccagtaggggcggagctacataggagaggggtgcttaggaacacggtcaagaatttttttaagctatagttcatctattttcacccatatatgcaccgcctcaattcaaaataaagcattcctattagcgtaaacttaatcgaaagtagagtaaattaagcgagtggtacatctcttattctcttcattttgttctagtgccgcccctgcacaccagttggactaatgtgaaaacaacattggtaagtacgagtggctggaggtggtgtggttagaagctctagattttttttaaataaatatatattatatttgaaaaataaaaatttaaaaggttaaaaatagcaaaaatttctctctaccttatcctctggagctaatgcacgatgataagtgtgtaaaaaaagaggatagtaaaggagagactattatgcaagaggcagcagttgatgagagtgactcgcaagcttatcccggttgccttgtcaccgccgtaaaggcgcctcctctccctatcttctccactgcctcatctcctctcgtcgtcttcaccgccgttcgatgaatgctactctcatcactagtgcatccagtggtctggaatagtatgtttcgatgccaattctgtctctcatggcgacgacctttgctgctgcttggtgatgatggagggtttaattgattgattgtggagtcctaatttggacactaatccgatctgggacccacccagatgagctttagtgatcccatggttgatcaaagcgtgctgcatctgctaatctctgatgtgaagcagattggctgaagaagacttagatatcctttcttctttttttcccttgatagtactccctccgtcccttaatataagggattttgagtttttcttacattaaccactcgtcttgtttaaaaaaattgtggaattattatttatttttttacttgcttaattatccaaattactttaagcacaattttttattttttatatttgcacaaatttttttaataaaacgagcggtcaaacaatgtaaacaaaaactcaaaatgccttgtattatgggatcaagggagtatgtattagctggagtaattatattcagtgctgatagagtaataattgtagcttctactaactgccagtcatgattctaaaaaaatagaaatgtagagtagtatatatctgaatcttagcaaaatattattgtatgatcagatcgacccaattaagcagcccctcgtatgctgcttgttcgcaggtgaagctgacggtatgctgacagtagatttacttccttcatctataaatataagtatttttaatgttcagaatttggttatagatataagcatttctcaagtactactttttcaattgtcgtatcgctgagtgtgaactttttcaagtaatctctcagtggtattaaagtaatattattttaagtttattttttctaaactctaaaaataattatatttataaacagaaggactaataattaattaagtgaataataaaggttgattaagtagggtggtacttgcacttccctttccgttgctcgacttgctccaaggggagggtgggtcccaggtgacatgcgagtgggtgatggttggttggttggtaaagtgtgcgtgagcgtgtggggccgaggggccccaccatagaacggcgaggtgagccttatccgaaatggggaaaaaagggtgggctctcttgttgaatcggcaaaaaaaaaaaaactcgaaaaacatttttatttttagtttttggtttttgatttgtcaactgagacggagagagacaagttggttgtcacggtttctcttttcggcgaagcttaggccaatgggagcggtggtgtgtgtgggcgtgtgccacccgcaccaacatggaggcacaagtggtccacgggatcatcatgctttccgttgatccttctcttcctcgagtggcaactggcaacatttgttgtcggggatcttttgttaataagaaaatattttaattacatgcgagttatcgtttactctatccgttatagaatacaacaacctaaaatccgttaccgaataaaataagatgaaacgtatctaaaatcatccagattcatattattaggatatgccccatctaattctagattgcaatgtcctgtaatggagagagcatgtatgccatggtatgaattttttttaatgacctttctgatattcgagctacgagtgataagttaagaaacataagccaactaaaaataacttataaataattttttttatatctatgttactagtgatttaaaattcagtgttggaaagtagactacaagagagcgaaataaactttaaaattcagttttaaaatttaatattttattgtgattggtaagctaacggttagcaaagtaagtgtagctcaactgatttggtttattgtagtaaaaccagtcctgtgtttcctaaaataaaaactgatataccttttttcttacgtgaaacaacagaagaggtcctactgtgctatattatattaaagaaaaactgatatacctcacactactaaaaggagcagtagaacaaatgagcagtagaacaaaaaagcatgggctccagacacaagacgagaagttggcccagatccccgcgacggagagcagcggcccgcactagctcatagtactattcttcgttactgtctacaaccaacaggcaacagatatattcatacataaaaggagacccactgagtggcaactgacacgatgagcatcgcagcagtgttgtgcaacatcacaaagcatatagcatgaggatttactccaggtaggctgatcagcaaatagccatatccacttcagttgaaccaaacagttctgcgttcctctcaaacaagaacagaaaagaaacaacacatgctaagagagattatgctttgctgaatcatgatgatcaggtcaggtttctttcggggcgcccttcttcgcggcctcggcggcagccttctctgcttcaatctcagccacgtactcgtcgatctcagcctcctccagctcgcggaggccatccttgtgtgtcatcaccgcaatctcgatgttcttgccaccgctctcgacaacctggagacatcaacccattactcaaatttaagatatttgttgcatataaaatgccaagcatcaaatgatatagctatgatggagaaaccaactcagcaaaaaacactgaataaacaaaggtcaaggccaatgagttcgtcatgaaaaaaaaaaagcaaagcaagcaggcatctctgtctacagacaagtaaaaaaggatgacatttgttgcactaaaagagctcatcagaaaattctacatgtgcaacagact

SEQ ID NO: 40378 - DNA, 2276 bp, Oryza sativa
attcctgcagccctgaatagctagttttcttatttgagtataaattgtatatgtttatgtatagtgtggttggttagcaaagagtttggggtacacatgtacccccatgtacccatctacctctgccactgaccaatggaaaaaaggtcaatgagtttgtcatatgtggcaactggcaaagcatgaaacaaagtactaacatactactttgtcttccaacaacgaaaaaaagcaagatatttcactaaaagaggtacagacatatacgtatatgacaaaatgtgcaagagacgtgcattttcacggtctgtatgagcaacagattgcaaaaatgatcaactgcttaccattagctagcataaactcaatggtggctgtgcatatgtgttaaccatttgaagccaccaataaacgaatatataaccagatgcaggctaagaacttgatttgaagtatttagctatgaactatgtgtccttgaggaacataaccatttgcagttagagacttacagtaatgaaaaaaggacatttagacttaggccttctttgtttaggcttataagctagcttatgagccaaaaagcctaagcctaaacaaacaagcagcttatttgtttgccctttttaaagccacaagccactcttacactgttaagccaaaagctaggttggagaaaccattttgttggattatatgaagtggaggtatgactcaaccattgaacttaggatttcaaatccaccggtttataaaacatataagccaataagctgacttaaaatctcaagccaataagtctaagcctaaacaaagatgaccttaatttgatatgtatttttgtaatggtgtatatacattttttttacctagacagtaaatacaatgaactaggcatccgtgcctatatctaagcagcaacatactaaagcggcagcagagttgacaaaatacatgcaagttgcagcttctacagtgcaatagaagagaactacaggtgcagattatcaataacagaaaaacaaaagtttatatgccactaatcaaacaactttaataacttttgaagagaaaaatgtactcacataagaatgcctttaaaaacttttgaaaccgtgcttaacacttaaaatatgagatgcagatgacaatcaaaatacacaaatgattaaatagctagagacgatttactacggataaagagttaaagacctatagccaacactacaacaataaaatttgaggtgcagatgaaaaccaatatacaaatgctgaaatagctggagatgatttatgagattacagatccaagccataccaattgctatgatcactccaggcaccaataagtatcatctttaagatggaagcaaacacaataaaaccaatcccatccatcccactctattttaggttcatgactgcatttatagtctcagccgattgtaacaaagattcagggaactattaatctttgcaccaaattgagtcatatggaacttaacgaagataacgatgttcaatcgtaggcgggcatcttacaaattactgaaccagtcaacataagcaacacaaattagtgaattacttttgagtatctgtcttcagaagcacagttactgattcagtggtagtggatcaaagctagaggtagttttaactagtaaaattattcagtgtgaagtgtatatatatacctcaaggagggctcggatggcaagcttgatggtctccttgccggaggtgtccttgtaattcttctcgaggaactcgcgcatggagttggagttgcggccggtggcgttggccttccaggcggagaaggtgccggatgggtcggtctggtagagggcgggcttctcggtgtaggggtcgaagccgacgatgagggtggagaggccgaaggggcgcaccccgccgctctgggtgtacttctgctgcagtccggcgatgtagcgcgtgatgtactcgacggtgacggggtcctcgacggtgaggcggtggctctggcactcgacgcgcgcccggttgatgagcacgcgggcgtccgccttgagccccgcgcaggcaagcgcgatgtgggtgtcgaggctggcgatcttgcgcatggacctggatttgggggggagatcgatccgcgggtgagatccggcgaagggagggggcgggttgaaggatttacctggagtcctggagcttgggggtggatttcttctcgacgccgaggacgacggtgtctgtgccgcggacgccgacggcggcgttgcccttgcgga

SEQ ID NO: 40379 - DNA, 3431 bp, Oryza sativa
ctggtggtggtggtgtcgccgccggcgaggttttcctgctctcgctttgcttttccttgtcggttgcgccgccgcctccgccttttctcgttgctgctcctgctccgccttttctttcttgcaagaaaagaagacgacgacgacgaagacgaagacgaaacggactcccattggcccatgggccggatcgtattccggcatggggctcgcgttatgaagcccactaagaaaaggccagaaagcccatggtttcttgctcacgaaggttactgcaggctgcatcccatgggcccatggttaagagggatcgaaattttattctccgttccccctttgattcgaggaaaaaaaatcgattttggctatatcttactcgaaaattttttttcttatctttcactcgattttctcacttaaacttacagtgcattttcttgtaagttacagtgcattttcttgtaagttacagtgtaatttatgaaacttacattgtaacttttgttttttaagctacaacgtaatttttaaatctttacatgtaagttttgaaatttgtattggatttagtctttttcttgaagatatggtaatttagtgtccattatagtgtttcttagttgctttttgccttttactgtgtctatcgaattttaatccaaagattaaaaattgcgtgatactcataaaaatctttcgaaaaatgcataggtactctaaaaaaataatggtttgtgtgtgtgtatatgcggtttatgtacctatagactacgtgtattgactgcctaggaaaaaaatataacagtatatcaaacaaaatgttttatcaatagttttgctgcatcataagttcataattttggccatgtcaatatatattgcctcacatgggcataaatttaatttgcaggcatcgagcagtcaccaattatccatgtctccccatcaaaatttgccaatgtcaaaactagagtcaaaccaacactggaatactaggagcccttgtctaaaaatgctttaatttctaaacggatggatttgagagaataaaaaaaagtaagcatgaactagctaattgaatttgtcgacatcatcagggcttgcaaacccatttaaaatctgaattgggcctttcatctatctcctcaaaagggaccaaatctgactcaaacttgaaaacttgttggatgcacttgtggcgtagtggagcttccgctatcttccccctcaaaaaatcatacctgcaaatcataggtagtgtttagttcgtgtgccaaatttttttaagtatacggacacacatttaaagtattaaatgtagactaataacaaaataaattacatattccgcctaaactgcgagacgaaactattaagactatttaatccattattagcaaatgtttactgtaacaccacattgtcaaatcatggcgtaattaggctcaaaagatttgtctcacgatttacatgcaaactatataattttttttttcgtccatatttaatgctctatgcatatgtctaaatatttgatgtgacggtaaagttggaagtttgaaaaaaatattttgaatctaaacacggccatagtatgaattaacaaacacatacctgtaaggctcctttgggttatatgattctcatatgaaaaattgcaatccataggaaattttactataaatgccatttggaacaaaggatttgaagtaaagccctgtttagatttcaacgtttttcttcaaactttcaactttcccgtcacatcgaactttcctacacacaaaaaattttaacttttccgtcacatcgttctaatttcttcaaacttttcaattttagtgtggaactaaacacagcctaaataaattcctgtggattgagttcctaacttcctatacaccaattccgtaggaaacaaacaatgagctcaaacttgtctctctactctctctatagaatccaccaaattctcatgttttttttttcctttcaaccatccaaacaatacacatttcatattcctatatgttttgcctgtttctgtatttttagaatcttgcgttccaaagagtaaaactactactgtttagctaattatttgcaaattgatttagatatgtgtaaaacggaagaagcaattattaagtatatacagttagcttaattaccacagcactctgtagacgctgttgaagaatgcaacgtcagatgcgtagagatctctgagtatgaatgagttgccttcctccattgccagcctcgtcaagctcgccgtcatcttcttctcccacctctcctgcctgtagccggccagcacccagacctcgacctcctcgtcgaccaccaccaccaggcacagcttcccctccaccgccgccaccttcttccgcgcccacctcttctcggtggtggcctccggcggcaggccgatgaggcgccacgtctcggtcttcacgtcgaacgcgaagatgtcctcggcgccgccgctcagcctgtcgggccaccggagccagtgcatggcgccgtgcgccctcaccgccggggcggcctccacgagcgactccggccacaccgcgacgtccgccgaccgccgccacgccatcccccgcgagtcgaacacctcgcagcggaggcagttcctgagcgtggggacggagaagcggacgatcttgaagtccgccgcgccaccgccgccgccgccggggcgcgccagcatcgcggtggcggccgtgcggtagcgcaacctcgggttaggcagcgcgcgccactgcctagtcgccggcttgcagacgtagtaggacgacgccggcttgcgcggcgtggcggcgtcggcgtcggcgtcgacgcagcagacgagcccccggtgcggcgagacggcctcgacgcggacgtgcggggaggggaggaagtcgagggacacgaggtcggccggcggcggcgaggggtgcatggaggagacgaaggtggcgtggtagcggttgcgcgcgacggtctggacgaggtagccggagacggcgtcggcgcggcggcagtggagcggcgcgaaggcgggctcgtaggtgaggcggcgccagcgggtggagacctggcggcaggcggcgaggtcgtcgagcgagacgcgtgtgagcatctcgaacacctggtcctccggcaggctgatgacgtcgcactgctccgacgaagacgaagacatcatggagaagagaagagaagacaagttggggcagaggcaggtactaggtgaggatctagctaattcagaactcgatgtgtgctagctgcattgcattgcaggcttgcagggcaagaaatgttggaattaatgaatgggccttagcccactcgaagattaattctttggaaaatcacaaaagcccacctcatgggatggcatgcatgtggagtttagtaccatcttgcttattctagga

SEQ ID NO: 40380 - DNA, 13558 bp, Oryza sativa
cctgcaccccagatgcaacctccttttgcagttgtgttctgctgcaaatgcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagtgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagcaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgctttttcctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgctatagttgtgtgcaatcgaagcaacctcgcaagcctcacaaggctgccgaggagagaaacttggcaccactagaactcatacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatggggttgcttggcgaaagtcaatgtaccaataacaaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttgaattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacctatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggccgggccgggcagggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaagaaatccgattaattggatcggcagctagaacagttaataataaggcgagaaaaatcctcgccgcacgcggagagccgaatcgtgaaagaaaaatgcagcgagcacgtaactccatgggttggaaacgataacgaggtgaagaaacgcgtatactatcttctcaacgataacgagatgcaacgatagtcaagcatgtcaggatatcaggactggagctttgggcatgccgcttccgtagcggccaagcctaccagggtgtgtttagttctagggtgtaaaaattcaaaagtatacagacacacatttgaagtattaaacgtagactaaaaacaaaacaaattacagattccgcatgtaaactataatatcattattagccgattggtttctactggattatattgttatttattacgttatcatcagccgaatgtctctagatcattatttacttaagtatcagaatatatatatagccgattgctcaaaaccctatcgacataggctagtattggcatcgtctgaaagtactccatcatcttgtcagctgatcggctctttggtgatcaatatatttatctatcttgtcagttgcaagattaaactgactggcagatccacatctcatcaagttttagatctacactggagctaagcagatcttccagactgttgtgttcgtcgacttagttcgcgcaaacacagttccgacaccatcaaccgagcgcggatttttaatgaaaagatatccccaaaagaagagtctgttcactttgatgccaaaaaaaaccttaccaaaatttggcattgccaaaattttgacaggatttcttatatagttaccaaaatttggcagtaaactaaatgtagctacttttttagcaactttaccaaaatttggtaaggttgaaaatgacatcaaagtgaacaggcccgaagcaagctgtacggcccaatccagcccattgggaggagtagagtagcccagttatttttttcttgacctggcccggcccaaaattgatttgctgtcttctctctccaggtgttagttcatccatgatccatctgtcgttcgttacagccaagaaagaagggatcgaatatttgcttgagtcggcggcatgatgcattgcatgcgactttgagcgcgatatcgtcatgactcatgagttgatgtctgctgatcgatcgagacgccctgaaaccgtgctttccctgacggttcagaattggcttcaggttaacctcagatcggggagtttcatcattactcactgacgatattaattaattcttctagattagatgtggaaatagtagtaggagttattttaatataatgatctttcctctaaaaaaagaaatagtagtaggagtagatcatttccttgaaattttctcatgctagtaaattgacatttttcacaggctgctttagtaaggattctgtcacatcttatctgaatcagcactagtatttcgttactgcttccttcactgaatggttcatctgtcactaagaagaaaataaatcaacaatttgttcagaggtttgaaaaaaagataagcacttgaaagttacaccctctctgaatttaccctcttgtttctttccccttcatagaagatgagatcatctcttgcggggacttgttcttcacgctgtcactgttatgtaagatggggcttcttcctcacctcttgcataaaaatcaaggaactcatgtgatgatggccgttggccgacacaaaatggccacctgaagcataaccatatgaaagcagagatccaggctcataagccctttccctttacagggcattttcttcaggtgtgtgctagcttaacactaaggttatcacataccaaagtaggttcaatattctgcttttcattgtcattgatgagcacaactcacatcttttgcctatgcctcccccttttgccttcaccacattcagaattccttttgcatcttgtttcttcagagttcagacaccctttcattgcagatcagaatgattgattggttggttaattataccaacaaaccctcaaaattcttatcaggtatacatctgagacaaacaggatctgtattactcttcccagtttacctccaaagtgattcttatcctctctataaagacaagagagaatctcagattgtgctacttgctgtgcgtcttgctcaaactttcagaaagaaaaaaaaaaggagcttaccagatcagaatatcagatcatatgctcttctcgtttagattcaaagcagtgcatctggagtccacattgatcaggacccccaaaaaattaagcacagcaaagaatgtaactagaatagcaaggttttctgaaaggcaaataaagcaaagcaaacacttaagctgagcagcaactacaactgccaaacttgaggttgaggacgcctgcattctctatccacaaacaaaaagtcctaaagaatgtgctctccacgtctcccccttttgatcactcctactaccgatcaagaatccttctcacttgctactagctgaataatacgggatgctcctgctgggcaagcaggatcaccactgcaattgccaaggcagattggaaagctaaggatgccggccatgatgccgcagttgcagccatccccgcgccactgctggccttcaagctcgccagccacaccgcatcttcgagctgctcgtggctcggtctccgtgatccgttctttgaattcccactgcaaacataccaaattcatgaaacagttaatcaacctgaaactgatgatgagaatttgctgttgcaagttccttccatgcctactaggaaattgcaactttccagtcaaggccagcttaggtacaatgtgagtgaagtggggacgaatcaaaggagaaaaagattgctcctccttttcttagcctaactctatcacatcctcaatgaacctttactttccccaattcatgttccacatcgaaatccccaattttagcccaaaatctcaatgtgctgcaatcagtccactatacaattctatcatacacataaaaatctcatactggtaatcgaaatctcaatgcaatggattcgctgcgattgatttgaagtgtacaaacctggatggagtggatcgggggcagaaggtgatggtgtaatcggtgtggttgcaggtgaaggtggaggtggcgtcgtcgtaggcgtagctgtaggatttagggcacgccgacttgaagagctgcgagtactgggaagggtggcaggtgtccgggttgccgtaggcgccattgcagcagtactcaggtcggccgaacgcctcgcaggcgctgcggcaagcgcggccatcgtcggcgcggagctcggaggggcagcgctcgttgaggtcgacgaggcagccggtgtcggggcagtcgggggcggaggcctggacgagcatggggaggttgtagccgtcgacgaggctgacgtcgtagaagtccttgccgtcggcgccgttgagggtgaactcggcgagcgtggcgggcggggaggcgcccgcgccgcggcactccacctggccggagccgcagtcccccgtggcgcaggagcccttgccggagtcgtcgaattcgcagccggagcgcgcccagaagcggcccgaccaccccgacggcgcgtagagggagcgcgacccccccggcgagagcgcgaagccggtggtctccagcggcggcgtgccggagcccgacagcacccccggccacaccgtgtccgtgcaccggttggtgaaggtgaaggtgattgcgccgacgccgaccgagcctgcgcgcgcggaggaagaggaatcgaatcccccaaaccccaagaaagaatcaagtcaagctccaaatcgcgagctccagtagatagtaacccagcaatggaagtgactgaccttggaagaaggagaggaggagaacggcgagcgatgtcggggagccgagcagctgcatcagcatcagcagcatccgtgaatccatctcgaaaatcgaatcaagaacgactcacacggttgattgaatgattgagcttgggggatctggtgttcgacaagatttgctcgctcgctcgtttggattgcttaaatcgcggcggcggcggcgatggcgggggagtgggcacgatcgatgcccataaccccgaatccgcggacgcgcagctgagctgaggtcgcgcgttgcgtggtggagtggaagggggaggtggtgctcgtgctcgtgctcgtggccgtgtaaacctctgggcgatggcggctgctggctttataaccagaggaggccgttgcttgctccgcaaattcgcgatgcttttctttcttgcaatcaatcttgcgacttgcgtccgctttgtgtactttttgctcgaatcatctctcaatcagcacgcgagtcaaatgcagcgaccgcgagattagtactccattttacagtgaagaattctgaattggaatccatctggtagcgcactgctaaattggtactccatccgtctcaaaatataatattattcaactttaacataatctttgatgtgctactttaaccaccataattaagatttttaaataaaaagagttgcatattatagtttgttcaatgataaatctactaacatcaattttatatgattgatcatttttattttttttactattaataacaaaagttaaaaatatttgatttagcactactttaaaaatatttatattttgggaagtattgaatacttttatgaacgtaattctagcaccggtcgcctgcttaattccggcttcggtgagccagcagctcgcaaatgcacaccgaactcaaaattcgagccggttcgttttggtaggattcgatgaaatttccagtgatttgcgacggggttcatgttctgaccagtttgaattttgtgaacgttgaggtagtgggacaaaatttttgttgtttgttttgttggtaagcgagtggcttttgttctgtttttttgcttgtcacgttgtgggcacagtgtttggacggtttggatcggcccagcgacgtccatcagacctccgcttttgcggcacaaaacgataggagaaaggggagcatgcaacatgccgtccgaattttcagccccagagaaaccgaaagctcttaataattatcggatccattctgatcaccgatctatacctgacataagattttcttattcagtgaaaaccagcatgttgtcatgttgttccaaggttgatgctcccttttctcccaatgatttcatcaccgtaaacgttgaatggatcacacacgtcttgagtagatgagtggatgacacatttcttgagtatatgaatggatcacgttgaatggatcatatataaatttattataatttctttttaaaaacaagttttcagctttttaatagttaatctgttcgtttatatttttcatcattctattacattcatcacaaaatcattcatctattcatcgttccattctattaaaaaagagcatactcaatcaaactttattcagctcgatcacactgtacctgtgtatacaatacagtactgtgcgtgtaggctaactcatagttcttggcgaattcttcgcacgtaagcaaacaaacgactgatcacgcagcatgcactaccatgcttctggtgtgcaagtgctactctagtactactacactgagtggagtaatcaagagaatcattaggcactaagtcttttaaaaaagagggatattaggcacttgccaggttaccaccgctgcagcctgcagatcactctcagcttcaaccttttctgaattaccactactttttagtactacgtgataacctttctcattcttctttcctaaaaagaagaaaggaatgcagatcagatgaagagatcgctgatcagtagccttagtccacatcgaggactggtttagttcccaactttttcttcaaactttcaactttttcatcgcgtcaaaatttttctatacacatgaactttcaacttttccaacacatcgttccaatttcaatcaaacttttaattttggcgtgaactaaacacaccccgagttaaaatgttgcttttctgaaatctgaatccgaacaaacgaaactattgcaaattaattggttcagatttcagactgttactagtactccagcctagtttagtttccaattttttcttcaaacttttaacttttctatcacattaaaactttcttatacacaaacttttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatctcatattagtagctgcccggttgatcgatcgaccagcctgtaattgatgcaaatgctgttctgtaattgatgcgtactatgctgttgtgctctgcttcagtttccttgtggttatacgtcactgttgagttcggctaatcctcatcgatctgaaagctactgctactgatcatctatctgaatctgatcgagataatttagctctctactcagctagaatatccatctctaaccatccaaccctgacaaaccatggcatctgcctacactgcttttcttgctcatctgataatctttcatgcttattagtagctcaaaagaaagcaaaagatctgtctttttcttttctttttcattcgcaaagcctggctgctaattaacaggtgacatctgctgctgatagctttcagtaaagggaagcccacgtttcatttggctgcatcattagcgtacgactcatagccataggcatcatagctgtagaatccctgtaagatctgaacaggagacagggaaccgatagatcagaatctgaacatggattcctgtggattcagaagaatcttgatccatgataagataggaccatgcaagttgcaacgaggataagatacgccttctgatcttcagatcccgttcatctttcgtcaagttcggtggtcacaggctaggctagtgaatcttgtcaaaatctttacagagatcatatcatctcagcttttttctgcatgagatttagagtctgaagctcaactgatgccagaactgatcgaccacctgtagtcaatcacccttacagaatactcctagctagaagtaatacagtagatgaattaccaagttttgcgagttttcatcttgtcacgttcttgcaatcacggaaagaggggaaaacctttcaaattcaaaccaccaaactcaaaacgaatgcattttaactgggttgattcaaatcacccagcaacgacatgttggg

SEQ ID NO: 40381 - DNA, 1455 bp, Oryza sativa
atttcaggggatatactgttaaccatctgccagtttagttaattgtagggtataatcggctgatgccttttatttttaacaacagattcacagttgtactagtattaattgggttctgagtgtattctatcagttggttttacaggttcaggttggtgaatggggaattcgcacagctgtagtgttgttgcttgagcacttctcagaaaaagcatcccaacaaagcttcgagccgattacaagacagtgggcaccaaggttgcctattgctttatgatcagcaatgcagagaatgtgctcaagctaagatgaactttctgaaccttgcaggtttcatctcactttatgcgttgtgtaatatgtaattgttgcatgacactcttgctctttgccttactaaattcacctggccgtgtacatcctaagcagaagagaatgctggacgaaccattgatcagtccataattacccatgaatgctataggcagagcaaagtaactcgtgttggtgctgtgtcaatggtctgtctggtaagttgcctatcacacaaattgattctcatttatcaacaatgcaaattctacatgtcctcttagttgtgaaatacaaattctagcatttgttcgcatcatgtctatttcctagtacgatccttgcatatatcaatgtctgtgtacagtttttgtgctaatgttgctgaaataaacatgattttgttcatgtagaattttattgctagttctatgtgcaatccttttgcgtgttcacgaaaattgctctacattagtgtcccttgaatatagtgttgtactatatgtcataccactcggttctcacccagtaaactggtatatagatatttgctgagagatacaatgcattggccaatcatatgaattgcgcaaattagtcaaataaaataattggcattaaccaacctgctataaaccgtctttgcttggattggagcaaactaaagtattctggaggcaagatcttgataacttctcctgaagtctaggacagacaggattgcattaggaaccaaacattggagttatttacacactggcacatgtagaccaggtttggtgcctcaatttaaattgacattgcagattgcatcagttcctgacagtgactagtgactacatggtctgtacatgcagctagtactactttgatagactagaggcgtcaaatgggccaatttgctgttgcggacattgtatcggtatcttacttggatactccctccgtcccaaaataaatgcagttttacactatttatgttcaacgtttgaccgttcgtcttatttaaaaattgtttatgattagtatttttattgctattagatgataaaacatgaatagtactttatgtgtgactaaatatttttaaatttttcataaatttttcaaataagacagatggtcaaacgttgggcacggatt

SEQ ID NO: 40382 - DNA, 2459 bp, Oryza sativa
cgtggccgcggcagcggtcgaggagggcggcggccttgtcgagggccttgccggtgtcgtcgaggatgcggcgggcggggcgctcgtagaggtcggcgcgggcggcctggcggaggagggaggcgaggcgctccaccttggccttgaggtcgaggcactcctgccggcacgtctgcgcctcctccgcccacttgatcacctgctccgccaactggatcggccgcgccaagatcgccttcaggtcgtccatctatgatgatccccgccgacgatcagcaatggcggcgagacaggaggaggaggagcacctcctcggcttgggggggattccggccgtgctcctccggcggcggcggcggagaaaccggcgggcggtgggggtgggatcgctaattgggggaaggggagcggcatgtgcatgtgaggcgagcgccgcgcgagatgtggatgccctgccatggattgccgccttcggatggaaagggaagacgagaggtttccacgcttttcggggtttgtatttccgatgccgttggatcccccacctcctcactatctcctacctccgctcttctaattactagcattttagagtatattcccattggtagttatactagaaattaaggattttttttcctgaattttagatatagattgtaccaaggttttttttagcatgttttttataaaagccaatcattggttttagtaagaaaacgtttttaaaaatgttgttgtaaaaatactaccaccgtttcaggttataagactttctagcattattcatattcatatatatgttaatgaatctaggtatataataatttataacctgaaacggaggaagtatcaaatagatttattttttttaaattataataattaaaactcaacaaattatgtgttaatggttttctcattttacgtgatcttacttgatacagtctccatctcttgcgaaccgggcttattgaaacggattattttctccatgcttcagaaaaaatatgtttttcctttagaactttttacttgtttcttaaaatatttaatttttcctataataaagtagataatcgtcttgataatctaaataaaatggctccgagtaattttacatgtagttagatttccagacactatacctcatagatacgagcacgactcttaacttttggtttcatggatacaattggatttgatgttacaaataattcatacaatcgtattttctatacaatagatttttaaagtttacttacatcttgtatacaattgtgagctttatatccatggaaacatgtattccttcatctacaattgtgtaaatcattttttgcctttcaaatttgataatttctagatcctcaagagcgaacaatgacattcattttcgataacagatccaacaaatgcttgctacaattgctctttcatttgttgtctttctcgtaggttagtagccaaggcatgtctaacgtgagatatcatgtcctactcttttctcctatttaattaactctatgcaaatcaatagaaacctatcctacatctacatggcagcaaaataactatacataaacactatcctatccgtgtgacatcgaagcaaagtggatcccgcttttctccaccatactgtatacggtgtaattttcataagaactttctgcacgtgaattttctataaaactattttcataaacaattaacaatgtgatttcatttggccaccgccatcgacacggattgagacggctccctcctcttcttgttcgacttcgaccactgctatcggtgtagatctgggtgactccctcctcgtccgctgcccatgtcggcggtggcatcttcccgatgatggcctccaagttcctctattctgatctctccaaattgtcatcctttcttccaacttgttggactacacgaattggtttctctctcctagagccaccgcttcttctgcaagctcttctgacacactgcaaaaccactcctcccctccatgatggcatccaaaccttacgtggaggctgagaccccacgttggacatggcctaacaagtcgttctcgtccacaggaaaacgcccatggatgtatcaatgcatcatgcacgatcactctctttaaaccttgtgatccaaaaaggagaaaaaaagatcgtgtcatgttgacttgaatcacacccaagtactgtatattgaaactacaagttggcgttctatctgagttgccgcagaagggaacagaaatacagaatcactgaagaagatagaaatacagaatcaccgaatataattatacagtagattggttcatgtcaaccaatctactactccatccgtctcacaatataagggattttgagttttgtttgcaacgtttgaccactcgttttattcaaaaattttttgcaaatataaaaaacgaaaagttgtgcttaaagtactgt

SEQ ID NO: 40383 - DNA, 4896 bp, Oryza sativa
ttcccatttgccaaacaccacctataagaatagagattctctaaagattcttcagggcagacagtgtagtgttacgttttctgaatggttgcctgccctgcccggaagaacatcaacacagacaggttgatgtttttccatggaacacaagcttaagacaatttgaaggcgccaatcgtaatattcatattgttgttccctcaaaaaaaatatttatatttttgcagactttccaggccttccatccaccaatcggcgatgttccctgtgttcgctgccgttgaataaaacaactcgtctgcctcgtcgtcatccagccatccacgttctagaacaaaaagctagccaaagtcgtcggcatatctcgccagaatggaaagaacgatacgaatcgaacacaagaagaagaagaataagcagaggcagggcatgcattttccttcaaacctcgcgtcaaaacacgctagtacaatacagtagtaagtacatattcacagtacatgatgatgattgggttaagtctggattcctaatacgctacctagtctcaattttgcattttacattcatacacaagggatcgatgcgaggaggaagattttactttttttttacataggcaggcatgggtgatcaccgtaactaaaaatttgtgaggtgagcggccatggccgtgaagagacagaaatcgcgtgtgtgcgctaccagcactggtcggtctcccaggtgcggcgtgggcggcggccgtaccagcgcggcgcggcggcgggagccgccatcgtccggtggtgcgcgccgcgcgccatggaggcgacggcgacgacgtcgcggtcgtagcgcgcgcggctgtcggggtcggagagcgtggcgtaggcgtcgtggagcctgacgaagtcgtcggccccggcgctggcggccacgtcggggtgccgctcccgcgcgaggcgccggtacgccgccttgatctcccgcaccgtggcgccggcacgcagccccagcacgtcgtacagcgtccccgccggcgccggcgcaggagccacggccaccgcgcaccggaccttccttgcccggtacgacccaaccgccgctgccggtggcggcttgggcgcgaaggcgatccccacagaaggcgcagaaatcatgagaaggaaggaagagaggaatggtgggcaagaagcagatctgggaagacggagaggggaattgggaagcttttatctaatacaagatgtggaaaaaggaaggagaggaggcaggtgagacgtcgttgggtggcacccgcggattgtgttggatttcggggtggaatcgccggtggtttagtggtattttaaggcgggtttggcgataggatcgttgcttgggtggtagtcagcatccggttgcgtcgacttgggtagtagtgctcttttctttgagcatgaaatgaaaatgaaggttaagatttttagaacaattaattaagatttaattattatagacttaaaatagattaatatgatattttagaacaatttttatatagaaaattttcgtatgaaatacgcagtttgaaaagcgtgtgttgtgaaaattattatcttcgtccaaggcttgatgaagaaatgaaggagacattggtgcatgcgtcgctgtccgcttccaaatcccaaattgagcatttttttttctccggtggattctgtgggtgcaggctgcgtccgactctgggcgtctggccccccggttgatgggaggattcggattctttgcattatttccttcctgccccccacggtttgtttggcgcgcgcacgctgattccgcccgccgtctctctctgtcgctgctctccaagtccgacatgacccgcgcgccgcggccgaccaccaccttcactcgctccttgcaagttgctgtagctctcggacagctcgccccatcagcacaaaagtcagctactactaaacttctactactactggtttcttccttttttgatagggagaagtttagcaggccgggccgcacttcgttcacgcgggctggtgatataggaccgaacaagtatggttgtattgtaccaaatgtcactcttcagagccactgcattgttcagtcaggcccaacagatagcacaagtatgttaagtgcaccgttaaaatgggctattttagttttttttttttgcctttgcttcgaataagttacaacagattattacagagtttattggtcaaaacgactgcgttttttcataaataaatacagtctaatgaaagcaagaaaattaactggaaataggctaaattttgagatgacaacctactgctaagggcttattcgtttcaaaggaattgcaaaggaaaagcataggaataggaatgtgttttaaaataccatatcataggaatgcaccataggaaaactttaggaaagttttccattcctccatatttgaaggaaaagcataggaaaaaataatccactctaacctaatgtttgcattcctttggttggtttgctcaaccaacataggaaaaatttctgtgtttttcaatccataggtttgcacatgtattcctatagtattcttacattttttatattcctacgttttgaaaatcctgtgaaccgaacgagccctaaatctttatctatagtcgacgaaaatctacatataatcggatatcgcgcactgcgcacatcgaactgaagcggacgatgctacaaaaagtgtcaacgagaagtaggtgaacttcacagcacgttacaattcgttgcggtaacagtatatgctacaccgttcaaacgtgctcatctgcacctgcctgttctgtctaggacaacgaaatttctttccaagacagtgcggtcttctagaagatgctacagtaagtgccaacaaaaatgttgccatccaaacatcaaagtatggaacttatagaaaaaaaattgaaaatatacttttatttttcatattttgcatttatatacatgtctgagattaatttgcaaaaatatacccaatccacatgatggttgcgtgagagcgccggtcccgcaggccggggatgcgataccgcaccggtcccgcaggataggcgaacggcaccacgggttgtttgcgtcacggtgcggacccgccgagctagagcgctcccgcatattggatgcacgggaccgccgctcccgcacccacatcgtttcctaaattgtgaatacatgtcccgcacggaaaacggaacagtacatcagcacatgattaattaattattagttatttttttttcaaaaatggatcaatatgatttttttagcaactttcgtatataaacttttttaaaaaaagccctatttaactgtttaaaaagcgtgcgcacgaaaaacaaaggagatgagttggaaaaattaggggaataaactcacgtaaccggagcactcccgcatagcggatgtgcgggaccggcccctctcccgtattccgaatgcgcgggaccgccgctccctcatggatgttgtttcctaaattgtgaatacatgtcccgcacggaaaacggagcaataaattagcacgtgattaattaattattagttgattttttttaaaaaaaatggatcagtatgatttgtttgagcaactttcatatagaaacttttttgcaaaaaatgcaccgtttagtcatttgaaaagcgtgcgtgcgaaaaacaaaagagatgatttggaaaaattaggaaataagacacggaaccggagtgaccacgggaccggcttcggtaccgcgcgttggagccgtgggaccacgccgttctgcggtactgccgcgctccgcggtaacgactcggtcccgcagtccagctatgcgggcccggctcagttgctcatccagttccgcgcgaccggctcaagtatgtggttcgccctcgctcccgcataaccaatccgcgggttaggtatatttttgcaaattaatctcagacgtgtatataaatgtaaaatatgaaaaagaaagagtatattttcaaaattttttcggaacttataggctacaacaggcctcaggccaccaggagactataaattaattgctttgaatttgaatgatgcaaccatgtaataactatttcacatctaatcaaatcatacatgggcgacaatgagcgtcttaaccacgacccaatgtagcggcatggcaaaggaagcacacaagtacagagacctgaacaatccaccagctcctgatgcttccatttcaccgatgacagaaagtatcaagctgccgctacttcttttaaattatacgcccataatggctacaatatgtagtgatgtcatgcccgggtgtcctgtgaagtaggaacttcagcactgcacatagggcatacctgcaaagcaatcaaggaaatttatcacctttcggaaatgaaaatgctttctccaataaacctaaactgctcccgttattgggtgcattgaacatgccaaatgatgtatcttcatagtcaggtggcaaaagaaaaacattgattcaatatctgacaaggaatagggatgtagggttcataagccgttgctttcattcatcaaggggttggtggatatgaagactggagatgctgttaattatataccttatttaattgcagccattggtttatgcattcagaatggtatgaatgcttgcaaggaagtgcaaccaatgattcaccttcctcaaattccacacggcaaataacacatctgcaaattagtttcatttatcagtacagtgccggttacttctaaaaaaggggggagatattaacatactgttccatgttgccgtcttgcttatcttgtgctcgataagttattgaaggtaatgaagcaagtgtatcagcagagaggcctctgctctccgtagggctgcaggaatt

SEQ ID NO: 40384 - DNA, 3589 bp, Oryza sativa
ctttccgtaccaactacttcacccaatgcaaccagctcctaagaacaccaacattaaattttagtagcagatcctgaagctttagatgtgtaccaaatgcagacagtaccggtcttttttaagggaacaaacaacttacctcataagaatattcatctggatcaacatcttcccatgcatcctaaagtcagaagtaaataaaaaagtcagacaatagctttattattggaagacttcaggaaaacaagaccacggcattaagaaaagtgcaaattgctcctagttgggtacattttaagccattacctcccccccccccccacacacacacacaccccatcccaattctcacatacaggaattggcattaaatttccattttcaaatgaacaatagtatacttatttgcaagcatcagaatctgatcagcaaaagcagcaggaaaagtcagttcccaaattataatttgagtatctagaaatggaaatggacggacaaaggtgataccgtgccattgagttcaacaaacctgtatcgcttttaacataagtagcacagcttctaacttctatataccaggaaaagaatgtagtatatatgccattaccatattagttcgatatgcacctaaaatattcacctacccattctgaagaatgggactacatacagatgggtatacttgaatttctcccataataatccaaaagttaccctccctttctccttgtctctcggaatccaaattattcattgaatggttgcatgataagcatggaacaatgaattggagatatcgtgcattccaaactcatgaaatggaagaaaatgtcacctgtggatcatccccgtcttcatcttcatcatcatcatcatcatcatcatcctcatcatcatcatcatcaacatcgtcatcatcatggtccatcactcgccctacaaaacaacaacaacaacaacaacaacaactgtaagctacacacaaaaatgaaataaaactatgaaaggaagaaaaaaaaaggatgggggataaaattctcccttgtgcactcacaatcactgaggcccgcgagcgccatgaggcggccggcgacctcgcgctcctcggcgtcctgcagcgcccgcgcgaaggcctcgtcgtcctcgtaccgcgcggggtccaactcagccgggtcaccggcggcgtctgcgtctgcgtcggccacctcctcgtcctcatccagcgcctccccgtcgccgtccccgtccccatcctcgtcctcaaaatcgctcccctccccttcctcgtcaaactcgtagctcccaccatcggaggccgcgtagtcgccgccgtggtgcgcgctgagcatcatgtacgcccgctcctgcgccgacaaaaaaaaaaaaaaaaaaaaacacggataagccaaacccccccgaccgtggtgaagcagcgagatcccgaggcggcggcgtacggcttttacctgctcctggaggacgcgggcgagggcgaggtcggcctcctcctgggtgaggctggtgaagggccgtctccccgccgccgccgccgccgtggagtcatcgggtggagctgcggcggtgggagggttgggggtagggttttggtcggcggcggcggcggtggtatccttggcggcgtccatgggaggagggatcggagaaggggggaagtggtggtgggagacaaggagaaatggtggagaaggaaaagcgaggcggtggcggcgtggcgtgggtgaacgttaagcaagcgaagcgcacacacgcggtggtggtgggctgggatggtttcagtaaaagaggaaaaggacgaggcgaacagaggtaaccgtttccgtgtttcagctttggaacggcagtccagcaccccgaatctacctgacctcagtttaggatgtaaacgcagccagcatgggcatggcaggtcggttccgtttgggtcccacaggtcagcctctttggtgaacttctcttacaaacggcccatcatcgtggaaataagcaaaacggcataattacaaatgaaaaataatttatgaataaaacttttatatacatgtttttggtgatctaataaaagtaaaggctgaaaaataaacttccataaaaaaaacctcaaaatcaggttcaaatcaaattcaagattaaaaattcaaattttgactgataagtataagtataaacgaaaagatgagatacgaagactccttttggtgaacttatgtaggttcattttggattattttaggagggtaacaaatcagcaattttgtttggagtctcatgaataactctgtttcgtttctaactctaccctaccaaaaatgacattttggtagtgcaaggcataagaaaaaaaaaagaacagcccgtaatccagctttgcttatgcccatatgtattggcaaaccatataaaagtttcatatggagcataactttttcatacggaaaaagaaaaacgaaaggcaaaggatattcttgatttggggaaatagctcacggaacggaacgcaatagaagttgttgaataggaattctatgttgcttagccggtgggcgaagagagaagcaggcggcatgatcacggcaagcaaggcatgctgctgcggcggcggccaacctcgtttcttctttcttgcacggatgcggcgtgtgccatagatgctttttcttgaggtgttccaagtgaaatgttaaaggtacagtagagaacaaactatacgtgcaaagtcttccatggcctgccttgctgcttcacccaatgttcgtatgcaattgcaatttgcttgactgattcagcctctagcacaaatgggccaacagtagttgctgtttcctagtttttgtatggtctctgatgtcacgtgggtttgcttctggcccatcatagatgctgactagagagttctgctagataaacaaactttgcacaccaacagcaggaggtgatcaataacgagatccaaattaggggaactatcttggtctatctattggggcctgcgacaactgatcgtatgataaaagctaagtagttaaaaactagtctctagatttcatcacggtctctggtaggtacatttttcacatgagcaatttgtaactgaaaaaaattatcaagcaaacaaggctctggtatccgacgatgtactaaacgtgcacaaagcccataacatgttgcatcctgctgcatttttacaccactccagacggaagtcgaaggacaagttgcccaccaaaaacactgcagcaaaagatcactggttagccaatcttcacaattttgccttgatgacggtaaaaggtagatttatgtacctcttcacatagtagtagcagaaatcagcaaggatgaacgtctgaacgatttcagagagaagcaccatcgaaggccagagaccatagcccagagcagtcaacaagcgaccacgggtatccaaaacctgcagattagatcacagcaaattgatttagatgggcttgctaaaaaaaatcctattctgtttacagattagatcactactaatcatgcatcagaagtaacagatttctcaagaatatatacagcttaaaatgcagacatt

SEQ ID NO: 40385 - DNA, 1577 bp, Oryza sativa
tctagcaataagaagggggctaacaagatgaatgatcaaaacaagtacataagcatgtctggcaaaaaatagttagcacccagaataggtgtacagatcattgcattggtaatgaatactagtaaacacatgcaactgcaatatacaagcaggttatgatcttggcggtgggaacctggaaatttcaagtgcttgaactatgtctttagtctagatcaagcaggggaacatttatagaatttgtgttttgagcagctccaacagttatagttcacacaatgaagtcagaaagtttacacaaaacagagggcaccacaaactttatgtttaatagattcgaagagttttttagtctagactctagaagctgatattgcacttaccacgtagtacaatgcaaaattgtccttgtccagcatataagttgacctcagtttgaaccgaatcatgtagatgacaaagagagtagctgctagtgtagctgtatcaagtatggtatggatgtcatactccataacaaaactgcagtacagcctaacagccagaaatagtgctgttaaatcctgagacttgagtgagagtcctgcagtaatttagaaggtttaaacaaattagagcatgagttacataaatgtaggaattaaatgaagagagtaacaaaagggacaattaaaaaggtcccagagttgggggagggggtatgaggggtgagaggaaattcatcttgcaattgtaattttcaacatgcgattctataccagtctactccctgtcattcaagcagttaattcatcttattttattttttgagaaagggaggcacctccgttttcattaacgaaaacaccaacattacagaagtccttaaactgcatgcagttaattcattttgatgcatattaaataaaataattggtctatcctcaataaaaactgggaagtgaatgcagcatccactatctaaaaaaattacctgattaccatacaatttccactttcaaacaagtgattttacagcttgctaatgcatgcagataaacagctgtactgatgtagtgaaaaccagttcggttaaaaacttagaatacaatagaccaattgggattttgctattctctttccactcaagaagcaagaacaaccaagttgccacagagcaatcataaattccaagcaattatgcttttggaaagcaatggaattatgagatggaccatatcttggtaagttaattgcctaatattttaatgtcagaatcaccatctttatacccccttctaaattcttcatttgcacaaccaagcactcagacataatatgttttcagaaagtaaagcacgaaaggagatggaaaacaacaagttccatgacagagaaaggcgttctagtagggactgaagcagcaccaccaatctaaacaccataatctatgcgccgtccaccaggagatgacatactccctccaacaaacacttcaatcagctacctgacagaccagtactgctcaaaacaaactctgctagtgctaccctacaacacatctacatatagaatgtccacctcattactagaaaacc

SEQ ID NO: 40386 - DNA, 702 bp, Oryza sativa
cgagtacatcgcgaagaacgggcccgagttcgaggtcgtgatccgcgacaagcagcacgacaacccggactacgccttcatcttcggcggcgagggccacgcctactacaggtacaagctctgggtctcgccgcggccgccggtggcgccgtaccctcccgggtcgatgcacatgatgccgccgccgctgggtccgatgatgcgtgggccgccgatgcaccagccgggttacccaccgttctacgaccagcaccagcatttcggtgctcacggccatggggagtatgatgccgcgccgcagcaatccttcaagggcctctccgggccgcttccggtggatgtcgcagctgagctgcacgacgtgcttaccaatctcaatggcaccaaggagtcgatcaagggtgccaagacatggttcatgcaaaggtcgccgttcgcgccggctttggctgaagctctgaaggatagagtgtttgctttagaggattcggagaggcagctccacattatcttcctggttaacgatattcttttcgaaaggtatagcttcgatcggcatctgcttttggtatagaattgctatcctctgctgatgtgaaatgaaggcacgctgtctgatctgattgactgaacaaatcacatgatacgatgaagaaagccagaaaacattcctgctgcaaagatatctatttgcctaatggg

SEQ ID NO: 40387 - DNA, 943 bp, Oryza sativa
ttattagcacaagctattgaaccaacttttgaatgttatttaatggtctttccaggtctattgcctgtcatgggttgtcatctttgtaattctgcttgtgatgaaggtaatccctagcattcatattttttcttcagtgtttcatcgcggtgctcatgagcaacattgtggttagaacacagggggtacccttttttctgtatgacaattataattttagctgcacagagtatggtagttttcttgctatattcctatggcagtaaatgctagagatatgcctttgcaatacctgaggaccattgcggtcaagttgctttgctgatgataccagttgttagaaacctgttgtgttgtgcacacagactgaaccttggtttactcatgtttgcagaccgtgtcagttgggaggcggaaattcagcgcggacttccaacttgtgttccggttgattaaggggttgatatttataacatttatctccatcattataatcttgatagcaatccctcatatgacagtccaggacatctttgtttgcattcttgccttcatgccaactggctggggtctgctgttggtaagtggatatcaattgtttttggcctgtaagcggctggtttggcttgcttgagctgatgatggttgttgggttcaggttgcgcaagctatcaagccagtaattgtgcgcatcgggttgtggggatcgatcaaggcgcttgcgaggggatatgagatcatcatggggctcctgctcttcaccccgatcgcgttcctcgcttggttcccgtttgtatccgagttccagaccagaatgctcttcaaccaggccttcagcagaggtctgcagatctcgcgaatccttggcggccacaagaaagaccgagctacacggaacaaggagtagtagcctgtctgccattcactggacatgtattctgtt

SEQ ID NO: 40388 - DNA, 1052 bp, Oryza sativa
atcatccgtgccaagcgcgccggtggcatcgcctccctcgtctccccctcccctgttacccccgccgttctccccaccccacgcctctccccctcccgcgagggcctctccgacatggctcaggcgcagtggggcgtcgatggctatggctccatgaagggcctcatccgcctccgcacctcccctcaccccgccaacccctccgatgacgacgatgatgccaactccagcggcagtgacgtcgaggagcatgtcgaggtggagcgccgcctcgaccacgatctcagcaggtttgagatggtctaccctgccaggggtgacggtgtcttcttcgaggaggaggatgactatgagtatgaccaggaagcccatgtggctcgcctcgaggaggagaacctcaccttgaaggagaggctctttttgatggagcaggagcttggcgacatgaggcgccgcctggaggcactcgagtcgcgttttgcagggactgatggtatgcctattgagaattcagatgcagttgcagttgaccatgacaaggagatggctcatcccatacttgttcagagggatgatcttaggactgagattgctgctgatgcagcagggtcagacaaggctagtgcacaagacaatgcagaggaggttgctgatgcagcagtgtcagagaagatcgtgcaagacaatgcagatgttgtagttgcagggtcagagaggactggcgaagagatcggggttgatgcttcggagatggattgatgggagatggacactggaatgcaatagcggttatcagtactgtacatacataattgtcgatgacagattgaggccgcgtgatgtggacttgttttgggaggcttacaattgtatgttgtcgcataacaagtggatcatcgtatttacaatgtaatatgtttctaccattctgtgctatctttggtgtttctttgcgtatttgttatgatgataccacacagcacaacttgtagtagttcttaccttctgctgctgctgctgaaagaggtagaagcgactagatgaatttgtta

SEQ ID NO: 40389 - DNA, 2388 bp, Oryza sativa
ggcaaaggctattgaagcaaagaaggctcaataatcccagatcagggcaggtctctgatagacataatgtctatcctgaggatgaacgccatgaccgtcatcgtcagcgtggtgaagagcaagcttccaatgacggcgtctcaagctctcgattgcgtggtagaataagacttccagcggaaacaacgtttgacagacttggcttacagcctgagaaagagagagacagagggcctcgagctagattgtcaccaccaagtcaaacagaccttagagggaagcttcatgataggctaaaggctaaaccaaatgaggatgtatctggtaatgtacaaagttctttgtcaaaagcaaatgaagatgctgaatcgttgaactttgctgggccaaagagccttgcagagctgaaagcaaaaaaggttgcaggcagtttaatgaagagtagtcgttctttaacagggccagttcgaatgacatccgaaatagttaccatcaaagactcttcggaccctgttctgtttgatggcccaaaaccattaaatgccatcctgaagagaaaaagagaggcagattctggaaatgctaccgattttggcagcaaacgggaagaacattctgggggagatgaagaaggatctcagaatgatttccgaaacatcgaggatgacatagttggaatgaacaccgaggggaatggagaagaagccttccaacctgaagacgatgtggtgtatggcgacagcctgtctcctgcggatgacattgctgctgaagctgcagacgatgcgagcagggagctggaggagcagcaagatgtagagacagcagaagagtacgactacgagatggatgacgttaatgcggcggaggaaaatgactaccaggagtatgaagacgaagacgatgatttggaggacgacgacgatttcgcgcgcaaagtgggtgtgatgatcacttgaagctgcgttgcagtaggcgtgccactatatatggtatgaccgaagaattgaaagatgtgttagtatccctcccaacaagatgttggtctgtttttcttgtggtgctagatacttttacttcactgcgccagagaattcagctaataaagttgggaggaagataaaattggctcatcggagagcttgtgtttcagccaagaggcggctgcttgtactctaatgtgtgggtgtgctctcctctgcctgcttgtgttgttgtatcattagttaaatcaaaatgacctaacaggttacacaatgtactacttctatttatattcatcagtgtataagatgataaaaggccttgaagccttttctttctggtagagaatacattgctcttacctccagatttaacatttcatttttcttgcttttgaattgtgtatctcatattgcaatttcgatctgtgtcgctttgctgggtcgaacacagcagacagttcattcgcgtatatttatgcacaagaaaactgtcaccctacaaatcgatgcctcagatagcaaacagacaagtcatggcgtctatttttccgtcttaaaaagtagagtaggagatgagctcaaaaaggaggacgagaagaaatttatcatctaaacatattatcttcgaatactcctacaaagtattacatacatatcaccgtataaaatctgccgtgcggtgtttacatcacctttgcagtggcttcaacaggtctttgagaggccctcgccgctgaacattcttggcctgctgtttctctgcgttgcagctgcagctgctggtgttgaggttttcgccgcagccaaggcagagacctttgcaggtgggactgcacagggcatcgagcgtgatctccaagtgaatgatgtccctgatgtgctttgagatatcaatctccttttctccagctgggaaatgcagccggtcatcccaatctatatcttcatcgtctccatcttcttggcttccggttagcgaaggagctttggtttgttcttcttcaaatatcgtgccgagatcaaccacatcaggttcctctactctgtcttcggtcagtaagagggaaaaattggcaaatataccttgaggcgctggctcagcacacctgaaaatgaagcacagtgcgtttcagtatagcactatcaaccttgtcttcaagttgtgccagaattaaattaaccaaaaaaaatagcctgtttctactttgtgaacaactcatgtattgtcaacaacgaaagtgatattcactgaatatatactagttgttacgtcaacaaaaaaaaaactagttgcttcatattcaatcctccataaacctttattatgcaattactagatatatattatattatttcaaggtttgcacacaagagcagcttagtcggacaataaatttggaaa

SEQ ID NO: 40390 - DNA, 3061 bp, Oryza sativa
tagtagaggtgataagttaaaaagattgttactgtacttgcctttgcctaatgaaaccaatttctttgggtcatactactgccttgtctaaaaggaaaggaaaagagaggtttacccatagcaaccgagggtgatgacagtgcggacgatgccgtcgaggcggaggcggccgcggcgcctggcaacgtcgagggagacgagcaccggggtgtcatcgtccttggtaccggtaaggttggtggaggagaggatgaggattcccatggtggcggcgcgcgcccgagagtgagtggaggagaggtcgccaaggccgaggcgctccagtgtggtggcgtactcgaggtggtgaaccgacgcgtcccgccggtacaccaccgcgccctcccacggagaaccctcctcgtcttcttctttctcctcctctgggtcgtagtcgacggtgaagaagtcgtcgtcggcggcggcggcgcatggggagtgggagagactaggagagggttgtggtcggaagaagaaggagcaggtgtggtggagtggggtcatcgccatcggcgggggaggggtgcaggtgcgagtgcggcggaggaccaagggcaaggctcctgcgacgcccccaatgccaaacccaatcatcatcatcttctccaccccccaagcttcttcttcctcctcttggtgccatcggccatcccatcctctcccgcgtgttgtagggcccatgggctgaatcatttagtaaggcccaagggatgcgccgtggtgcgcggaagtaacagcccatcgctgctcatggaaatgccagtttctccaaaagacgctatgtttataacaagtaaaaaaacaccagtaacaaaaaaaaaagcatgtactagtatctatctatctatctatctatctatctattatattattaaaatagctttgaataaagacaccacgttcgctgtcgaggctagttaatcgaagaaaagagaaaaaagctacaccgttagattacaatgaatataaattaaagggtgtaggtttatcagaaaaaaaaattttatcagtacgaaacaaagtctatccaatacataataggaaagttactctattatattattaaaacagctttgaataaaggcaccacgttcgctgtcgaggctagaaattctcacattaatcgaagaaaagagaaaaaagctacaccgttagattacaatgaatataaattaaagggtgtaggtttatctgaaaaaaaatttttatcagtacgaaacaaagtctatccaatacataataggaaagttactctaatctttcacgtacgtgcatacatgcatgttggattcctaatagtatttggacaaggatgctttccgattgggtgtggaaaaaaaggaaaaacaaaagatgcacagtccatggaagagtacatctagactcaaatcacttaattagccagataatcttgctgtcacgcaaaaaccaggcgcattaattcatctttgatatcaacacgtacacctacacgatagattgttggtaataattttgtagcttactaaaagttttttttctacttaaatacatatttaaggagtctgttcactatattggaactagaaaaaaaatatatgcacaattacatttgttgtttaattacgaagggtttaaatttactccattgatcatacttgaaaaaaaacatttactccaataatcatatttgaaaaattctacaccactaatattggttgatttaatttataataagttataacaaaacatatatagtatataagttaattgtataaggaaaaaatatttcttggcataatagaccaccttaacaaataataattatagacaagctagctcgaacgggaaggaaaaaaaacacagtccctgtcttcataagaatctagcactttgtgaaccctttagttgcatgccataagaaaataaagataactcacctatgtcgtaggttatagacttatagtacttaaaagaacaattttcacggaaaaccctgaacaatttccattgtgtgtattatatttagtttcctatggaggctacaaaatcccacattaatccaagaaaaagaggagaagagttcgagtaaaaatacatctagaaattattgaaattcggaataaaaaaatatggaaagaagagtccatgtagaacacaattaaagattaattaaaatttggaataaaaaatagaataaattccaaaattataaaaataagaataataagagttcaagtaagattacaattttcaaacaatagaaattggaaataaaaagaataagaaatattgaaagatttcccactatacagcacaatacaagattaatgaaaattagaaataaaaactaaaattaattcagaaattagaaaaataaaaataagagttcaactaggaatatggtttataaataactaaatttagaataaaaataaagactattgaaagaagagaccgtctagaacacattaggaagttaatgaaaatttggaataaaaaataaagtaaattctaaaaaatagaaaaataattataagtgttcaagtaggaatataatttataaatatcaaaatattggaatgaaaatatgattttttttaaaaaaaatagtccatatagaatacaacgatgagaaattgcaacaaagagaagagaagcaagcccgtaaaggagtagggtggtggcagttgatggggcataaaaaaactataaacaaaattctaaatagaatcccaatgatgattaagaggagggataacggcaagccattaagtaaccggtcacgacagttggcgggacttctacaaagtaaaaaaaaataaaccacaacgacaatcattttcgatatttaaaatctcaatgataataaaattgagaggcaccatgcgggtcgcataggaatacagtggttgagccaccaacagttggcgggtcttatagaaagtaaaaaataaactccaatgataattatgtttgattttcagaatcccaattacaataaagaggaaggcactgaacgggccgtagaagagtacaataa

SEQ ID NO: 40391 - DNA, 10476 bp, Oryza sativa
  unsure (1)..(10476): unsure at all n locations
ctttgggccaccaacacgttacacattaaaaacttacacttgcacactccatctacctttctagacaccataagcggcaaacccttacaaaatcaaaacccaatgcgcatacctcaagtatatccttaacgtcatccttagtcagtttgttctgtcttagaagcaactctattcttgttctcatctgtgaattgctgaaaatacatggcagggtcaaaaatatgagtattgcactgcacacccgacctcctaactcaacagagcaagaaacactcaagcttcacttacccagagtgccatatatgccccagaataagtgcaattaactgaaaaaaacagccacaattattatagacacttggtaaagtaaataaactaaaggatcaaccaagaaagccatacaagtaagaaaacaacactttcaagttattactatggtacctgaagtgtgtaaagaccagcttctagcttgcgattgtagcgctcatcttcatccatctgagataatgagaatgtagctataagaatttttcatctgttcaaatctgagacaaaaaatcaccgtgggggcttcccccactgtttccgggtcaaaaaaaaatctgagacgaaggcaactaggtagataaaagcacctctagatcatctaaatcaagactgtcaagtctttcagtctcagctttcactctttctgaatacctgcaaatgaatgagcaaagcatggaggataaagccaatagcagaaaaacacaagcaattttcttagttttcttcaaacgaaatataccttgtgtaaaactccatcaaacggtctatcttttcacattcattctcaacaaattttcctagtaacctgattcttcgtgaaccttttgtaataccacctaagaaaaaaaaatgcaaaacaccaaacatgaggaaataactagattaatagggtgtctgcagcatcaacaaacctatatataagtagcacagacaggaacagagtccttaaatgcaaaaggcatcggcagtattatgttcagaaagaactccccactgaattgaataattaactacagaaagaaaacatgatttttcaatatagatgcaaacatgattgtgaattaactactatagtgtggtaaaaaccactgagtattcaagttcaatggtgatcttcccagaagtactgttagatcatttaaatagaataactgcagctgtccaaatatgcagttaaggcttgaaatttttgcatgctacgctatacacttgggttcaaccttaaaaggccagtatgattgaaacgatctgctattcaactactccctccatttcacaatgtaagtcattctagcatttcctacattcatattaatgttaataaatctagatagatatatatatgtctagattcattaacatcaatatgtatatgggaaatgctagaatgacttacattgtgaaacggaggaagtatttagaaaatcaaaggttgcatcctcacttcccctaaagaaactagtttcaacagtcaatcatgtactaatgtctgttaagctgatttatatgtatattgttgattcgcagttgcaggtatcatatacagaagcaatctggatgaagtgttataatactaaggagcaccataaaaatataaacacccatattggaaaaaacctgcttgcttaccaaacaatgaagcaattagtgaaatgacccgttcttctagtgcttcctgataactctcttttttgtttttcttgttcacaggaatctgaaaaaccatatcccgaaataactgagaagcacataggtgattacctcataaagcagttactataagttaaaaatggagacgaataaagatgtcatgtagcaaaggtctactataagctgtttttcagttgaaacaataaggtgtatgctactagttaacagcatttgtgcaatagaaaaaaaaaaggaacctcacataaatttgatcaagtggactgaaactgaaaggcaaacaggatgctctgttataatttgaaaaggcagcagcatgtgtttcaagttacttaaatcagcaatgtatgtgttttccatgtaatgttggttgaaaaggctgatgcagttgaaccactttcatccattttcagatttacttcccaatagaaactgtaactgcagaccataagaacatatggccgggttaaaggtaatagtgataaatttaattctcttgcatattactgcatcacagcattgattgatgttcacaattgaaactatataggatttgatcagtataggagtatacaagcactttcatccattttcagatttacttcacaatggaaactgtaactaaagaggatgagcatatgaggcttcaggaaatggttatcaatttagttatcttgcatgttagtgcatcacagggcaccgcattgattgatactcagcatccgaaatcttataaatgagaagagaaaaggagtagcagacacttgccttacccatgaacgcagcaaaagcggtcttcagcccaagtacatcaacaaagcgctcgcaagcaggtgggaacctagtcatggcaaaatcgagggtccggatggcagagctgtatgccagcttcttctgcttcatgatgatgatcatgagctcgacgccctccgccttgacaaatctttccttgttctccatgggccattgagtctactatcnatgtcttagtagtggggcccattaaatttccccgtaaattaaaggngaagtgtttnttctttccggaaagggcccccaatttttccatttcaccctttcctttcattncaggaaggagggntctttggtcctgacttgtacatggcaacggcctgcagcaggccgtcgactccattgatgttgcccaggcgcttctggttggcggggctgtcctgtacgatgatggcgaggatctcggaggcgtactgcttgttggcatcgaactcgctggccttgaggcgggcgaggagccagcggagaagcttggtgcggtcgcagacaatgtcggcgagttgggggcggagctcgaggaggttttcaacgacagagagggggtgggggacagcctcggcttcgtcggggtcggcctcggagaagcgggagagattgtggacgaggaggtcgagggcgttggcttcgacgagggcgtcggcgagggagtggaggccggcgaggtcgtcggggtcgtcggagtcggtgaggtcggcgaggagggaggcagcggcggcggcgaggtcggcgttgtcgtgggtgaggagggaggagagggaggaggcgaggcctagggggacgaggtccgggaagaggtccggggcgccggcgaggaggcggaggcggtcggtctcggcgtggagggcgatctcggagtcggcgaagcgggcggggtcgtcggggtgcttcatgcgggcctcgaggttgtcgcgcaggcggcgctcgaaggcgagcaggaggcgcttggcggcgcggaggtcgagcacctccacgtcgtcggcgccctccagggaggagaggtccaccgcccccgcagcgccgtcgtcgtcggcgtccggccgcttgcgcttgtgcgccgcatccatcgaaaggaatagggggagggggagaggctaaaccctaaccctagccagcgagcgcggggccggaggcggaggcggctgccgctgcggaagaagaagagtagtagagctctaagattcgtgcagtgccggatgactagatgatatgaggctctcagtatactcgcagcagctactgatgacatacagtatgttaaaaaacagcagcagattgagtactttgatcaatttctgggctggattatcatcaacatgttgcaatgcaactacaaatgagatctacaaatagataaatgctttcatcaattgattgataaccagatgatcgagatgaggcattcatttcatacatgacaagcagattagaggtcagaggagagaccagcacatcacatacgtagctccataatactaatactctaccaagaattaataataagaagaagagtaagccgttacattcatgaaaatgaacagagagaccagtcacaggccaagaaaaagctattactagtacttgccttaggaaggtacagtaagttaaaagttgttttctgaccaaaggatgactctacaaccagaacgagtagcattcaggtaggctttgtcatgccttggggggttcttcgttctatccactggagtagaacccagcagcaagtttttatattagcaggatcagatgagcagcacgcctgccataagcagcggatgatggtcgctttcattttcatttcttgtgcgccctgtagtctggggagtttggtggcaatggtgaaagcgggtgcctcgatgatgaatctgcaccattgaaatcgatggtccgacccactgggctcgtatccttcaaacttgatgatttgcgcttgtgctgcaacaaacatatacatgatgacatcaaacttctttccaaccaacattttcaacaagagacaaattttccttgccagtttataccttggtggtggacgcactggaggaatgctttctctcagaccggtgctgtcgctctttctccaacagagccaacagttttttgttctcttcgtcaagaatcttgttttcctcgaatagcagcttgaccttcaattgaacacaagaaaattttctagccatcagccaggcggcacaggtttcttaatgatgcagaaatgaatgcaaggacaagagtgtttcactatcttacctcctcctctgctttattaagattgatccttaggttttccttgtccttgtgcagagcttcaacttgagtggtcaatgcagaaagctgcatatggaattagaatcagaatagatcaagcagggggcagacggtgctatagcatttgttactaacatctcaacacacgagcttagatgatcaaatagttaaagcagaatattcaacaacagttgatcaaatttttactagtttttttttgggatcaaagaggaacgaagccgtttccctcatttacattaatagaacggcagggtttactacatactagtaacagagaacaaaattaaaaagaaaatgcaggcctccgctctactggtgccatcccagcaacttgaggctatcctgaagaaaaccatctactggcagcaaaattttacgacattaaagcgaaacatgtactgaagagttctcaatccaacaagaccacatcacatctagtagagggaatattaattaatattcatactagggtaaaagaaaagaaattcacacacatgccgcgccaagaatgaaagaaaggggatgcgaaggaggaagggtactgacggtggtgtggtcattgaggcgtgcgcgcatttcgtcgttctccttagcgaggtcgtcgcaggactccatggcgcgttcgaggtcccgctcgtagagggtgcactcccgctcaagcttggtggagtgggaggagaggtcgttgtaggcggagaccatggtctccttctcctcgatgcagcggcgcaggcccgcggcgttcatggtggactccgcctgtgcaccagatccagcagagcaagagcagttgcagttaggggaaagggaaagggaaagcagattggtattggtattggtactagattagagattagttaccttgagctgttcgatgcggcgtgcggctgcgcggaggtcctcctcgaggacgaagacgtggtcctggaggcggcggcgatggtcctcggaggcgagcagcttgaggcggagggagcggtcggagacggggaggccgagcgagtcgtggatggagtcgcggatgtagtcatcggcgccgccggggagaggggtagaagaagcatcctcctctcgctccatggatgatcgccttcttctcttctcttcttccggcggcggcgggggcggcggcgccgacgaggagaggagaggagaggaggcggcggatgagggtgagggttggttgatcgatctggaatttcttggggaagagaatgtgggatccggatggattttgaactgaacccgctggataaggccggggtgaccgttgctgctattattgggccgggccttctctttcgatcttttccttccctatttcggcctattgcaggttctctttatttagacttaactttattgacttagacttttaataagtcagcttattagtttatatgatttatatatataaaccgatggatttaatgttttaagtttagtggtgaagtcacatctctacttcacataagaaaaaaaaaatctccaaactagtttttggcttgatgtgttgagcggcttatggcttcaaaataagccaaaaaaaaaaaactgtttgattaggcttagactttttggctcgtaaactatttactgggctcattttaattctgcagttgctttcataggcacgcgcattgtgattggatttcaactgcatatcgcactactcctgcggtaaaaacaaaaatcaacgtttaggataagattcaaccaaatttttaaaattccaaccatcactatattcggataaatttataaattgtaagttgataatactatggtgaatccacatataccaattttttatattaaacgaagctttcgggaaattttttatggccataatttgaaaagtttaatacaatcttgctaataccgaccattatacattccagaccgatgcatgagttgaccaatggacaagtacaaccttctagctctgcttgtacttgtagaatagaaaaacagtgtcggcggcaacaaaattacagagccccagaggttggtctgattacgagcatatgcacgcagtattttatgagataaaaaaatcaatctgtttaagatatcgatatttcgtacttcgttctgacatgtgtcaacctcattagctaaggttaaaaaaaatatagtccagaagaattactgtaatgtaatactgtagtgctggccagttttctccattgcaggcaaacctctctatgcaataagtcttgggagatgagatgtggaggccccagtgaacaagtagaatatgtgggcaatgaatcaattaagcatttcgtttccttggagagctagttagtggtagcggataaaatgaaatgtagggaaggaatacaaatgaagaatctcacaatgcgatgatgacgatggaaagaaatgccttgcttgcctggactcttgccggtctcgtccttgataccataacttgttcactttaatttgttctccatcaatcgctcaagcaatccatgctgccgcagaaggtggtgtaggtacatataagaaatgatgcctgcctgcttcttggaagtcatctttcttctctctccctccttccttcctcttgatcatctagtataaattgaggaggcttgctggatccatacaacaacaaagacagtagtatcatataacagcaagcaaataagaaagctaggtagggcattcctccctcctcaagtagagaagagctacagctgcagctgcagaggggggcataatggccgtcgggttgaggagatcggacagcattgccgacatgatgccggaggcactgcggcagagccggtaccagatgaagaggtgcttccagaggtacgtgtccagggtaagaggctcatgaagaggcagcagctcttggacgagctcgacaaatccgtcgatgataaggccgacaaggaccagctcctccagggcttccttggctacgtcatatcctccacacaggtaggagaattacttactttcctaggtacatgcgcatctctctgtcaatccaacatcatccatgggccatgcaggaggctgcagtgctccccccattcgtcgcattcgctgtcaggatgaaccctggcatctgggagttcgtcaaggtccattccgcaaatctgtccgtcgagcagatgacaccgtcggactacctcaagaacaaagaggccctggttgatgacaaatggttagtcaattaaatattcacatttgctttccgtgtagctattactattgctatttaatcaacatccttttttgctttataatctcataatctggttggttatatctaaattaattaattggctgggtcaggggggcttacgatgacgactcccagctggaagtcgattttggcgccctggacctgtcgacgcctcacctcacgctgccctcctccatcggcaaaggcgcgcacttggtctccagattcatgtcttccaagctgaccgacaacaagaagccattgctggactacctgctggcgctcagccaccgcggcgacaagctgatgatcaacgacatccttgacaccgtcgacaagcttcagacagcactgcttctcgccgaggtttacgtcgccggcctgcatcccgacacaaactactccgaatttgagcagaagtacatgctgtattaccatacctggtcaactaccaaaagcatgcaacacgaatacatgatccaatatatatttgtaatgcatcatgcaggtttcaggagtggggactggagaaaggctggggtgacactgctgaaacatgcaaagaaacactaagcagtctctcggaggtgctccaagcaccggatcccatcaacatggaaaagttcttcagtacggtgccctgcgtgttcaccgttgtcatcttctccatccatggttactttggccaggagaaggtcctcggtatgccagacaccggtggtcaggttgtctacatcctggaccaagttagagctctggaagacgaactgctgcaaagaatcaagcagcagggcctgaatgccacacctaagattctcgtggtaatttaagttttcaactaacaattgcatgcatacctgggccatccatatctattatattattaagacagctcgaaaaggaggcaccacgttcgctgtggaggctagaaattcccatattaataggagaaaaagaaaaaagaaaaagagagtccaagtagaaatacaatctaaaaatagctgaaaatcggaattaaaaataagcaatattgaaagaagtttccatataagaacccaatatgagattaatcaaaattcgaaataaaaataaaataaaatacaaaattagaaaaggaaaggagagctcaagtaggaatacaattttgaaacaactgaaattgaaaataaaaaattaaaacattaaaagaacataatacggtagtaactaatttttaaaaaaaaataaattatgaaattagaaaaagaaaaataagatttcaattaggaatacaatttataaataactaaaatttgtgataaaaataaagactattgaaaaaaaaaagaccatctaaaacacatgacgagataaattaagtaacatgcctataaaggagtagagtggtggcggttgatacgacatataaaaattgttaataaaacaccaaatggaatcctaatgacgattaaaaggaggaacgtcaggtaggccgtgaagcaaacaagtaaggcacttgctgggacttctagaaagtaaaaaaaaacccattgataatcatattcgatttttaaaatctcaatgacaataaaaatgagaagcagcgggcgaggtgtataggactatagttgcagagccgccgacggttgacgggacttctataaaattaaaaatgaattccaacgatagttatgttcgatttttagaatcacaatgacaataaaagagtaggcaacggacgggctgtagaggggcacagtgacatcgtttgatgggacttctaaaaattataaaaaatgaaactacaagtccaatttttaaaggttcggaacttccaaaaagtaaaaaaacccaatgataatcatgttcgattttaaaatctcaatgacaataaagaagggaggcagcgggcgagccgtagaggaatacaatggcaaagccgctgatggtttggcgggacttctagaaagtaaaaattgaacccaaacgataattatgttcgatttttaaaatctcaatgacaataaagagaagaaacagtggacgggccgtagaggagtataaggtaacgtttgacgggacatctagaaattataaaaacaaaacccaacgtgacaataaactctaaaaactataaaatccaatttttaaaggttccaacaagaatgaatagaaatagtggtagatcgagcaagcaaataaagaagtaaatgacataaggggtagcaactggtgtgacttttaaaaactatataattagaaacacgaggatgataaggtttggtcttttaaagtcttaagacaatgagatagctatttaataaattttaagtaaaatcatactaaaaaatatataattttgtttggatgctagccacgcaattgcgcgggccacccagctagttatcatatatgatactacataatcacttattgagaattcagatagatagtgacatatgaataaatgcaca

SEQ ID NO: 40392 - DNA, 12556 bp, Oryza sativa
gggctcgatgtaaattacaatttataaagaaagaagtatgtgaaatgaagccgatttaaaagtgtggataccatgtacaatcaaagatacacacctgggcagaaacagctaaagcatctgcaagcaaagataccgcaagccatacttgtaagcatatctgatgagctgccatagctgttgggccttgtcgagcagccattgatgtccctatggtcatcgttaataaaatcgagagggttcttcctaacagcatgccacctaagcatttcaaaaacagatgatggaattatagatggtggtaagtgcaataaaaggaaaaacaagataagaagtatgaaattataacatggaggttctcaggatgcatatcatagacatgcattatctttccaataatatgacagcaaatatttgcaaatcctagaattgagcacattttactacatataaatggtaccacgaaacaatatggagaatagaagttccctgaacagcccattcattagtggacagaatgggcatggcccatgaatgaaagctctatcaatgacaagctgatcaacatatctgtaaaatatactagcagtaaccgtacctacaccatctactctacgatagtctttcctttttcttgcatataaagttatttcaaaaaccaaactttacaattaacttgttatcgataaaggtatcattgttaaatgcatagtggatccagaattggaaattttgacaaattaacccaaagaactcaaagccccctgggagagaaaatctgaacttcagttaaccgcacattgtagaatgaacaaaatgaacagacactgagatcaatgaaagtgtaagaactctgatttagcatgcacaacaattgaatataatgagagagggggagatagaagaacgaaaaagacaccagattttagatatccgctaaactctaactggtccagccttggaggaagtagaacagctcttttacttagagactggagaagcaaaattgtaataatgtacctatgtcatggacggaataaagttagaactccacttgtaagttgtaactagcaaaaatgcttgatatgtaacatatgaataaataaactgcataaacatcagatgatgtgctaacagccacaaactgttatggcaagaccagaatcacatatggtaatttaaatgtgtgtgctgaattgctgataaatgaaaaacaaaaggaaagctaaagtttattttctgctgcatttcattattttagaaacatgtctataagtaaaaacagttggtatttggaaccaaactgagttatttgctgctatattcatataaaatattccctttttttacctttgttgttttacttggattccatggggctaggtatcaatatagaacttactgtgatgcaactgtagaaattgcagctccagttatgccaagccgaaagacgtaaataagtaaaggaagaagcactacagctgaaagatttcccaaacctacatgttttaaaagaacatggtacagacatcatatagtgtaatatgagagatatttgatatcagagaagagtctggaatcaaatgaaactggacgtaaagtatgccctttattgtggaaaatggaaaaaaaagatattggaaacattattgtgattccacaaaatatttgctaggactgctaaaaggaatataactaatgcaaaccaatgtaatcatgtggttgatgaagagtagttcttggaagttacctataaaaaatacaggagtcttagtatccttgaatccacgaaatattccctgaactgctaacataatcacatttgcaggtgctcccaaagctctcaatgaaaggaaaagttttgcaggtttatgcattggtgaggcctgcaaaagcactaagttgagatatcctgacaattccaacaattgaaaactaattgttgaatcaaattagtgacccattgtccaaaagtgcacataaaaacgacagtattccctacaaaacaaagatcgcagacaagaataggcatcgtaatccaaaacatacaggtgacacgcccattagtttaagaaacaatcctgatcctaggaacaatgccaatgcttcaattgtaccgattccagcagctaagaccaatgcagaagatacagatgacagctccaatttgcctgcaacataaccacaagtcaggttttattgcttgaatgttgaagcaagtgcacaaaaaaaatttataaatatgtgagaaatggaatatttatttaatatatgctgctgctacctgaacttgaatgcttgctagcattcttggaaatgtcttctgccacaaatgaggttgcaatgctcaacagtggaatgttgaaaagcttagacacgatattaaaaaccgacacaccaataccagctgatgctagctccatagccccttcagaatatatgaaaaagaaggatgaatggcaaaagaagggacagcttgctttcatgcagtaaggatggctataattcatcactcccaatagctactttatgaatggcaagcgccataatacctataacatcatttttggtgctgtttgaattagttacataatataaaagaaacaaacagcatgaattatagagtattagtgtagacaatgatggtgcaggtatctacctatttgccgattgataaaccattaagaaaagaacacttaaaaatataggatatagcaggtccagtaggtacctacctaatctaccaatatatgcagtctccatcaattgcgccaatggatcaatagcttggccaagaactgctggtagagctagaagaattagctcatttctgacacccccgggacgcaagtgactggttgtttattcgttggatggttatgaaagggtaaaatatgtcatgcacctccgaaatgtaaagattatagtaaatgtagacagaaatgcaaagggcgcaagcatgtgggtaggcaagtaaataaaagtaggaaactgaaattacatgggaggctccgttggcgttgcattagcaaaagagatggcgccatcatcttcagcaacagcatggggagcattggtggcaagaggggtgatgtgtcgccggtttatgagcaactttggcaggtttgatggggaggagactctggttggtctgctacccaacagggctgaggaggaggaggaagagataggccttggacagcgcgcagggcgtgccgcgtgatggtggtgcatcatcactgccttcatctcgatctcgaaatctggatggaggaatcaattaaattgaagggggaggcagagcaagaagagagatggagctggaccagccggcaggagaggacagcaagttgcggtgccggtggacgttggtagtgggaggatcagactcgaggggagaaaggagaaatcagaaatggatgaggcagcgcatagagccgggagggaccaacaaaaggcaagcctttttttttaattgggttaattgttgtcaacttggcattggcatatgtactgtatgtctgcatctgtatggtggtgcttcatgtggcggtgcaggaggtgcagcatggcgtacacctccgctcgccgtgggtgcgctccgtcccaccatacgaaccgctcgcttccgccggcgtgctgcaccacgctgtggccgctctccaccttcactcccttctccctcatcgcccaccgcatccctgccgcccaccccttgcctaaacccatacccatggacatgagataccccgccgacttgcccggctccagctccagcacgcgggccgccgcgcttcgccccacctcgccgccgccgccatccccgcgcctcctgcacgcgctaagcagcgcgctccacgccgccgggctgccaccgccactgctcctcctcacaatctccgccgcgccgtccaggtcccccgcgcgcgccagcatgtccaccacgcacgacacgtgctccacccgaggctgcagcgactgccgcgccatgctttccaagcacccaatcccctcctcaaccagccctccatgagcgcatgcccacagagcggccagcatcgtgacgccgtttggcctcacctcatcaccttccgcttccatcctgtgcaggagcgcaagggcgtcccgtgcgcgcccgttcatccccagcgccccgatcatggagttccaggtgagcacgtccttgacgggcatcgtgtcgaacaccctcgccgacgcgcccagctcgccgcacttcccgtacatgtggaccagcgcgttgcccactgccagctcaaaccccaatccgctcctgacggccacgccgtgggcgcgtctcgacgcccacatctccgcgcagctgccgcaggcctccacaaggctcagcaccgtgatcgagttggggcgctccccagtcaccagcatcgccacgaagcatgccatcgcggcgtgtggccgggcgttgtgagcgcaggcggcgatgactgtgctccaggttatcacgttcctctcgcgcatcccttggaagagcctcagcacgtcctccacgaggccgcacttgccgtaggcatccagcaacgcgttcagcagagccatcgacaagagccgcctcctgatggccgcgccatggaccgacctggctgcctgaccccctagcctcttcttcttgcacagctgcagcagcaccgcaagcgtcgtctcgtcgcccaccaccccaatctgcaaggccaggagatggagcgcctcggggtagctgccagcgtgcacgaggcctgagagcatggtgttccaggacaccacgttcttgacggcgataaggtcgaacaccttcctcgcggaccgcagatcgagacatttggcgtacatgtcaacgagcgagttgtccacgaagagatccccttgcaagccccggcgcgtggcgacggcatgcacggaggctccggccctgacatcctccagcatggcgcacgcgcgcagaaccacgacggccacgacaccgtccggctgcagcgcgccgtcagcgagcatctccctgaagaggcgtagggcttgatcggcgtagccggatcccaggcaggccccgatcatggaggtccaggacgcaacgtctcggtcgggcatttcgccgaacagaatcgcggcggaggcgaaatcccccaaagtggcgtagagggagagcagggagttggcgacaggcgtgtgaatggaggcgggcgtcttgagaagataggcgtggatcatgtggaggaagtggtcggaataggaggaggaggcgcggaggagggagaggagggaagcgatgttggggtggaaggcagcgtgggcgtggcgcatggcgaagcggaagaggcggaaggtggtggaggaggaggaggaggcagggaggtggttgaggagggtattgtaggttagagaatccctgggcgtggagcggcagcgcaggtggtggagcgcgagatcgaggcgcgaggagcggaggtagtagcagaggagggagttggaggcggcggcggagagaggccgcttggcgacgtcggcgtggagctgtgaggccagagcgcgagcccagcctgatgatggctgctgcctggacaggagccccaacaacgccgggaggagcgccgccggcttgccgcccgcgtaccgccggaccgcctcctccaccaccacgcccgccgtcgccatatttttcgtttccactcctcttcttacttgttacactacatgggcagcatatcttggtaccaaatacaacttaaattaaattaattttgatccctgtcaaatttattcgattggagcattggagggagtactaaaaagcaatgtataatagtttgttaacattggagggagttctaaattgaaaattaatgtttttgtttttgtacctaaaaatgtgtacaagcgagttgttaaaggttaatatatatacatgaagagcaactaagaaaatgatgaaaatcaatcagtgaaatcacccatggccttccaaattaagggggaacataacatgggaatccaaccaagagagagagagagagagagagctaggcaactagtagctagaatgagcagatggaggaattaaggttgggagttgggaggaggcgtggtggtggtggctctttgcttgtcttcccatggctgggactgggaggcgacgtggtcgagggctcgggtgacgtctgtcatggaggggcggaggttggggttgtcgcggaggcagagcgaggcgacgacggcgagctggtagaaggcgcggcgggggtagcggccctgcaacgccgggtcggccagggcgaagcacctcttgcggtcgccggcgaggtaggggcgcgcccagtcccggaggaggaggaagcgctggtggtcctccgactccgagtcggaggaggcggcgtcgaaggccctgcgtccagtgatgagctcgaggagcacgacgccgaagctgtagacgtcggacttgacgttgagcttgccgctcatggcgtagtcgggcgcgcagtagccgtaggtgcccatgacgcgcgtggacacgtgggtgtcgtcgccgacggggcccagcttggcgaggccaaagtccgacagcctggggttgaggtcgtcgtcgagcaggatgttggacgccttgaggtcgcggtagatcaccggcggcgtcaccacctcgtgcaggtagcgaagccccctggccgcgccgaccgcgatcctgacgcgcgccgcccaccccagcgccagcgggggctcctgcggcctcctgccgaagaggtgcgcgtcgaggctgccgcgtggcaggaactcgtagacgaggaggcgctcgccggcgtcggcgcagtagccgacgagggagacgaggttggggtggtgcagcatcatgagcatcatgcattccaccaggaactcgcgggttccctgcgcgccaccgtggcagagctgcttcacggccacgagcccttggccgccttcctcgagacgccccctgtacaccctgccgaacccgccctcgccgacaacgttggactcgtggaacccgtccgtggccgccgacagctgcgccagcgtgaacttcttcgcaccgcccgcccccgccgacgccgcctgcgcggcctggctgcacgggctgccgccgtcattgctgccatgccagcaccgcaggctggggttccacgagaagcagctcatcccttccttcattcatctatcctatccattcatgtcatcaacacaaaagctttcatcctcgactcgacaaaaccaaaaatttggaggacacacgaggctcttcttaattaagcaaccagacagcttaatcgatcgatcgatgcttaaactacatctatatttagatacagcccaggacgcgcaattcatccaggacagagcacagggcattcttctgagtgttgttagctggcatatgtacatatatagatacataaatttcacaagaacattattatgtgttcacggcagaatagatcagattatttttgtaagctatatatcagtataacaataacaaacttttggaacagagttataaagtggaggcgagcttcatcccctgcttcaccaaaaagaacatctgtcgcaaactcacaaggaaacacagtgatcatggggaaactgttttaatccctcgaggagatattccctcgttctttgtatgtcacttaaatggttataaaaaaatttaaaaaaaatgggaaggtgtattaacatgtgatataacactccataaacatacaggttcaaattcaacttctacatctcgtaacgaaaaaaacaaattgaataacagctagttaacgtatattcagagttaaatttatttttttcgttgcgagatgtagaagttgaatttttacttgcatgttttgtggagtgatatatcacatattaatacattttcttaattttttttcaaattttttataaccatttgagtgacatgcaaacaacgagaggatatcccctcgagagggatcaaaatcctcttccgtgatcatgccattgccatacaaaatgcatccaacaaggcgcaactgctgttacaagcgcaggcatcttataatacaccacttcttttaaaaaatgtaattcggtttcttataaagtcaccacaccaacggtttgtggcagggtagcaacacgatgcatacttattaaacacacacaaacctaaaggcgagggatatagtttaagggcagtccaaaccctccacctaatatggtgtctatagcgttaactacattgtcatgtaggacttttaacttatgtggcactatattaattaagagagagagagtgaagagtggaagaaactgggtctcatgcaagacacagcttcaacacgagaacctatgcactagacactatcaagttttgcattgggagagaataatgtcttcataataggcgaagaataaatatgattggcagagaagagagatgatgtatttattaatggcccactctaagaaatcatgggttgtggggtgtagtttctattgtgatgtcttattgacatggcactatagacattacttatagacattatgggttgggactgccctaagcatgcaaagtgaaagctaaactggaacacagctgctcaaggccagggcaaagtagatgcctggatcaaatagttcattgcctggctcgtgaatcgtgattttgtcctgctggcctcctctggggttgatgggaacagctccatgtaccttgtcccaatggtcatcttgtccttgcatatggctgtcttcgcaacccctgttgttgagaactccatagagggccttcccatctagacggtacgcggtgtgcacattttcctccgtcaactcatactctacaaagaacttgatgatgtcttcagcggtagtaaagtagggcaggccacggagcttgagcacatcaggtggtgttcttttctcttgaagatgaagattaagttttttacgtaaaacgaggtggtattaacgtatgattgattgagttttaattattataaacttgaaaaatagattaatataatattttagagcaactttcatatagaaagttttcgcacgaaacacaccgtttagcagtttgaaaagcctaccacaaaaatcttaatcttcatccgacttttgttggagaaaagaatgggacctcaatatattccatgttgctcgtcttcagctggtttcttgggccgtggaggaggtggggagtgacgatactttgagtcgaaaaagccgtcttggttcacctcagcagctattgagctgtaatactcttgcttcttgcatctaaacacctcaacatacctcctgcccatgttctaccggttgcggtgcagtgcaaactctccttgcatggctgatgggaagacgacaaaagcctcgtcggtgaagcagccattcttgtgaaccaagaggcagtccactatgtccagcccaacaaagaacttgcaaatgtcaagatcgccgcagtcaaaggggagccctagtagacggacccctgaaaagttctggatggcactattagctcctgcactaggtaagttggcctggtagggctagtagaaggcattggtgccatcagcagcactgttgcccatggctccaaaaatagagaggggttggttccatcatcctggccctctttgatacatccaagggactgcctgcggtcactgcgaagtatggattggattccatcattcgtagcctctttgatccctcctacccatccaaacccccctccccccctcccatcattgcccatcattgcccttcagataatccagagtcccaaaaagagaaaagaaaaaaaaagagaggagaagatccccccatctctcaatccccatttcatataaaataacccaaacataaagaaaaccgcgcagataagaaataccagtaatctaaacaggacttaaggctaaaaaaggtgaatggagtcgaaatgcgaacgcattagtggtcataaacaaaaactaattaaatgttgacagcttatgaaatgctcaaactactagataacacatatcattagaaaataatcttacaaaccacattggtgcagttatcaatttggatgtaagtcagctattactgcctctgatttatttattttttgggggaggggtttggttttgtagggagggggggacgtacatgtatcctaaatactaggcatatgatatcatatcatatcatattatgatagcaaagcaaagtgacctacttttagatggggactaagaaattgtccctaaaagaatcgagaaattgatgagatcgcataagcaagcaagtaagcgtggattcgtagtattgtagaaaaaaaaagaaagcaatggatgaatcggcgggatggaattgcagggataagagagaaggaagaggaggaggaggtgaccgtacatggcgaagcccgctggaggagggggtggggtggcggttcacgatagggaggggaggaaaccctagagcgagagggagtcgtcaagtcgccgcctctgcgattgtgttgcaatgcgcctcgcatcgcccaagtagtcgtctctaaattctaaatacaacctatacgctatatgcataggacgaggaggaagagctcatgaccgaactgcatttcttgttgctgggtctggattaggcctattacttctattttatttttttctctagaccaaaataaccctgcctaattctctcctttctcccacgcccaaatcgcgcacttcccctgttgaggagggaggcgacgtcgcccgtctctccgcgtcggctccggcgccgacccactcccctcctccgccgccatccatctattcgcgccgcaccgcccgctcaactcttccttcgcgcaggcggcggcggtggcgcaggcggcgtcttcctccacctgatccacctccacttcctccggaccgcacaagaataagaagaagaagaagtgcaggtacggtgcaggtgcagatccaattgcgagctcacctgctctgccctgcccactaccaagtagtagcctcctcctcctcccctttctccccaacatcccatcccaaatcaaaggctactagactagtgttgggggagatccaagagatggcgcggagcccctgcgacctccgcatcctcctcgtcgccgccgctgcagccttcatctacatccaagtatgcctatgcctatcacaatctgattcttcttcttcaacttcagatcaggatcccccctctcctaaccaccactctactactctctcactacacataatggcttctttctccttgtttcaggtccgccttttttctactcagtcccactacgccgaccgcctcgcacaagcagtcagtctctctacccccccccatctcaatatactccctccgtttcaaaatgtctgacaccgttgactttttagtatgtgtttgaccattcgtcttattcaaaaaatttgagtaattatttattcttttcatatcatttgattcattgttaaatatactttcatgtacacttatagttttacatatttcacatttttttaataagacgaacggtcaaacatgtgctaaaaagtcaactgtgtcaaacattttgaaacggagggagtatatatttttggtctgctcaaactcactaattgcaatttaggaaaaatccgaaaaccaatgcaccagtcaactccgctccttgatcgatcaagtcagctctcagcaggagaagattgtcgcgttggaaggtaccacacatttatcacactaatttaagccttgcctctactattcgcgacctataaatgttgtgtctctcatgttttggtaacaacagagatgaagatacgccaagacgaagaacgtgtacacctcaagattttaatccaagatctcgaaagtatgaaaatgacctttcttatctttcacctatggatttcagccacaactgttcctgctaccaagtgtttgctacgttacttgatttttctcgcgcctcctaatgtttccattaaaacctaaccttgtgatactcatactggagcctcatgcacatcgacctccatgtgacatgcatggttgacaacacaacaacatatgacccgatgtttcttcttgaaattcacatgttttttttcctataaccaatagaactgaaaattagtatgtcttctggaaatatttttacaactacttattttttttaaaaaaaaatggaactacgaaaatgatgtcaatccatcagttagtcagttgtttagttaaacaatcattcataaatgcccaaaatataatagtggaacatcaggaccgtacatatcattctagttgtcatcttcacgttgaatacaaaataatagtttcataatcctcccatctaccccaaatatagaggttatgtttctcattaccatttgacatgtcactggcgtgtggctctgggtcccacatgccattctcatatgtggtagtgcctttcagtttacacccattcgcaacgtgctgaactaattttctcaaacataaagatgacccatcgtatgatctcaatcctcccagctgccatcgggctgcaggaatt

SEQ ID NO: 40393 - DNA, 710 bp, Oryza sativa
aacaagggagcctttagaataaataaaacggctacacatagtaataacactagcaattgaacaatgttggtagcaagtaaaaatggcatctcctagcagaccgacttgaacataaatacctacagaatcacccgctcgttcatttaatccgtagtattgactgcttagttgccgctccatcttcaaccagctagctgcacaagagttatgcaatggctgcacttatcatgacattcacaaaccgctccgacagaatcatgcggggaaaagaaaaccagaaaaatatggatactgcccttctctattactcctaccttcacaagcatggccataaaaaatcaacagtacaacatattaggttgcatgcctcaaatcatcaaatcaacagggataggctatctcatatttttctcaatacgaccggatctttcaaaaaaaatatttttctcaatatgaatccccatgactgtaggctagtgagcctactgaatgccttgctcctgcatttccctaacagattcttcttttaaggtgagctgactagcgtgtgatactcaacaaatgacggcgggcaaatttaacaggttatcgtaatttgcattgatttgacactatacctcttaagttaagagccttacccaagaaaaaaaattataatgcagaggacaagacaatttataaactaataccagggtgtaaagggctgcagg

SEQ ID NO: 40394 - DNA, 1122 bp, Oryza sativa
tccctcatcccccacggtatcctccccctctgcagcgatccagatcgcgcctccatcttgaccattatgacggcggtcggggcctcagaggagcaggctcctaagggccatgacgacgcaggcgggagccgccgaggggatcaatctacccccggagggggtcgtgcttctgggccccgcgtcgggggctcggggagcagccgccctaccgactcccgggggaagaggaagctgggaggaacacctcccccatctcctccccgagggggcggggcggtgcgcgccagcagcaggcgcccggagggggccgcgccagcatcgcagcccgagggggagcgcaagaagaagcggctgcgcaagatgggggagacagaaccatcccggggaaacctaatttcccctccaaggtggtcatttaccgaccccctcgcaggttcgtcccacgctcattgcgaccgtcttttcttctatcccaaaagcaagttttctcttacccatcttgtttgccttctggtttttctttctgcttcagtgatatctcatcgcgttcctcccaccatcccaagtccggccagtccgaggccgaagatccggcggccgcagaggcacggaggcgggaatctgaccggcgagaggccgcagaccgcctacgggaagctgaagaggccgcccgggaggccgcccgggctcgccaggctgaggataccgctcgggaggaggccgcccgggctcgccaagccgaagaagccgctcgggaggaggccgcccgggttcgccaggctgaggcgatggcggcttccgaggcagttcgcgacgaggccgcgggcgcctcgcttgggtccaccccttcgggcgacgcccaggaccaaacaggtccgggggcggctcgcgacgaggccgcgggtgcgtcgcttgggcccactccttcgggcgacgcccaggaccaaacaggtccgggggtggcccgcgataaggccggcgcgtctattggcgggccgagccgcgcggcatcttctccaaggcagcccttccccacgccttccgtcgccccgctgagcgcagagccccttctgcaggccttagccgccgcaaataccgcggtgttggatgggttaaatgccc

SEQ ID NO: 40395 - DNA, 10818 bp, Oryza sativa
  unsure (1)..(10818): unsure at all n locations
ctcgctaacaaataaagaagtaaataaagtatgtgctagttattcaataacaaaaaaaataatcaaggcatacaatattttgtacaaatgccaaaaaatgtataacattaaatttcaaatcctcgacttactgcaatatgtttgctctgcttatccatccaatacatgagcgcgcctcttattcgagcaacagcatcataccaaagtgacaatgcaggttctacacccagaggaggccaatgatgtttgcctccctcagcaagcggggccagtatacttgagagcatgttgcacaaagcatgttgcagttcactctttcttttgttgggaggacgatttagaggatttgcttttgcaatgaaagaaaccgaggcattcagtccaccctctgtcttcacctgaaaaagtaaattcttaagtatgtaataactacaattcaaactgaatggcattgttatgtacattggttcaaagatgatggagtgaatagagtatcagttaagttacttcttgtgtatgtagatatgtttttcttaacaaaattaaaattctgcaaatcaaaaggtacttttgggattctatgtacagtggtacacaagtaaaaactttggatgattcagattcatcaaagtgctaatatcagagcatgttttggccagtgaaagtggacttgtaactgaagcatggtagtggtaccatactacctgatagaacatttggaattttgtaagacagcatgccaagataaatcagattgtcattgccatgcactttaaatacttgtcaactcactatgaactggcacagaaaattaaaataataaagcgatctttgtatcgtacccccaatttaaggtagcgcatcccattaataatgctgagtgaatcacttctagaaagaggcgcatcattacgccgactattaagctccatgaaaaacctttccgtcacagaactaaacctgtatgaatcatcagaattttaagtaacatagacaaagaggtcatataacagtgcagcagcttttacatggcctccttccctccctaatttgaagtaacatggacaaagaggtcacatatgtcttttatttaaacctttccttcaatatattatatataattaaactgcaggggcctcccctgcagtttccttgtcaagaaaaaaaaaggccacataatattgcgacagtttttacatggcctccctccttcgcacacaccccttatccatgttccatgtaaatatagagcatacctgatacgagataaagctcccaaaagttgggcaacaagatctaagaggagacctcgcaaatcaaccaacgagggatactctacttggctaacaaccctgcagaaagtaaagaagttggtaagaaactcaacttctaaagaatataaagtctttttttcctggcaatcaagaaacaaaatctaacataatgacaaggttcgcaaaatttggcacaagctgaaagaaacaagaaagcaaatatttattgcacatgatgtgctgttttgatgatatgcaaagccaaagataaacaaatttaagatgcaccacaggcgtggatgtgttttatttatcatgtgagaaaacctaagtaaaaaaaaggcagtaatgcctcacctgtctgcattaattagccaatcaaatacaaaattttccaggccaatccaaagtttctctagataaaataaaacagctagttagccaacccatcagaaagtagccgtgcaaataagtcaaaatataatattataacaacctgttattccctcttgtgggcaatactcagcaaaacgaatgcaggctgaacagaatatgcactcgacagcaagctggataaggggtcagaaaacagacatgaggatttttagacgagagtacgcaaatgaaaatactatgggagtaaaagttttgagagatcagggatcaaataccctgctggcaactatttgcaactatgaaataatagagaaattatatgtgcaagaatgcctgtctgatgctgcttaatagttagttacaatcgaaaatgaagtggttcttgaaaaggagagggcaagggcaatcaacgacaaaccttcttttggaacgttgatgcgtcatgtgcgccttttggtgattcactgtgcgacagtgaagaacagtagttcagtaataaataagggagtgcagagaactcattgcatatttgcattgttcaataatgatttcggggaagcattaagggatagggctagagctttcaaagtcaaggtgaataagcatacctttccctccaccgaagaagagcttccaaaagaggcaaaggtgtgtgcctagcaaccatggcaagtgaatccaatacttgctcatagcttggatcagatggacggaggtattgcccatcctatgcattttcaaaaataaagaaatttagtgtcagatgtattttctgtaatagtaataacatttgccctgatgatataagctagtaatcaattttgaagttgttcatctggcaggtaaaataataatgcctcaagaaaacaagagaatgtctaggtagaaaggttcctccatgcagttgagctaagtagtattgagagaaacatcatcgtgctcttggaaacatgacccagtattataggtggagcacacatgtgaaagtaacgagaccatcaaaggtggagtacgattttgagcatttttcaacaatgtgggcatgtcgcagcacaagcaaatcaaattcaaatggacacgcatgaggaggcagtttcatagagaaggaagtagcagtaataacaatggtgggatggcaatgatttggagcactgatagaagcggcagcatagagcaattgtactttgaacatagggtatgggggaaatccctaggcctaagcggttggaagaggtggtgcacctgcaatcgatccaattcgaggagtgaattggggctccagtgagatgaagagggtgaaggaaagaaataaaacaaatcagagtgtggagccggaaccggaagggcgatctggaaggggggtgaaccctaggaaggaaggaggtgagtccgtcccgatcccgttgtttatccgtgagggagggaagaggcaggccccaatctggtgatggaattccgggcgaggcgaggcgagaggagagaggagaggagttacctgtgcctgcgcggtctcgatgcggcggcgggcgagcgggaggaagcgggcgaggagcgagtcgacgatctgcttggcggcgccgccggcgcccatgtcgggcgccgtgggcgccgcactgggcggagtggggggcaggggcggtgggtaggagacggagacccccgcggctgcaagcgccgcggaggtgctgaggtggtgggaggagcgtggggtatccagcttgtgctcgcgccggagccagcctcccgccgatgctgctgccgcctcttcctccttctgcctccttctgcctcgcctctcctgtcctctcctcgagtgctacctgtggtgtggtgtccccttcctcttctttcttcttcttcttcctcctctttaccaggcaccaagcaccaactgtttaggcgtcatcaacaggttacctgcttattatttactgcattttccttcccttctcattctcctactttaatacatgcaatgttttttctcaaatgtccctaactatgtttcttttattttaattttaacttgcaggtggcattattaatgcattccataaaaacaactacttttacataaaattgccattttagactttagccattttcaactgaatggtggattatctgattttttatatatatatcaacaaatgtattaactattgtactaagttgaagagttatttttaaaaaaagtactctagaaaatttacacataaagatttttttttaaaaaaaacatgatctataatcgggataaaaggagtgctccttctaatttcgacttgaggccatttgttcaaatagatcctccaagctcattctttcaatcaaaatagtcatcgagatcgtgttatatgggggcaaacacgcccaatacccatcgttgccatcaaaattattttggttttctcaaaaagaaaaggtattactatgcccaccctctttcaaacataaaaaaagaaaggaaaggaaaaatattctctttttatttttgaaaaatctactatgatactatgaatttggtttagcttatgtagcagctgtctgggtacaactttcgctagccttttagtccttccatgacatatttgagggtataatntcattnttatatataatctccatatttgatgttgagcatttatttttttgcctttgaaacaaatgacaaatacggtgaaaatgctaatgcgcgtcgtgcctttctatttttgcctaatttgttttcgaatcgggtcaacattccattttacacctcacatcgtgtggtttttttactaaatccaaatagttgcatgcgtgcttgcggcccaaaatatgctccttttgccttctgacctttttcatttaaatatttctatgtaaaaatatttacactttaatattatttatgtataaagtttatatatatttcatgtatatgtatatgtatatagtttccctacaggtataaagtttttatataaaagttttatgcatacaaaaattctatatgtggtgtttaaaactgatgaaaacgaatatgaagtttgcgcacgtaaaacgagaagccactagcacatgattaattaagttttaattattataaacttgacaaatgtatatatttgatattttaaagtaacttctgtttataaagttatcacacgaaacgtaccgtttagtagtttgaaaagtgtgctaatcggaactgagataaaatctgaatcttaataagaaaatagtaaggtgttaggttgatgagttgcatgtagctcataaaccaaaaacttgggttgaaaggagaaatgcgcacgtgcgtacgtgtctacacgggctatgcgcgcacacacttgcattagagcggtactagatacgaagggtgtgtttgatataacatgaactaaagcggtgaattttttatacttatgaatcacgtgatatcataggcatgttttttaagctcttacaataattttgtaaaaactttcttcattagcatttcttaacccatcaactttatcgtctatgttctcgaataattgccataagctcgatttcatcaatcacgcatcatcaagaatgcactctttactggaacccaagtgaccaaaatagatattctctcgaataattatattaacttgaataattatatcaagagacgtactccgtatcaagtagtaatactcaatttgatttataaaaatagttatcactacatttcaaagctaaggccgtgtttagttgcaaaatttttctttaaacttccaacttttccatcccatcaaaactttcctacacacacaagcttccaacttttccgtcacatcattttaatttcaaccaaactacttttgtgaactaaacacgacctaaatagacatagcacagtgtacaaggcatagcaccataaatggagccagtgctcagtgtagaatactactccactaataattgtgtgctgtggagtactactaaattgttgccacttattcggcatcaatgctcccttttaatactaggaagatggttgagggtaaaatagagagaaatttgaataagagatgattgatggggtaattagtactctagaattgctattattttgggacaaaatttgaatcctagaaatacaattattttgggacggaggtagtatgtttttttgaataaaaggtttacccgcagctttaatagaatagtttgtctggctgcttttaataatcttacttccaactgtatatatatagataacacgtgcctaacaatttagaattattagattttctaattataggattctaatgaaactatctaatctaaacttataaagtaagagaagtattggtccagatccagtgttttgtcagcaagagccgaggacaaggaaggcagagagaagtgaaaaataatagtaaacgggcctgaagggcctattcttcgtgcatcgatgacgggccgacatgtgcctagtgggccgattttcacacagtggactgcctgctgcttactgtgcagtcgagttttggctgacggtgacgggcaccgttaccatacatactactactactagctgtgtggttgtagtagagtgctccctccgtcccaaaatataccagccttgtactggatgagacatatcctagtacaacgaatctggatatactcctattcaaatttattgtactacgatgtgtcccattcaataaaaaatgttatattttatgatagagagagtagtaaatttaaatctaacatagattattttatttgatactttgctcatagtatatctttaccaattgatttattttagcagccacaatgataaatcttacttcctccgtttcacgatgtaagactttctagcattgtccacatacatgtgtctagattcatgtatatgggcaatgctggaaagtcttacattgtgaaacagaggaagtattaagctttcagagttaaaccacccccaaacacacacatctaggagcaccctttcctacatatccatacaagacaatccatcccatcaaaagcctagcttgtacattaatcagcaatcatttgttacttgggatccgttggtagaactcctaaatttaactccaaaaattatgtctaaaataaagttgtgaagctacctaaacctaactttacatatttagttcattttatgagagagcttcacttccatttataggtgaagctaaaactgtctagctgggctctagctctagaagaagtggagctggagctcgaggtgtgtcaaacagtcacttactatacctatgcacgactttcatctatccggcagccaatgaattttgtatcttccccttttatgtactctttgtgatagtttctaatgcagtgaatatggataaaaattacaaggtagcattacgtggacgtagagccaactatagtctgttgattgttgtacttccgctaatacttctgcaggtaaataaccaaacgatactattaggatgaaatcttttgaaagctggtgggctgagagcaggtacaatagcaaattattagccagctacgaaaatattttaatgagataaaagatgagagagaataacaacgggctacatatttgtagccagctgcagcacagactccaagacgcaatgtgtatataacaggtgggaccatatactaatagtgtagtaaacaattattatatgattggttattagattaactataaataaattggagctaataatcggctatactattaggcaacatatcctatgcacacgctacctatgatgcactcatgcactcagcctccatagaccctccgatttctatccaacggatacaaatcttaggtgagcatttttgcagaaaaccgcccgcatcctacacctaaatttacaggtaaccccctcgcttgcttttctcctctcttgttcattcttctccccagatcgatccccaatcctcttcgtgctgggcgacggtggcatctccaatcgccctcgcctacatgcgcgtcctcctatcgaggctggtgagcaagcggtggccgtccggcgccctgtccaagcgctgtatctcgcagccacatggttgttctctgctcgtggcctggttttgccagctatataggcgtggtggtggtggtcgtcacaacggcggggctcgcgctgacggcatgcagcgcatttagggtgtttctcttcaggtcattagcacacgatgtttgattgggtcaaggatgatcaattaggatgaatcgatggcttatggttctctttttcttctttgctgttaactgaatgcaaaagattttgttttgatttctccattcaagtcttatacataatttgaggtgcggcgttttgtgttaactggctgcgaacagtcgttttgtgctattgtcatggattcagatgtcaatatagcatctggtgtaaaatatattgatattgttagactgttccctctcttacagaaattgcaaaacactggtgacagtgaaatattgctgaaaattgaattgtgatctggatcaatttctcttcttgtttttgtcatcgattggacactggtctcctcctccatcggcaaggtcactgcttggaggtcagccgggccgtgaccctgcttgagctaggccatctcaacattcagctgtgtgtggatggatacgcaaccgtcggtggccatgatgcaggcacctcaacaagaaggcagcgcgtgcatcaacggggcgattggggatgctgccgtcgcccagtcctacctcgagagaattggggatcgatctggggagaaggttgaactagagaagaggaaagcaagcgaggggtttacctgtaaatttgggtgaataatgcgggcggttttctgcaaaaatgccgcacctagatttgtatctgttggattggaatcgaagggtctacggtggctgagtgcatgagtgcatcatagattcataggtagtgtgtgcataggatacgttgtcatactattggctaaccttgctcggaggtgaaaataaactcacgagaagaatctcctactccagcaccgagtgcaggggaggggatggggtggtggtggtggtggtcggtcaatactccactgggagtactggagacctggagtggagcacaggaggacagaagcacagaaattaatgccaggctttggagaaccccgaggaaacgagtatgcaggcatatctttgactatggagtagtagtatattccactgtagtcactccgtattatactattatactagcactccctctcttccataatatagtaatataaataaataatattatataaataaataatattatagaacggatggagtaaatatggtacttaatataaataaaattgttactaaattgtactagtaagtaaaaaacttaaatataacttttacctatacaaatgctattcaaacgcacaagtacccactctagaaacgttggctggtatgtccatcatcacttaaaaaatagctgtaaacctgagcataaatgcgaagtctaacgcttaaaccccgttgtcgaaacagttgagctacattcctttggcatacttaggggctgttcactttgttgtcattttcaaacttatcaaatttggtaaaattgttaaaaaaaagtgactacatttagtttgctgtcaaattttagtaactatataagaagttaccaaaattttggtaatgctaaaatttggtaaagttgaaaatggcataaagtgaacatgcccttaagtagaagctgattcatttattcttgttgcacttgctctaagagtaaggataatggtagagctcacttcctattattagcccatcttaaagccaatatatataatagattagctataaggttggctacaatattttcttctcctctctctatctcttaattatgcatttaatgtatttgtcttggatcttgtgataagctagctcttgcataagagccaacacccttgatttttcactacctctctcctccctaagtttatagtaggcttatagctcactattatacttgctctaaggccattcctaacccaatgattaggatggtgtccataacattaaataagttgccacctagaatgaaaattgatatggcaagtgaataaatgagaaaatagaaggaaaccatattttgcatgagacatggtttgtacacaacatccaagacatcatatgagataagtagcattaaatttaagtatgtaatagtgatgtttgtattggaagagtagtgtctagtactagtttcttaatgatgtggagcttatggaaactatgtctaatgtcttggattggaaatggcctaaattgttaaatcatacaagtcatcgtgttagtaagtttgtcgtaaaaagatacttctgcaatttcaaaatgtagctaactagtataggatgggatattacctagtgatataaatctggacatcccatcatgtactaggtatctatattttgggacggaggaagtactattttataagtaatatagttatagtgttaattttttttagaaaatataattaaaaaggagatagtacagtagtaaagacacataataaacataacagtgtgtgttggttagtaaatcgatgtcctgtgttctgttgtgggacttttagtaaacagagcagccaggggaagggcccaggcccaactaacaattaaaggcccagttacctgcatcttttcccttcttccctagtcttctcctctcctcggtgctcagttccttcacgtgctccagagcagcgtggccatggcgaccgcaacgcgagctccagcatttaaacccgcacccgtcccccgcttccctttgttagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40396 - DNA, 1119 bp, Oryza sativa
cccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacggcgtgggttcggctccccgtcgtcgccactcacactgggagagaggtcggacgcctttgcttgctcagccatgaggctgatcaagaaaaacttgacgcacacggaaaagtgcgagagctcagaaaacacacgctgagccccctacctggcgcgccagatgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgttgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcaccacctaacccgcgatttgaccggtctgtgactggtcacagaccgg

SEQ ID NO: 40397 - DNA, 1466 bp, Oryza sativa
ctgttctcctggaccacaagttttttaaaaaaaatcagtgccaagaataccctatgaagacgtatactacaaaattgttttggtttgttataaaaaataatatagacctgttttaccacctatgtgattcatgaatggaatactaacagaagtattactaagctgaaggttcttcatgaaagtaatataggtaggtatgtatcataagggacttactccgctcacttcatcatgataagcataatctggggtcttaaaaaaatctgcatcagctctcataggccatcctaatctgaaacaatctcttgacctgagaataaatgcagaaataatcacacaggtttccttagaaaagtagctcataaatttgaaacaacaaactaaaactcataaaagtagctcagaataaattaggctagtgcttaccaaaagtactcatttagatcatcataatttctccaatgtgagtgcttagattttgttgtcttgctcctttcgctcctttcactactttcactcctttcagcttcctatgtaaaaggcttgagtgtataagttgatggagctggaaacagagatatactttttttgggggggtggggggtaccttctcgatgactttgtatattggagtcacaactttcttcaaaaaggcttcttcatcaccaccgtaagccggtttaacattttcacctgtcgttggactcacatttccagccaacataccgtatagttcaaaagccatctatgagaaaacaatattacacagtcagcactcaccaaaataatctcatcacaagagttacaaatacagaaatatcccatcataattgacatgatggggaaagatgaattccatccaagatatgcttcctcatattatcaacgtgagcagaatgtgattctttgtgtatggcaatagctgtgtgcaactctcatatattgtcaggtaagtcaatgttattatggccaggaacatcatcagcattggagcctggactccattaagatccagctaactactttgtagatagaaaccaaatatggcaaattggaaatagctttgtacaaagaaaaaggtccgataagtcaattttattgtgaccagaccatcattgggtattcaggtaagaagcttgcgcaactttaagatccaggcctactagcttggtaaaaaccatatactaattttaaggggaaaaatggaagggatcagccatacgtgatgatagatgtagcatagacattccggcataaatctcaggttagccgcctcaccccagatgagaagataaagacccatatagaggagcttacgctgctgcacttcttgttgaatagttggcaacctggaaaggaaatgaccatctgatagtgatacatcaagcaagcttgagagaccttgtgcatattcgtatttttagattaaatatcgtaccataagctgcttttgcggccaaggtact

SEQ ID NO: 40398 - DNA, 26440 bp, Oryza sativa
gaattagacgtatatagtactgtaaaataggaggagtcaaagaaagaggagaggaaccggtcggctttgtcggcagcgttctgaagagcctggatgtacttcttgtagtagtgctggtagaagctctgcatctcgcgggcgtcgctctgcttgaccctccccttgagcgtggggtcgttctccctctccagcctctgcaggagcgcggtcttgaactgccggacgccacggccgctggacgtcgggtccagccggtgcgccttctcgaacgcgtagaacctgcacaggtacgccacccgcgggttgctcccctccacctcgttcgccacacgcaggatcggcgctatctccaccagcgacgacggcaccacctcgctgtcgaatatcgactcccccaggttccccgccgtctgcgtccgtaggatccgtcgaccccccgacgccgccgcccccgcccccgccgccggactaggactactctccccgccgcccctaggccccccaacccgacgccccgacgacgacgacgccatccaccctaccctacctaccttcctagtgctgctgcttcaagcccggaaatccccgacccgaggaggtgcagccggtggccggttgccccgcgcagcagcagcagcagcagtgggggactctctccactcatcacatcaggagtgtgagggagagctcctgcagctttctcctactactgtaaagcagaaaagatgaaaacgtttcttttcttttttgtttattttatgctactactactatcatgtgtggtgttgtatccctaacgtaaatgggatagaatggaatcatttgttggcctccgttttcctctcccctttgacgaaccgtttagaattccacgactccccctactttagttgcgaacaacacggtacacagcatcccagaaaaacattcggtggcaaatactactagatttttatcacaggttacaaaattcgtatggttttgacgcttgcttttatcatttcgaatcgataacagtagcgtccatagcaattggataaacttgcttcaagtcggacgttgcagtctgaaatgaatgctagtactagtcctgcagctgcagcaccagcacacacaccgcagcagcaacagagaggcagcgtgtgtgtcttttgataaaggcgaccaaacaatttcggtacaggggcggtgccggtgcgcgtcaaacttgtgtgtgtttgatactactactactacaacaaaatagattacttgttcctttctgaaagtaaaccaaaaagaagataaagtagtacgtgtaatttgaagcaggaaagacgatcgaaattttattcaaaagaaaatagtagaagcttaggccccgtttagttcctaaaaatttttcccaaaaacatcgcatcaaatctttggacacatacatggagcattaaatatagattaaaagaaaaactaattgcacagttaggggagaaatcgcgagacgaatcttttgagcctaattaattcatgattagccataaagtgttacagtaacccacatgtgctaatgacggattaattaggctcaaaagattcgtctcgtggtttccagacgagttatgaaattagttttttcattcgtgtccgaaaaccccttccgacatccggtcaaacatccgatgtgacacacaaaaattttcatttcgcgaactaaagatgccctaacaaggtcctaaattaaggttaggttaggttggaattccgtctttccttcatgaaaagttggcgtagatttgcagcaacgccattccatccatctgttatctcccgttctgtcttttagtagttttgtttctttttcttgttgagaatatagaaaaatgaaactgctactagtccatatatatttcaggcaaataattaaattgagtcatgtaagggcatgttcaatgaagaccacaagcactagtggtctcaaaacaccacgtaggatacaaccacacaaagatcacattaaccacaatggaaacaactccaaaacgtattttgcatttcagccactatctatttatatgtcagccttgtggtgtatcttattatcaaacctattaaaactttatattttagtccctataataactaaaagaagtatatatgcacccttaaacatcatgtggacccactgtcacctctccccctctctctcccgagtcttctcgtcttctccatagatttttattctctctctcccgactcccgagccgtatcatcttcttcttctgacactgtcggcgctctccttcttctcccaatccaccccgccaacgagacccttccccttccccgccaaccgttcccctcccagccccctcacgccgccgcgagcttctcatatcccctctcattttccctaggcgagcagagggcgatgagagatagttgggcggagcggatccaacctcatgctcgccggatctggcgacgcaggccacaacgacggcggatttgctggcgagcggtggcggggagcagcggtggtggtggatctagcgagcggcgacgcgaccacaacgatggcgatgagtggcgccgacgaccacaacgatatggggatttggggtatgtgcacggggggactgaccggacgaggcgacacgcggggctctgactcctcgaacgcgagtcttcgagccgtggcttcgcgtctcccgagcccaggcgcggcgcttcaagcattccctcttcaagcgcgctttctggcctgcggaaccacgcattcggctaccagctcggctcggctctaacgtggagccgtgtgatcacaggccgagtggagcgttatacatggccgatgtgtatgatgtgtttgtttatgtgtggactttataataattagttgtaattcgttgagcgaatgccaaaatgttattccattatcttaataaataaataaattgaggtctctgctctttcttcttgtgaatttgtatagcccagcccgcctgagatatggaccattcaggcccatcgaaatgagaaaggcctatatttatggttagttttggcccatctagtctgatctgatctgatccgatccgagtgagtaacgacggtcacttcccccctcatccactggccggccgtccgtcgtcttggctcgcggcggcatcctaaaccctagctgcggcatggagacttctctgcggctgcgcggcggcgggtcacgtccgcagtcaaagtcacaggagggcctccgcatccacgccaaggagaagctccccatcgcctccaacgcgctcctccaggtactatactatatcccgcctactcactccctattcattctcttcaccatcgattaataattcattcatattcccttgtgctacggcggcggcggaaggaaaggctcacggcgagatccacgccgccaccggcgccccgacctatctcgccctcctcttcaggaacttctatccccgtctctccgccaatctaggcctaggcctcgccatccacttccgcaacaaccaaccactaccactagcatgggacaacttctcctacaccctccgtgccagcaaggctatcatccccttcccctccaacgccttgctcgggatcaacctcaagggacgcctcctcgccgacaaatacttcaacccgggctgtctctacttgcttttattctacttgtacagtatactaccttacttaccttaacttgccaatgctgcctaccctcatgagcagaccgcccggactgctgccgtcgagttagcatggaccatacttgatctcaaaaggggtcaagatgtcaggctcaaacttggatatcaactcttgcacaaggtacttttctttttctttctttattcttctttatatatatatgcacgcccaccatcaccatctaaacgttacagccacaatgttctagctctacccacacaacttctgtgcttatctagcattttgtctccctttattctttatgcaaatgtctctttcctttcaatcaaaacaacttccaccacgagttctagaaaactaaaagggcatccatgtcttgtaaaggagcttcattcattacagattacagacacttacaatctcaccaaacactctcagtgaaaggaaacatcactagcaacgttgcaccaaaaccttctgcttaccaccgacctcccgagaccttttgtctctcacccatctacatccacttatctacgtcttgcagtcaagaccttggcaagctggctgagcaccgtgctgtcttcctcctttctcttgaaatacggaccaaagctatcagcagccaatggcatatactactgtttagtaccttccaaggatcatgtggaaccacacccctgaattgtgcattaatcctggtttcccacagggtcaatactgtaagtcaatattgacttagaataactaggtttctaccttttcctgtaaatctgaaaatatggacccaatggtgaaacaggtgtctttcatttcttggtgacatgccaaacaaaaaaggtcaatggaaatcaaatgatcaattatctccttggctctgatcccctcaaaattttgcctatacttattgggcctcccagtcattctcacacagtgcattagcctaaattatctgtcttctggtaatggattttctaaaagaaaatttatttgtttgcagatgccttatttccaactcagggaaaacaattggacttttaatgcttatatggatggaaaatgggatgttaggtttgatctgtgatcaaaaggcaatgaatggaggtagggggattctgtggtgatcaactaggccctttcctgtattccttttttttgcatcaatccatcaactcttttaaactgtactgcttcactcatcagtaagcaatgttttacagaaacctgtagatactctattgctttcatatgtagaactacaaacttaataattgtagctcttcttattcatggggacggaatattctgattctgtgtatagtaaccaatcggttggggccactagacacagccagtaaccaacactaaggtatccgcatcacagatgataccaccaaatcatgttggtgtgcattcagccataggctgtatcgtgcaccacatggctgatggtatggaccaagattgatactaccaggatcctatgggctgaaaaccagcaaaatagattgaaactgaactttcttggtcctgtgctcaatagtcatccttctctacttttttggtataaagtaccgtgataagctgcacttgtccccaccttttggcttggggctttaagtgcttggttgctccgttatactggtcctgtcttgcattcacggcgtggctgttactccagagaccaatgcagtgctgttattctaacgtggtgatacttggttgatagttcatacgaaaagaagtgctaatctgtggcatgcattgtttcgttttacccagagatgcacaggttttgcatttaggcatttgattggctttgttggcatcgcataggagctcttgggaaatattcaaagatagagatcattcgtaattggtttggtctaacatgagtggaaaaggattgggggtttggaatgctttggttgatatgattgtacgcaggaagaaaagttgatgtgtttgggcgtgcagccttgttgtttggctttctgggattttagataggaaggagtttcctccttttgcttcttcctttggtgcaatgataactgaagtggctggtcctatatagaagtagtacgtacgagttgggtgttgatcattccgggattgaaacaggatggatgttgcatcgtgagaagaaccggaggaccggatagcatgctgttgggcacattggaatgcacggccgatttctcatccttaaacaagtaagtggtactacttttaattggatgagttcataattgaaaaccatttgtgcagttgtatttgggtcacctgttgtagctcgttaatgccttctgtgtgttgtggaccctgtcagttggactgagaatatatagattcaggtgtgagcagagtgcagtgttggcagcagtaagcatgcatgttgagaaaatatctcatctggttttggagactggcatgctgagaaatatcttcctttagttgatgataagagggtgaggatgggattaggattggaattgttgacaattggcaacatggcaagctaggtagggagctgagaaaggcaacaaaattaaagaagaagtcggaggaagaggagaggtttgatgctttctttgcaatggtagtgtaggcagctgggtgcttttgggggacagggtgaggtggccgtccatgtccttttttttttgtgtgcgcgctttgatttgcaagttgcaatcggctccctcctcccgtcccggtatagcatgctcgtcgtctcttggtctttgttggtacgcgactgggaagaatcacttaatggagtgataatcaggaattcagaaatcataagtcataaccctacctcccgtaatcctttctttctgtagtgaataatctgtgtgtacattgaacatactacatacacggcccttgctgctgctttgcttacagtaagtttcaaagtgagagggggacagcaggagaagagagagagagagagagagaggtcgggtgagctggccgcgctgccacgtgtgacggtgtccacgtaggcgctgcctttgtctggcttatatatactcctactactctcctccacgtactactacgcagcagagcaaactcattcactccgatagattgattgatttgtcagtccgaggccgaggcggctccatccaagtcgagcagaaaagaatgcgagttctcgtccactccgccgagtccccggcaacaccggcggcggccatctccatcgactcggacatggtggtcatcctggcctccctcctctgcgccctcatctgcgtcgccggcctggccctcgtggcccgctgtgcctgccgccgccgaggcgccgctaccaccaccaccaccactactactacaccggctgctacatcccctgcacccaaaggcctgaagaagaaagccatcgacgcgctccccaccgtgtccttcgcactcaagcagcagcagcagcaggcggagtgcgccatctgcctggctgagttcgccgggggggaggagctacgcttgctgccgcactgcggccacgccttccacgtctcctgcatcgatacgtggctggggacccacgccacctgcccctcctgccgcgccaccgtcgggactagtacattattcctccctctccccggccgctgccggaggtgcggggaggtcgacctgcccacgctgcacgatttctccaccgccaccgccaccgcccaccacaacacacctccctagctacgtactccgatttggttgtatatgcatgatccatctttctcatcggatcgctgtttttaccacccatcaacagtgtatatatacgcagcacatctatctattaattatttcctgcgtctattataatcatcgatcacattagatgattgcatctcaatatgtatgtctatatcaatgcgcatgcatatattgcttcttcttcatttctttattttcttctcgatcgatcgccacccctcaaccatcattattctatatatactcctacagcccatctatatattcgatcgatagagtaccttaatttcaatcaacattactccttgatttagctgataatcagttactatctatcggtgctttggtttagttgaagctctctccccccccccccccaaaaaatttcccagtttttagtgcaagatctacactatatatgattatttcatatcgtgtacatatattatatgcatggtggcaaataatgaacttcttgcgtgttcgaagaaggtgtgacaagaacactgcttacttcttaattttgtcgtagtgttttagtccactgaaataatataatacttcctccattttataatgtaagtcattctaacatttcctacattcgtattgatgttaataaatctagatagatatatatgtctagattcattaacaatgtgagaaatgctagaatggcttacattgtgaaacggagggagtactatatgtcttacttaatttggagtgccatatatatgcataaattaaatttcatgtgtagtgtagatagtggcaaggcctgcaggaggcgatcaggtagctagtagagggcggggttaatttggtctccggccggtgttcctctctttatctcctggccgatgcttttccatcgcgattgatatgatgcacctcccctaaacctaaaagagcactccattcattggcctttactacatctaaacctaagccattgttggaggaattgaataaagtagagtagtagtagatgatacgtttgacctctcactagctagcagcccagcagcatagaattagaatatataatcaccgatttagtttcagccgttgcaagtgccagctccattactggactggactctctacgtcctttctctatcaaaccggtcccaacgaaacgatcgatcgaggacaaaagagaccaaaagaatggaacacaacttaaagcaacccgagaatccgtgatattatagtatttacttttttgaattgaaacaacacaataaactcttatcatatcaatacatatattctccactgatcggccctctgttcataattgtagtctcagataccttttccggctaaagattctgaatacctagatgaaaccttgtgtattactatgaaaatttcgtatgataataacataaataatatgtaagataattggacaatataattttgtatgtactttatataatttctcatatgattgactatatactgaaaaaagctacaaacaattaatatgatgtggtttataataatttaaatactgaaaaaagctacaaacaaataatatgatgtggtttataataatttaaatgttatgtagcattaatctttcaaaagcaaaattaaaatggtgtggttcaatgtgagaaggaaaataatatagattaatcgtccaaggtaaaactaaggtgatattacttcatgagaaggaatataatttttaaccatagatcaatcactctcccaatcatcttaaaatttagtgtgaaattgtacatatcttgtatcaatgccaaggaaatttaaaaccacttgttagttacatgtatctattttcttggacaatgtgggttacatcacaatcatccttccaatgctgctgcacaagccacaatcgtttgaggcaaaattgagagacacatattgaatgaatgaattaatggtacaagaattatagtgacaaaaaaggaattatagtgggcatatatagtagtaacaacaattttttttatctttaagaaagaaagaaagaaagaaagaaagaaaaatgtgcaaaacaaaaagaaatgacaaatgttattaatggataaatggtgtgttaattaatagtggtcgtcatcgtcgtggaggtttggtagggtccctttggctccgacgttgaagaagtcgatgatgacctcgagcgggaggcccttggtctcgggcacccgcagcgcaacgaagacgagcgcgacgcagcagacggcggcgtagatggcgaagaggccggcgaggccgagggaggcgagcatgacggggagggtgtaggtgacggcgatgtcggcgagccagaaggcgagcgagcagatggcgatgcagaggccacgcacgcgcgtggggaatatctcggcgcacaggatgttggggatggggccgaaccccatgacgaagcagcacaggtacaccaccacgctccccgtgcacaccgccgcgtgcgccgccgccgccatcggcgccacgctcgccgccaccagcaccgccagcgacgccaccagcagcgggatcgtccacaggagcaggctccgccgcccggacacgtccatgagccgcatggccacgccgatgctgggcagcatcagcagcgtggtgacgccgctgatgaggatggaggcggagtcgtcgcgcaggcccagcctggagagcagcacgcccacgccggcctgctccagtatctgcggcgtgtacaagagcacgccgctgatgcccgagaactgctgcaggatctggatcgccacgccgcacaccagcgcgtgccggacgccgccgggctccagcacctcccgccacccaccctccacctccgcctccgcctccttcttggtgcacaacgccgactggctcaccagcgccgccgcgtgcaccccctccgcctgctcctcgtgcaggtacatcctcttcaccgtgctctgcctcgtcccgtccgccgcgacgccctccgtccacttccacgccagctgccacccgccgccgatgcccaccgtgctcgtcgcggcctcgccctccatggttagcagcggcgcggcgatgtcaccgtcgtcgtccccggagttctcctcgtcccagtcgatgggcggcctgtcgtggacgccgatcatgctgccgaggttggggacgtcagtagtgccaccggcgggggggttcatgtcgtggaggctgtcgaggagggcgacgacggggtccttgaggtggtcgagcatgctgccctgtcgcgatgccagcgtgacggcgctgccgaacatgctgcctggcgccaatcccgaggacatcccgccgtagagcgtgaccttggcctcgtccgttgggccgacgacgtactcctcgatggccgtgtcgcgtccggtggtgagcccctcgacgaggagcgccatctcggcggacacgtcctggcgtcccctgagcatctggagcacggtcctggcctccttcatccttcccttgctgacgagccagcgcggcgactccggcaggaagaagatggtgaggaggaggtagaggagagcaggcaggaggaggacaccgagcatgaggcgccagttggggatgggcgcgagcgtgatgaggaagaccatgcagtaggagaggaacatgccggtggagccggtgagctgcggcagcgtgttgagcaggccgcgggtgtcgggcggcgccgtctcggagatgtagacggggacgagcgtgacggcgaggccgatggcgaagccgtcgacaaggcgcgcgagtaggaggatggggacgttgggagaccatagcatgaggaggccggcgagggagtagagcagcgcggaggcgatgagcatggggcgtcggcctcgggagtcggagagcgggccggagaaggtggtgacgatggtggcgccgatgagggaggtggcgacgaccagaccctggagtgcggggtgggcttggagcgccggcaagtccctcctcatgtagaggagagcgccggcgatggtggcgttgtcccatccctgaagcatgttgccgaccgccgccgccgccgccgccaccaccgcgcctctcatcttccttaattctgatcgtcctctcctctacctagctagccgcttcaactcaattcaactcgatcgggtaggcacgatgatcgacgcatgcaaattaatatgcaatagttaaccagccagccagcggcgaaatcgaattgatttcttgatcgatcgatcgatctatcacgttgttcgtatatatatatatagtacatgtgcatgcagatcgatgcagatgcatgtgcagattggaattggattaagccttgccacacggaaatgactcggcgctagctagctagctaccgagctcaagttaagacgtgcctgtccatgactaagtggttactattagtgcttacctactacgccagcttcaccagcccacccatggcatgccgacgcctatccagctcctccttgcataactcgacttgagcaattaacgagttgagttgagtttgaacttttattcgcatatcaacgttgttgttccgtgattttttttcgatcaataattaatagtcacccctccttaattttcttctcattgaactattatccattaatctaaatacatgtcttttagacaccatgatcagtcatttgttccttcctttctaactccagaaattttaccaaaacataacctttcattgcacgttataatcatgcatgatcagcaagcacgacttggtcagaaaatttagaatattttctataatattttttttgttaaactattattcaccgatgtgtaattgccacgtcctcaatatcttgggaacaattatatatcctaaaaaaggttctagggaacaattcatatttaagcaacgggacagataaagctgaactagctagttattaacacttaacacatggcacatactatataaatagtacagttttaaatcattaattcagtgtattatcgtgttaattaaatttcacgagacggctctttagcatcccaaaatataagtatgtactagttcagtagccagtgatggaattttatttttgtgaggaaccagtcctatacgtaagaccaataagagtaagattggaaaacatgatatcgaatactccctccagcctaaaaaatatcgttttagaccttttgaaagtcaataagacataaccttgatcacttaattcttttattatattctaaataaaaaatatttagttgcgtaggtataatattatgaaagcttatatgctaattaaaaatttgcagtaaaaaataaacttctgttgattgcactgattctaaaacaacattcttttgtgtttgaagggactattatttagggtgtctctaaaaaagaagtattatttagggttttcctaaaaatgggagcattatttatgtaactgttggcgccttttccaatcaacagggactcacctaaagatttatggtgttaacaaagttgccaaccaccccaatctaaaaactctaaaccaacatggatttaagagattaattggctagtggagttgatttagattgatttgaagataacactcatctcgcggacgaatcggaaggtttacgggacaaacctacaataggtattacactgtcgcagcgaaggcggacgatttatgacgcaaatcaacaaagatagacgaaactaaggtaaagtaaaaaacatggctaaaaaagtaaaggtaaaagaacaattcgatagattgtagggattatggttgggggttagaattgaatcggacatagctcgtataaaggggctggtcttgccttctcaacaccatctccacgttcaagaaaccttgggcccaagcaaggaaacatgataatcttaattgaacttggattcgggactgtcggtctgacttgccacgtatctgcggtcagactgtagttcaccctccataagccggtcacacaacggcggtcagaccggcctcctcaggaaagcttcggtttgttccatatctagcccaaacttgttataaatttctcatggtgccaaaatttgttgttaaccgtaaccattcaaaattaatgttgcatagccttagactcatctttcagcagcaatactctaatactcacccgttttgccccccatgtcctgcattacaaagtttgtcacaagtcttaattgatgattaaaaaaaatgacatatacacaggaaaaattgctttatatgcactctcttggatcaggtacccacatatacaaattgcttccgttggcatgcatgtatccgcaacaaaaccatatacatgcatagattgatcgatctctggaggtatatgcccttaattttattctatcccaagaaataatcagctgtatgcatggtataaaaagaatgatgaatcttgagagtatagagtatatgctactagctagcatgccatgcgagcgatccgtgagtcggagttgtgaattgaagtaattgggaaccatatttgcattgtttgtttgtttggcgttgatgcatcatctagaggaagaagagattgttggagaaggatcgtcggaagtagccgtagttggccttccaatggtgagccttccgttgccgatgatatcgatagcgcccttcttcatcattgcgacgaactcgccgtagtcgatgcggccgtcctgcatattgtgacgaattgaatgaatgaataatggaggtagctaggtaagtgccgttgaatggaagtaggggaaagtacgttgtcttggtcgacttcgcggatgatgtcgtcgatgccaacgtcggccatgttgtggtccctgcaggcgtgctcgagctcgtcgcggtgatgtagccgctgccgtcgcggtcgaagtaggcgaaggcggcgagcagggctcctcgcgctccagcttgttgaggtggacggtggcggcgatgaactcgtcgtagtcgatggtgccgcttttgtcaacgtcggcctgcaatatatatgcgcgaattgatcaagaagaggatatagatgcaaagaagattgagagattgagagaagtgaggacggtcttacggcgtccatgagatccctgatctcagcctccctgaggttggagccgtatctgcggagtccttccttgagctcgtcgaaggtgatggcgccgctggcgtcggtgtccatggccttgaacatctccttgaggccagcgagctcctcctcggagaggttccgggcgatgacacgcagcgccatcttcttgagcctgttcatggcggagaactgcttgaggcgggagaggacggcgggggcgagggggcggtcgggggcgacgccgtcgtcgcagacccaggggtggcaaagcacctggtgggcggtgaggcgttccctgggcggggagcggagcatgcggcggatgaggtccttggcgctgtcggagatggtgggccatgggtcggagtcgaagtcgagggatccccggaggacggcgtcgaagatgccctgctgcgtctccgcccagaaggggggcaccccgctgaggaggatgtagacgatgacgcccgccgtccacacgtccgcctcggggccgtagtgcttgcacagcacctccggcgccacgtagtaggggctccccaccacgtcgctgaacacctgcccgggcttgaagaagacggagaggccgaagtcgatggccttgagcgaggaggaggaggaggattccttgaggaggaagttctcgggcttgaggtcgcggtgcatgacgcccagggagtggcacgcctccaccaccccgacgatgacgcgcgtgatctccgcggccttgcgctccgagaagtagccgcgctccacgatgcggtcgaacagctccccgccctcgcacagctccatcacgatgtgcacgtacaggttgtcctcgtacgcgccctggatggtcaccacgctcccgtgccccgccaggtggtgcattatctgtatctcccgccgcacgtcctccacgtcctccgggctcagcagcttcctcttcgcgatcgacttgcacgcgtactccgcccccgtcgacacctgcgtgcacaggtacgtcgtcccgaactgcccctgccccagcttccgccccaccgtgtacacctcccgcagcgccggcgtctcgtgccccagcaccgccgtcggggacgacagcctctgctggtggctgcggatcggcatcctccccccgctacttgttgctgtgcttgtactactgcaactgcttggataccgatgatagcagtagtagtagtcgaccaaggacggtgaggtcgggctggacgtggacgaggcgccgcacgagtagtagttgcccatgcaacgaaacgacgatcctcaagagatgctgtttctctttcagcccagccgccgccgcatcatcgtcgacgacgatcctctctcttcccctctgtttccttccgtcaagcggaggcgtcgatcggagtcgatctgcagatgaacgcatgcagatggcagggaattaaggagaaagaggtgccgggaaacagggccgcacgctccttccaaccttggcgagcgagtggtgtgcgccgcgctacccttccttggaccgacgtgcgcgcatgcctcctcccttccttccctcactggcgatcaatgattgattacacaagctttacctacctgcaaactgtaatgcaatataattcaaaggccttccacaacatactgtactcgtacaatacaaacctcaattcagcttcattcattttattcgttgcatgtcaacacccacacatgtcaaaatgctgtttctgcatctcctagctacgcctcgccaggtgatgctgcaaccactagcttattgcaattcaattgccggcacgaatcagtttgctactacatcacacaattcacaacccaactgactgacaatcgttctggtcagcccaggaattacaaaacacaccaatccccccttcttctcctcccactagtgtccatgtgagccattccaaatttgacctaccggagcagtcctcccagatctgcaacacataatacatggcataagcatgactgccctctctgttttttttttaatctcattaacacaaaatccatttaaaagtcagcatgcctataatattcaccataatgcaagcaacgtcttaagacaatacagataaaccttttctatccccagttactaccaacacctggatctaagcaaagaaatttacaaagggaaagtttcaactaaaccacacacgtagtaagaggtttcacccacagcaaatctgcgcctggaaggagtttttcacaagtaagaaagcatatctctttttgtgattggaatgagtttttcattaacataaacaaaggaaagcagcagttattgccagcacattttggaaaacagagatcgatagcaaaaggtcatatatcaaatatcgagagcataaccgccaaagtctcggtgcaaaattaattagccatgcatttcccacattcatattattgttaatgaatctagatatctagattcatttacatcaatatgaatgtggaaaatgctagaatgacttatattgttaaacggagggagtaattaatttatgatgcctacttctccttatgattcatgccatccaaaaaccgaaaaaatgttgcctgtggactaaacagatcttgcaacaactcaacataacctcaaacatggctaacatgtatgtatcgaaatgccttctaagatactgaaaagtccagatatttaggcctattaaagtttgaatcttttcattcagagtaacacaattactagaaatcatcctgagctacaaatgttactctgaaactgctgtccaaaaacatactgtactacctatagcagttgccttaaaaaaagccaacttatttatgccaatgtatcagcggagaaattggatgtggtattaacagtaaatcgatgtccaaaacccctcactctcccagcattttccattgtccaagaatattagtgacccagtagaaattagtgaaatttgtgcttgggattgaagcgatttgaggaaatgcatacatgttgtgatcaatactaggagaatatctgaggcaccgtaaggaacacataaaaaaaaaagtaccttcctactccaaagtggaggtagagataaccctggcaccaactctatcgagctgagcaacagtagctgttgctttgagattgccggcattggcgaatgcctccaccatcctccggccaacctcctcgcccttctcctccccgtcaatgacagccacagcagttggccctgctccactgatggtgcagcccaatgccccagcttccaacgccgcggccttgaccgcagccatgccaggaatcagcggcgccctggttggctccacgatgccgtcggaggacattgcggagccgatgagggtggcgtccccttgcagcacagcggcgacaagcgcggccgcttggctggagttgcggacgtgctggtggacggccacctgtttgggcagcgcggcacgcatcttgctggtgggcgcctcgaagtcgggcgtgacgaggacgaagtggaggcggagggcaggtggggaggagagcgggatgaggtggaaggggtcgtagctgcggacgaggacgaagccgccgaggatggccggggcgatgttgtcggcgtggaagccactgacggctttctcggactcgaggcccgcgaggacgaggtcatcttggtgtaggagggagccgaagagggcgtcaacggccttggcagcggcggcggcggaggcggcggaggagccgaggccggagccgagggggaggcccttggtgaggtggatggagacggcgtgggacttgacatcgagggcgcgaagggcagcgatggcggcgactccggcgcagttgcggagggggtcgcgggagaggcggtcggcgagggtggggcgggagggggaggtgacggatgcgatggcgacggtgccggggggcagggaggggtcgagggtagcggtgacggtgtcgccgagggagagggaggcgtcggcgacggcgcagccgaggaagtcgaatcccgggccgaggttggcgacggtggcgggcgcgaaggccgtgacggagttgaaggccggagcggggtcggcgatggcgacggcgactttgactctccgagagacgcggacagatacgagcccaggcagcgtgtggcgggtggaagggaagcagggagccggagagggcgccgccgccgccgccgccgccgccgccatttggtactcggtagtggtggggggtttgggtggttgacgagtgggagtcgagtcgacccgtgtggtggagtgggtttaggtaactgagactgacaagtatggcccaccaaccaatcgcaaattcaccatcccatccaatcttgacgacgatgccgccgagatcgccgcttctcgccctcgtcttcctcgccgccggcgtcctatcctcggccacctctccgcctccgccgccgtgcagccgctcgtgcgccgccctcaactgcgactgtgcgtcgtgagcgcttacctccaactgattggcgtcccccaccatctaatcctccaactctttgtctctgcagccgtagggatccggtatggcaagtactgcggcgttggctggagcggctgcgatggagaggagccctgcgatgacctcgacgcctgctgccgcgaccacgaccactgcgtcgacaagaaaggttaggagtttctttcttcctctctggatctctctaccaattacttcactcctacaataataagcatactacacatttactctaactcaattcactgtcttagacttgaatgattgcacacgaaacaatttcagattgctgcacatcaactcacatgaattcaaatcactggacaatcaaactttatctactagcagagatactatgtaggagttttttttctttaaaaagaaacactagcagagataccccacttacgcgaaaacaatcatcttcaccctcttattcacaaccattataatgcttgcttggattgcctgatcatttttcactgggctatgcatgaaacatactatccaggggtgagagacaagcactgcagttgtttctttatgaaattttcctggtcatctcatctcttactgaaccaactcatgttagttcttctttttcttggttgcaggtctgatgagtgtgaaatgccatgagaaattcaaaaactgcatgaggaaggtaaaaaaggctggcaagattggcttctctaggaaatgcccgtacgagatggctatggcaacaatgacctcagggatggacatggccatcatgctcagtcagttgggcacccagaagttggaactgtagctttaatttggcttctccttacggaggtactccatttcttagatgatggttaaccgtatttgattgcaccaaagtttgattttttttttacaggaatgtattgatttgggcagcctaaaaagatttcttttccccttgctgcacaatttgcagcatatagtattttttttgtacaagagatttggcatgtaaactgaaccaaatgttccggctcactgggtatgggtaaaaagggttttcctttcctttatgctgtaacattatccatttactttgctttgatacgttggatcagtaggggtctggatctctttaacataataatgtaacactcctgagtctctgagcatgttatggacaaactctggtgcttgtgtaatcagtggcgtctgttgattgattgatttggtgcttgaggatgaaacagtaggcagtgggcacacacaactggaaagtgtgttggaaaacaaaagacattacacataagaaatgatagtattaccgttaatttgtagtatctgagagttattgaacactcttcctacagctagtagtacatactaatgtctttttctatatctggggccagtgaacaaataattatactgaaggtgaagtttactgcagaccattgatgagtattattagtaggatgttgtctgttcatattattagtaggatgtttcctaatcaaagatgaatgttcataagaatgaacaggtgatggtatggaattttttttgaacttttgtattttttattttaaaaatagatcttccaaaacttatttccagaatccaaaccttttgattgccccgttctaggtggcaaaatatcttgccatgcgagggaaggtggtgtggccaaataatgcagccgcgctaaccagaccgatgtgaccaaataacaagcatgcttgatagcccaaattttacagctgtctagctgtgttgtacagccaatccattcagctgcacacaaactactgctctcaacacttgctagattcaacacctataggttgtagctactagtggctagttacaactgttggttggctgcgttgtggcaaacaagtcttccgaacaaggccaatggccctgtttggatccaagggttagagttagtttgagctagttagggctcaaatagccctaaaggatccaaacatgaggggttagattggggctagttgcatctaacccaccaaaaaaactagcccctccaagaggtgcttattggagctagtttgagtggggcccaccgtagaagccacttctctctctctctctctgcccgcactagatccccatctcttcccgatcccgcacgggatcctctcgctggacgctgccgcctccccgatccacgccgccgccaccacggatccgcaccgccgtccccgatccacgcctccgccgccgatccgcgcggcgcgacctcccccactacccacgccgcgccctccctccaaccgcgccgccagccaacctcagcgccgccgccagccccaagccgcgtcgcctccatccaaccgcgccgccggccaacctcagcgccgccaccgtccccgagccgcgccgcctccgaccatccacgtcgccgcctctaccgatctgcgccgccggccacgcatggacggagacggcttcgacgacctcagtgcgtgggcttcgcagccgtcggcgagcggccctgccactgcttcctctgccggcaccggcttcgacctcaactcgcaagcgccggcggcggaggggttgaaatatgatttgtttgtgtcatttgtgagagggaggaggccacacatgagtctgccacaccaaatctggttggaaaggagccaaatgattggaaaagtatatttattgtcaatctaacccttccatccaaacatctctagggctagagttagttcagggttagttgagagctggaaactaactctaacctctaactctaacccttagatccaaacagggccaatattaccatgccagtcaaattggtgtgacatcgttgttttgtcacatcagttgtgctggtgtggctaaaatgttcaattcttcaaaataagatttgaaaggtttatttttaatattaaaatttttaaaaagttaaaaaaaatcgatggcataggagtatatgtaaaagcagctactcaagtctgatctgatgagagtttttaatactgtagtggatatgttgagtactccagatgagattaaggccgagtttagttctaaactttttcttcaaatttttaactttttcatcacattaaaactttcctacacatcagggtatcccaaaccgttggggccggggttaccgcgccccggtggtaaagcacggttaccgcgcggtaaccgtgaaaaaccgtacaaaatttatcaaaaattcaaattattttttaaatttatttgaatttaaggatgttaccacgatatttatattaccgtacccctcacggtaagcccggtaaccgcgcggttaccggcggtaagagaaaccctgcacgcataaactttcaattttcccgtcacatcgttccaatttcaaccaaacttttaactttagcgtgaactaaacacaccgtaatacaggtgagagaggggggggggggggagggtgaatgacgtggcatgtcgacgatagacaagggaaggaggggtgtgggaccaggttagcatagggtgctctgcctggaacgcctctctgtgctgtgctccactcccctcgtcttcttccttcctcggcccggcctcgctcgctgcctgccagctgcagctgcaactctccatccatcgatcgatctcctcctactcccccgccgccgccccgtccaagacaagccaaggtatgccaatccattcctacctactactacctcctcctcagcttcactcactagtctatctaatctcccctagtgagactgagactcgcttgccatttctgttcctgtgctaaattgctaagctacgggtagtgtcttgtgcagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtgtgttctcttccccggcccccccctcaaacccactcatttttagctggagttttgctctactaatctgtctgattttcgacaggtctccatcactcaggaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggtcgcctgctcactttgcctcacctcccgcacttgtacaaaagcaacagtattatgtggccaatcttgctgacttagttgttttcttttcatttaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaaggtacctacgaggttcttatgccacttattatatctaacacaagacatttaagaaacagaggtttgacattttctcattttggtggttcacagatatgcgccatttggacgttccttcttttcgccttacttgggtaggaggcaaccccttggtgagggattggaaagctggcgtggattttaccagagcattcggcctactcagatgggcttatcactgaatattggtaaatctctctctctctctctctctctgatgtgtgcatgcatagctgaaatgtaagtcatattctttgttctattgcatgaacaagtgagcaagaagaaagagatagtgcataggtctcagtactttttagatttgagtgctattttttgtttcacgattgcaattacattcctattttcaactggaattgttatgtgattcacttacatcaaatttatatgtttcatttgggataaatgcatttaatgtccttgatgattcttgtgccatattgagcatttgtaccttttccagatatgtcagctacagctttcattgagccgttacctgttattgattttgttgcacaactattgaattctgacatccattcaaggccgctttctgatgccgaacgtgttaaggtgctcttactaaacttacttttcgtgtgactgtctcatctgttagcaagggccaattctcaaatgaaatttacacattcttttttttttaaaagaaagacatgtagatctcttgagctatgttctatttttccctcaaaacttgtatgtcttgtcccactttcctgtctatcttagtgggaggtttgtttctccttatagatgcaactcattaatctttatgctatttaatgagctggctaatgctcccgcattgagatatttcataaaaaaatgacgagattatatattcctaaaaaaatagcattcttattgtatttattgtgatgatcggggcattgtgatttttagttctctcatatcatccgtacttgacaataagattatatctatttctgacaatgtacatgaggattgtacaacataaaatcaccttgccttccaaaaggaaagatagagatacttgtgataccagtataccacacagtaattgtattgggcctacaatcattaattggttagcagtgtaagagtgttgcttgtctgtcccatgtaatagtactctactctatatattgcacctttgggcttttgctggaacgcatgaagtccctttttttcctggcagctcaaggaatttttttaagttcttttaaaacaagaaatgcagtagaggttacaagaagtcgggaacttcagtttgggattttttacactttattttgcttttcctggttgacattgacttctctaaagttttcctttcagaatgtatgtatgctttaacaatttaatctctatgctcccactgtattgaaacactagatcaagaaagccttgagaggagtaaaggtggaagttacccaccgtggcaacatgaggcggaagtaccggatatctggtttgacaattcagccaactcgtgagctaacgtatgatttctaatctgtgtgttttaccaagtaatctctaaggtattcatagaaaaggccctgtgatgctactttcgtatgctctgaaaaaaatatgttgttctccttgtggcagttttcctgttgatgaaggaggcacagtgaagtcagttgtacagtactttcaagagacatatggctttgccatccaacacacctaccttccatgccttacagttcagcgattaaattacctgcctatggaggtaatgtagtggtgaacctttgttgccttttgttgtaatgaatttctacaacactggcccaactttacattttccatgttcatattgaaaatataataccaaacactggtgctgttcaattttggattcacggtgattgcgactgaatttaaccaggtctgcaaaatagtggaaggacagagatactccaagagattaaatcagaatcagataagagctcttttggaggagacatgccaacacccacgtgatcgggagcgtgatattattaaggcatgaaatttgttatcacgtcttagtggtgcaatattgtgtgcgtgattaatgtttaacataattctcaatttctctggtttgggatggtacacagatggttaaacataacgcttatcaggatgatccttacgcaaaagagtttggcattaagataagtgatcgtctggcatcagtagaggcacgaattttaccggctccacgggtaggttgactatggctttgttgaggctttgttgattttgatgtactttcttgttatacccttcttgtcctttctaactgtattgtggatacagcaaaaaaaagggatgcaattaacattttctcctatatacttgtagccttacaaatatgtttttttgttatattttcttgtgatgcagcttaagtacaatgagactggtcgagagaaggattgcttaccaagagttggtcaatggaatatgatgaacaaggtaaccacatgaacattctgttgtccagcaaccatccatttattggcacaaaggcta

SEQ ID NO: 40399 - DNA, 724 bp, Oryza sativa
gtccctcaattgctgctgtaagtagaatatcgcctgtgacctgttcctgaattttttttccctggagggtaataatttactctgcctacgctaactatatatcgttttgcaggttgtagcctcccaagattggcctgaggtgacaaagtatgctgggttggtttctgctcaagcccaccgacaagagctgatagaagatctatataaaatctggcaggatccacagagaggaacagttagtggtggcatgatccggtatgctactcagtattttttagtagttctttccttaagaacttcacagatagttcttcatttttaaaataacatgatattaaagcccattttatatttatattgccaaaaaatgcagtgagctgcttatatccttcaaaagatcaactggtgagaagccccagcgaataatattttacaggtatctaccctttaggaggaacaattagactttctatgatttatagatttggaaatattatatgtgctatatccatgatttctgttggatcttttgaaacatagcaacatgttgaatttgctagaggggacatctcttccactgaacaggaaacaatcataattccactaaagccggatcttgttttcttttgtcagggatggcgttagtgaaggccaattttaccaagttctactttatgaattgaatgcaatccgaaaagtaaaagtttgccagatcctgtatcct

SEQ ID NO: 40400 - DNA, 743 bp, Oryza sativa
attcctgcagcccgtggcccacaaaagttaaggacatgttggaggagcagcagagacgaaccttggggcaaagagcagcatgttttgatttcccttcgatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcattaaagaacaacacacgaggaagaagaaggacaagaaggttcaagaacgatatggacaaagcatacaaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtaagactgtgggagggggtgagggtagcacacaggtgggattggatgacattcatttgctaagaccatattgttgcatcaatgtttactttctgttgtcctcctttccgttctcattg

SEQ ID NO: 40401 - DNA, 4817 bp, Oryza sativa
  unsure (1)..(4817): unsure at all n locations
ttttgcaattactaataattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggtaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccgcaccaggatgcagaccgacgtcccactgtagctcacctgtgggaatcggccccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagaaggcggcaccctccgcaacgccctacaggtaatcgttggaaagagatgaaactacggtgttttcttccaaaagcgataacttaacatggattattttttatgcagagactacggtagcgatgtcgggagttggcagcaaggctcggctgcaggtcgactgatgtggtcgaacatgctcatgcccaccaagagggggatgaagaaggggaggtgggtgacgaggagggcgagcaaacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactagaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagacgaggatcgatgggatgcttttatttcttatatatatggacttcatatatggatgtattgatggattctatggatgtatggaatgatgttgggattgatggatggatgtatgttttgtatggttctctggatatattactgcctgtaaatntctgtgatttgatgtttgcctctgttgtgtgcaaagttttgctaaagtttagcagggctgggacgtcagcgccatgctaaatggcgctgacatgtccaaactcagcgccagtgcacctggcgctgaggtcccagcccagccatccagaaggcttgctgggctgggccacggccgaaacggccaagtcccacctcagcgccaggtgggctggcgctgagtttccaacagtcagcgccattatggctggcgctgaggtcccagcccgcaagccatccagcaggcttgctggtctgggccttgggggttgcggccaagtcccacctcagcgccaggtgggctggcgctgagtgtcccactgtcagcgccattatggctggcgctgaggtgccagcccgcaagccatccagcaggcttgctggtctgggccttgggggttgcggccaagtcccacctcagcgccaggtgggctggcgctgagtgtcccactgtcagcgccattatggctggcgctgaggtcccagcccgcaagccatccagcaggcttgctggtctgggccttgggggttgcggccaagtcccacctcagcgccaggtgggctggcgctgagtatcccacggtcagcgccattatggctggcgctgaggtcccagcccgcaagccatccagcaggcttgctggtctgggccttgggggttgcggccaagtcccacctcagcgccagtccggttggcgctgaggtagctgccacgtcagctggagatcggcccggccgccacggtagcacaatgtcagcgccagtcccgttggcgctgacacggccaacgtcagcgccaatgtgtttggcgctgaggcgacggcctatttttggttgaagtttttggcagaggttagtttcgaaataagttttccaaaagggtcaatttgtcaaaaaaagggatgaatatgcctatacaggctttacaaactccagtaccagaagtaaccacttaacggtaccggtccgtatttatagagctagaggtgtcaaattttggcgtatcgtttagacaataataaaaaaactaatcacagaatctgtcagtaaaccataagacgaatttattaagcctaattaattcgtcattagcaaatgtttactagtaccacattattaagtcatggagcaattagatttaaaagattcgtctcacaaattagtatcgagatatgtgcaattagttattttttagcctatatttaatacttcatacagatgtccaaatatttgatgtgataggtataaaatttctgaacagggcatcataaacagctgacaaaatttctggaataacagcttctcacgatgaatggtgaattagattgttcgagagatgtttcgactctacggtagcgacatcaaacagattacatcgtctccgtgcataaatgaacacaacaggtaacaataataatgaatcaaacactacactggagtcccttccccttcgggatgtcaccaagcaattccaatatacacactagccaagaaaaaaagaaaagaaaagagcttgtgccactcgctcatgctgtatgtatgtgtatgtgcatccaatgaattgcagtctacagctacaaccatacttcaaacctgcgacctctgtgaggttgcaggataaataaacacattccgatattacaacagtcaaaattgagtttggttagggtagtctttcggtggcgggaagtgctgcttcttctatcttgtcaacctgtgcacagcgatttctggatcacgctcctagctgtacaaaattggctgcattcattcattcagttagcacatatagccaccaaacattttacataggtcactcaactgcattttctacccgatgttcgccacaaacggcacaaggcgcttatgatccctcttacgcccaagagcgcatgtatcaaggacacgcccaagcagcaaccgggtattctgcagcgccacatctcgggtggccactccagtatctgcagcgctgccaccgccttgccccattagagtcccaaaccctgaaccggcagcagcatattgaagaggtccactcctagccttgaatgatgattgaggaagaagcatgctttggtgaaccttctcccccatcccgtgaccattctcgccaaatccaatatcatcaccttgaccaccagttacaccgctgcagctccgtaggagcgcctccaacacattcaatgcctctgcacatagtgcgctctccacgagctgtgacacaacattgtacacttgaggtatctgagatggatccactggggtttgctgcaacagtgatttaagcatcagaagcaccactctctgataatccagaggacctctctcaaggagcctaagcaggtgcccaaatgccagagatgagtgcttagggaaccactcggaacatattggcggcgaagcgcgtgcaaaaagatcttctagggagatgatttctccaaaggagtatgctctgaagacttccgctaaatcatctaaagatttgacacggcaccacaccgaaatgttggatgccacatagtaagct

SEQ ID NO: 40402 - DNA, 1245 bp, Oryza sativa
cttgctcttcaccacgctgacgatgacggtcatggcgttcatcctcaggatagacattatgtctatcagagacctgccctgatctgggattattgagccttctttgcttcaatagcctttgccgcaaatctgaactgtctgcagtcaaaggcataggttctctctgagaaaacctactctctgacaacaatttctcagctgaacctctgtgtgacctttcaaatccataactatcatgagtttgcctaagcatcccaatgtgctgctccccgttagtacgacggtaagcaccacggtcttccctgagtgactgttcagtattgtcatcagcaccaccagtaagaacatcagaaccaggagaaggttccctcacaaattcacccatctccacaccattttcagctaaatcgtctccagttgagggtggaggtcggtaattctttgttacacccgatggcatataagaaccttttttatcatgaataattcctgacgagtgaccagccctgtttgtcaaattttgcttctgagcagttttgccattatgagcactgtccttaggcttgtcaaatatggcaggaggtgcattctgctgagcagaagagtttggttttgtccacgagttcttcaactgaggatgaggcacagaagcaggagcaaaaacctttgttgtgtgctgaggggcaggacttccagtagcctgtggcaaatgcaagaaggcgcacctatccccttttacgcacatgcccttttgaaagtaataacatggaactccttgcttggctgtgccactggcaggattaggcacaggagcttgagcaggcacagaaacctgtggtgcagattgttgagatgttcgtggtgttgtgggtgctccgaccaggccatccaacggctgaaaagtgagcaagattattagttatcaaccccaggttgctcgtagtatttgattgagtaagtattatcatgtgcagttgtgtacaagaattgttgccacaagaataagctaattggagaaacttatatagtagcttacagtgtcggcatgtttcgcagtggcactaaacatataataattgcagtagttttggttgaagaaaaaaaaaacggagagcaagggagtaccgggtgcctgaatgagcatttaggattagcgcagttgccattgaaccaataccagcaatccctaggattcatcctggcagcatcactatgacggtactcacattcacttccctgagtgag

SEQ ID NO: 40403 - DNA, 962 bp, Oryza sativa
ttatagctcatcaatcaagctatttcccccacatttgctcccaaactggagtactagtcactccctccctataggtatgtaagtccagaaactccagatctacctttgcctcctttgggtcccaatttctgacacacactctagtctgcttgccgcacgtacaagtacgaatgaatgaatatgccgtttttttgacaaattgacccttttcaaaaacttaattcgaaactaacccctgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcctaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcgacattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaagtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttt

SEQ ID NO: 40404 - DNA, 925 bp, Oryza sativa
aacttgtcctggtgttgccaacataaatattaggcatttgctgcaaactactgtttcaaagtccaaacaaattcttacctccttgaggtagctcaggtcctcagaattccacttgatctatagccacaaagaaggaagaggtaaaatggtaaatctctgcactaaagaatttgcaacagttaagcaaaacaaaaggtgatggaaggtttgcatacatgggcatcatttagcttgattggttccaagtactgtctgaagaattgccccatgcttgacccctgaaaaggaggtatgaaaatctattagtgtaaattcaagtcatccatacttactggctcaaagactaaattactatccagtggctactagtgtgcagaaatgtggtaatttttgcattgatgaagtagccaacatacatgttcgccaaaattgtatgttctgcagacttccgggcgaataaattgccggtctctgtgtacctcttttagcctcacccagtcatcccaataagtaaagtcttgttaaggaagaaatatatggtagatggaaaatattgtatatgctaatataaaaattagtaggcaacagtaaagatatgctttgggccacttaggtgacagctcaatccatgtaggctttgttaacatccatccaagtccaggaaagaaatccgaccggtaaagagcttctgcaaaatgtttatgtaggaaaatgagtagctttccctattaatgcagaacagaacttttatacaggtctatcagagtactaacttgggtcgtaaacaaattgcttttgtccattgtcattccaggaagaaacggccatgattgtccttcaataccacagtgacaggaatagcagcaaagcaattagatacattgcagatgaaatccttggctttccaactataattaatatataa

SEQ ID NO: 40405 - DNA, 13212 bp, Oryza sativa
  unsure (1)..(13212): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaatagcgatttagccggtatatatgtcttttgtaattgaatgctgttgtgttccctctctctttttttttaaaaaaaaaaacagaattcaagtggcgcagcccaacaaaggaaggccacaaacacagaacctcctccgatgggccgcccgctcccgccaatgcaacgccgcatctgctccccagttacccgcccaatgccaccgccgtcgcggtctcacggatgcggccgcatatcgtgcgtccccccaccaccgccgcgtcgctgtcttcacgtcgctacgtcgatcagtcagcgacggcacacgggcgcctcggcgcgactccgaagaagcgggcggcgatcatcacggggatggcgcgcgcgcctcgcgggtgagaggctgagagcggcgtcggcgccatcgaccgcttcgacgcctcaaccgtcggcaccggctccaatgtggcaaaggcctaaggtggacatcacgcaaactcggctgatcacgcgccaacgtacaatgctgctaacttctcctaaaagctttattaccatagtctggtactctgttttggcttatcaacccgcaggcaaacttaaattttagaaattaaatccagatttttattttaggtttttttttcatcagaatctatttttagtctttagtcttttaaactgttaaaattttgtccataaattaattttaattgttattaaattgtattagtagtttcgatccccgctggagtaaaaggcgaaaaacgatttaagtgattcgttttttgtccttgggaaaaagaaaactaattcttaacctctttcatatgctcatgtattgtcgaggtactgtaaaaggaaaactcataaaatcccatttgatgagagatgatggaatagctactgcccccatttatcttctactgcatccggtttagaacgttatgcagcatacgaatgtaagatcattgaagagatatttcctttttgtaacgaaattctgttgagccaatatttcagttgctagatacatgtctgttgccagtcaatgaaagcagcatagggcattgccttggcacacagcatgcggtttagaagccattgcaaaattgcaatcatcaaagcgacaaccaccggatgggtgcatctaaccataaaacagttcgtaagtatacaactccaaaagaaagcgtggcatcgatacccactcggtctgtcccttttgtgctcaggagcttgagaagacgaaccacatccttctcgactgtgtgttcgctcaacaggcctgactccgtgtgctgtcgccttttggttggactgccctctctccatcccgtggcagctggctccaggactgatggccatcttctagggcatgcttacctgagcatctccgtgctggcttcgactccctggtcctcctggtcccttggcagctgtggacggaacggaactccggggtttttgactctgcactcttttcggtctcagtgattctagagtccatctcaagagtcatatatggtcgttagctggcattgctacttttggggttttcttgggagggtagtgtggttgcccccttcctgctaattggagttgcgtagtctcttccttttccgcggtttttgtttttgttttttctccttcccttggcataagttaatatgactgattgcggtgtgtataaaacactcttttcttcaaatatattgacgtgcaatcttttgcgcgttcgcgaaaaaactccaaaaggaggttagcaattgctatatattagtaatagtaccaaagagtacatgtgctttcttgctaactatgatcacataaaagaaaactttaatttccactaataatgtaggtaattcacctagcaaaagagatactccctccattttcaattggccatcatataaattttcgaggctatttccaaataatcatcagaaataattcccgaataatcatcatattagtacatattctctaagtctttttattatctaagagtaaatggatgttggtgcatgcatccatacacacaatatgcaatgttttgatttattattggattgaaaatagtggagatagtgcatgcatcgagttcgttaccgaagtaaatatagtacgaaaaagttattgggttttcttgatctctatgtactcatgtaatatgataattaattgaagaaacgcctaaggattttccggctagctctacaaggtggtgggctagacgatcttggttcgaagccccaccccttctaattatttgatatgacaacctgagtttgaagcctcaccccttctaattatctgatattagattctttcctaatattcgtgtatttttttaaataaattgggaatggagggataaaccttaactattctactacccaatgattaatgcatacaagatacaaaatgtaacctcttctaactcagtaactgccacccaaacagacaacagccagttggatcccatgctctcttttcgaaagaagctactatattgtcccattcgctcaaccacatggcaaattgagtttcctgatgtttggccggccaatcacctgtgccatttgtttgctgttgtcttccaaatcattggcctaactctactacctcgtgcctcagaaaagatgctgatgctgctaaccaccaaaaggttcagactgagggtatttccattttgtcagtggttcgaacagacaatcagagaaagcaatacaagtacagtatgaaagttgtacctcgtgggtataaaacagaaaggccttccgttacaacagaagattagtgatccatcctacctctagaaagcagatttctagaagataacaaacaatacaactgtatcatgtagatctctgccacacacaagcgaaaatgatgaactgcgcaaagtgtcatgaaaaaaaaaatcagctcaagatagtgccacttgcgatatggagcaaactgcagaatcgttgggtctcgatcgaagcgtgcgtgtgagttgtgactgcggtggtggctgtggtggctggacacgtttggtcttcgatgtagacttgctgcaaatgatgggctcgtagatgatacccggttattagtggttgctggtatgactgtacatgtatggcttctttccaacagaatatcattagccattacggtggaaaatgacccaaggacggatctgcccattagacagggtgagtcgaccgacacagctacgacccgtgtcgtcccacatccctaagatctcctacctccttatagtatttattggccatcaaaattaggtataataaggtgtgagcgtctaacaaattagtccgtcttttcacaactcacgcacgtcacaaacaataaccaaggcagttatgagattgagctataaatacgatatgtgttgtgttcggttcgtcttatcgactaaatatctccgttctccgccctttattttaaagttgcgtccgtcaatctcaaaaggtagctagctgcatgtcccccaaaggccccaaataatagccacagctaaatgcttatctcaagcacagtactcaaagtgctctagtccaattttccggagtcaaacttgtaatgttattgttatctgcttttctgagaaaagaaaacaactttttaacattatcgctagttaggttagtggttgtcttagagctaaggttaggagaatatatgcctttatccctagccaggctagccatattctttccagtccagctgaggatctgcatacaaaatgaccttactatataatacaaacagatcacgggtctaaagtttaaatcaggaatgatcaaattaatgaatacatctctttctcacctgcacctgctgcacagttcattctttatacatgtcttcggttgcacacatacaacaaagcttcacttccaagcttaaattcgacatgtgctacatgcatacgaacgaacttttagttagtcagtgcttcactttcttcttatatataaaacgtcggcaacgaccaaccgttcggaaaaaaaaaagttagtcagtgcttggtaaaaaggacgtatatacatagtataagaatcgcgtttttggacaaaggatctcatcttagtcatctctaaaagatcgccggtttcacgctggatcgatcggccggcggctagcgcaccattgcaggctaaggcggcagtgcgtgcgtgatgatgcggacgacggccggtctccactttcgcctccacgtatggacggtagctggcgcccactatttgggtcgtcgtcgtcgtcgtcgacgtcgtcgacgacgaccgcggccggccggattcggacgccggttgtggccacaaggccgccggcataaggaagacaggaatgttctgcgtcgtgttgcttgcgcctctgcctgcgtgactcacgggcttcgctggctgccatgttaatcagtactctagctaatgctatctttatatcccaacctaaaatttttcatgtcatattgaatgtttaacacccatataaagtattaaatataggctaaaaaataactaagattacgactaatttacgagacgaatctttaaagcttaattgctccatgatttaacaatgtggtgctacagcaaacatttgctaataacggattaattaggcttaataaatacgtctcgtggtttaccgacggattctataattagtttttttattagtgcccgaacacctcatacgacaccctatataatatccgatgtgacacgctaaaatttatacacatagatctaaacaccccctaagatctacagactgattgatgaagcttcccgctggttttacctcacaccgagagctgtctttttgtcagatcgactcacatgtatttttgtcaggctaagtgactgataaagaaccgttcagttttctagttaggccgtgtttagttcattgtcaattttttttacgtatacggacacacatttaaagtattaaaaatagactaataacaaaataaattacagattccgtctgtaaactgcgagacgaatcttttgaacctaattaatccaccattagcacatgtgggtactgtagcgcttataactaattatgacgtaattaggctcaaaagattcatctcgcgatttacagtcggactgtgtaattagtttttcttttttgtctacatttgatgctccatatatgtgtccaaacatttgatatgacgaaaagttaaaagtttgaagaaaagttggaatgtaacacagccttagaagttgtttctttaatggaaagtgtaattcaccaaatcgaaattctctatagtaccgatcattgatatgtaggtccgaggatctatggagcccacgtgtcagtcaataataccgcagaggatatgtatttctacgtgctttactagtttgtactccactagtttggacttcaaagtttcacgtgtgattcaacaattttgcgtaagctagtggataatagatatattcatgttggtttagaattcgatgggaaacattttagaaggcttcgggtgcagaggccggatttaatccatcttttttcttttaaaaaaaggacaatagatatattcagaaattaattagaggattggaattaagccatgttagaatttgatgtgactgcggattgtgacgcagtttggattggatcaagcaaattttaagcatccaggtgtacagactagaactgttaagtccaccccctatcaatgttcaagtactgctcgagtctcgaccgtgcccgccacaaggctgttgcgactttggtttcggtgaagtcgtcgctgaacgatgtaccttctttttccccaatgtcttaataatactccgtattcgattggtatggtggtgccgatccgacgtcgaaaaagtactgtttgactgctttcgattaaatttatttgacgttggggtactggattcgaaattgatattggtgtccaccaaattcagaagtacatgtatatgacatatgctcaatttacgcggagtgatcattaggaggatatgtataatgtttcctcaattctcgttatataatgtccgccctcacccccacggtgcacgcgtctgcatgcccactccccgcttccgctcttccgccacttcctccgctgccacggcgttcgccccaaccgcttcaccttccttctcctgctcacttccatgtcctccctcggtgacctgaggcctagatgacggaggaggctgatgggagaggcgagatggacgggatctggactttctggtggagttgttgagatcgacgggatctatggccagactgatttgcttgatttgatttttttgggatttgatctggtggatttttttccatgaatcatgctctacttgctacttgttggtggcatcatcatattttagtccttcatcctagttgctttttcattgatcttgtacggagtacttaatttttttttttgcaattattttttgtgttgagttcgtttatcgccgaatcgaatcaaactaaccaaagaccgaagtgctcggtcttgagttttcttgaagactgatcggtcttgtgatcctaaagactgaatttttcaaaagaccgatgaaccaaaccgaattttcggttagaccgaatgcgcacccctactcgtctcattgaggaggaggaagcatggagggagaggtaaatggagcagaggggaagccaacgtcttgctacggaagaaatgggtagggggctatacggtcattcgtcgaggagtacgaggtggcatgatgccacgcaacagagggaagtgacgaatctattgctccatccgtcccaaaatataagtattttggactttgacactgtctctaagatgctattttgaccaacaatatctataaaagtaagatatttaaaataaaaaagagttgcatattatgatagtttgtttaataataaatctagtaacatcaattttacacgattgatctttttttttatttttttctattaatagttaaaaagttaaaaatatttaacttgtcagttgtcactatgctaaaaatgattatatttcgagatggatggagtacgagttaaggtgttcgctacttctatttatcatggttgtttgccaaataacaacccccacaataaggacttggcaaggtgcttccctaattatcatgtgtatatatatcaagagattttgcaatcatgtgtatattatggtgggcacgagtagccgagtatgttttatattgagcacatgtccattatgctctcatattatattggttgtcaaaggttgccacgttaaaacttagacattcaacaatttgttacctcaaacatgtttggttggtaaccacaatggtgacataccgcacttggcttctagccaaatgctgtcacatttatggccaataatttgttggccacattttatacggcatatgccacacttatagcaaagtgaagcgtgacaaacatagttatcaaccaaagatcagacgtctggtattatccatcacatttctttcgattaaacaatatgtgcatagtaaataggactaaaatttacttcatttgttccaaaaatattcaaatcctagggacatgtgtctagattcatccctaaaatttaagtttttttttacagagacattacaccatttcattggggcagagaaacatgtcattatcatatactcctttcatcctataaaaacagatataatacggaatgtgatatatttagtaatacgaatttagacactactaaaatattacattgtattctacgtttgttttttaattagacgggtggagtatactttattgttaggcttagcgcctatttaattggcaaaaaaaaaagtttgcccgtgcatataacatcggatatacggacacacattaaacgtagtctaataacaaaacaaattacaaattctgacaggaagctgcgagacaaatttattaagcctaattaatctatcattagcaaaatatttactgtagcaccatattgtcgaatcataacgcaattaggattaaaagattcgtctcgtaattttctgttgaactatgtaattgatttcttttttatttctatatttaatactctatatacatgtgtcaaacattcgatgtgataattttgtttcggaactaaacaacccctagttgctgcatgatctgcgtatcttgtttgaatggggaatcgtgccaccaatttcctacctgtcatttgaatatcgaatttataatccagcacgcgtcctataaataccggacatggcagccaccgtctccactgagctcgagctcgaccaaagccgctctcccatcgtaaccaccggatagaacagtgcccccgccatgaggacgagcacgagcaacgccgcgctgctcttgctggtggcagcagcgcaatgcctcgcgctgctctccgtcgccgccgcggcgaagccgcgcacgcgccagggcgactacctcgaccggctccgcggctcgccgtcgtcgtgggcgtcgctggccgaggatcgtggcgcgccggcgccgtcgccatcgccgtccggtgggcggcacgcggcgccagcggcggcggcggttgggagcaaggaggcggaccgcgtggcggggctgccggggcagccggccggcgtgggcttcgcgcagtacgccgggtacgtgacggtggacgcggcggcggggcgcgcgctgttctactacctcgccgaggccgacggcggcgccgccgcgtcgtccaaggcgcccctcctcctctggctcaacggcggccccggctgctcgtcgctcgggtacggcgccatggaggagctcggcccgttccgcgtcaagagcgacggcgtgtcgctctaccgcaatccctactcctggaacaacggtaagcaccgcctcgccgccgcggcgcgcacgacgtcgccatgtcaactcagaattcagagcaactactaacaccacagcatcattcgatccatggcgtggcgcgcagtggcgaacgtgatgttcctggagagcccgatcggcgtggggttctcgtactcgaacacgacggcggactacagccggatgggggacaacagcacggcggaggacgcgtacaagttcctcgtcaactggatggagcgcttcccggagtacaagggccgcgacttctacctcgccggcgagagctacgccggccactacgtcccccagctcgcccacgccatcctccgccactcctccgccgccgccggcggcaagccctcctcctcgccgatcaacctcaaaggcatcatggtacacacatatactactacactacatatagtacaacgaattcggatctaatcttatccggttttgttatactatgaaatatctcattccattgtagattagggtgtgtttaattagttctacgttaaaatggaaagttgactaaagttaaaagtttgaataaaaaagttagaagtttatatatgtagaaaagttttgatgtgatggaaaagttaaaagtttaaaaaaaaattaggaactaaacaaaggcttactatattgtaagacagagttagtacctctgttttaaaatataataatataagtatacttgaacaaacacgcagaaatgcttagcttttagaaagatccatacgagagaattcaagtactgaaacatcaactagcttgacaaaaaaaacaccaaaagtgtttaattaatttaatgcacttgacgggtacactgatgactatactgtgcgtgtcgcaatcaatcaaagattgggaacgcggtgatcaacgactggacggacacaaaggggatgtacgacttcttctggacgcacgcgctcatctccgacgaggccaacgacggcatcaccaagcactgcaacttcaccgacggcgccgacgccaacagcctctgcgacgacgccaccagcctcgccgacgactgcctccaggacatcgacatctacaacatctacgcccccaactgccagtcgcccggccttgtcgtctcgccgccggtcaccccctcggtaagtcagtcggtcaccgtcttcttgaccaacactcactgacgtttcagaattcgacgcgtctctgatgacgtttcaaagatgaggccgggttttcggacctcatcttttcgttttttcctatgcttatcaaccgaaatttaaatttttaacattaaatttaaaacttattttagtttttttttcatcggagtatattttcagcctatgtatttagataactaagaacacatatataaaagttttattcataaatagtttttcatttgcaaataagccaaacgataggaccgttcatctgcgtaacacctatatcatcggttaaagaaaatcaacttataaaaatgaatctagatatacgtttgttcagaattgtctctataagttgtttcttagactgaatgaatattcgacgttatgcggtggtgacggttactgggacagtgagatgaaactaaggaattgagtggctaattgctagggctaatcaggaaggttaacttgtggtgtacgtgacgtgtgcgcagattgagagctttgatccgtgcacggattactatgtggaggcctacctcaacaaccctgatgtgcaaaaggcgctgcacgcaaacatcaccaggcttgatcacccgtggtccgcttgcaggtaaacccaacaatcacccataaagaaagtatcaaaccagtattaattaagcaggcaaattcatgcataagcagataattatggctccctgttttgaccaaaatatacaggtcttcaaatattcaaatgtgcagattaattaagcagacttctgtatgcatgaagggcctgtttttgtttgttgcctaaattgcctcatcaatatttttgtaatttcaatactgtctattatctatttggactgaagccgttttagcaggcctaaatggtaggcaacatcattagttaacctcagcttcaatcaaacacaactttgtcttgccaaaatttggcattggcaaaaattggtaaggtcaattttagccccaaaccaaaccagctggaaaagagaaaattgagctcatttttctctagtagctcatcagctgaatcacagctaaatggaccagtatttactactactatgttagcatcattagagcttacaatgctttggtcagggacaacgatttcatcagtgttttttttcatgatttggccagtagtacaatgtatcaagcatcacagtgaaaccaaccgatcacaccaacttggacagatgattaggccatcaacatgacatccattattggagacacttttggtgtttcatcaatcatccaccaactgttaaaccaacctgattagtgatttgctttgctgcacaacctggaggcaatcattcatagttatgaaccctagcttgctcacattatacgaaaatcacaccacactaagctcactatttcaggttaggcgtgcactgaattatgaactgaacacagaattaattagtctcttctgtctatcatgttttattttgtctatcatgttttattccattcgtcctggatttttgtctgcaacaatatgataaactgactggtaggtgtagcacaagaaagtaggcaatacaaaaggttgctgaaaacttgcagcaattccatttcacatgaacgggcaaacttccatgagttggcatagcgtgctccaaattcgtaaaatcttgtttgaattaacaaatgacaaatgcaaggaatgcatggtgctagtttaattttgacttcatgcatactccatatcactatatgcaagatcttatctaaaacatgagagatcttataatctattctcagaacaaaaaccaggaaccttataatgcaccagcttttatagtttctttctccatgtttattcgatgcacatgacgaattgcatctagaaccacacgctgttggtttccttttttttttatatgctggtatgctctgaaactatgcgtggatgtactgggacttcaacatttttttttctttttgctcatatcagaagtctatgattgatcaccttactctttgcccatgccgcatgaattgattggcccatgtgcccatccatcgatttgattgcgtagaactttggcataatttacaaaaaagaaaatatttgatccgttttgcagtggagtcttgagacgctgggtcgacagcgcttcaacggttctgcccattatcaaggagctcctgaagaacaacatcagagtctgggtgtacaggtatgttcagcaactttcagacaatcaatcaatagataccctgatcaattatctgaaaaaatagatgctctaatccaagaaggaaatgaactagtagtattttgttgccagttttggtatatatatgcttaattcagtgtcactgatattgcagtggagacactgatgggagagtacctgtcacttccagcagatactctgtcaaccagctcaaccttccagttgctgctaaatggagaccatggtttagcaacactcaggtacttagttcctgcacttaaaactcttccttcccttcacctgttatctgaaaaaacaaagtaggaaccacttcacagaaatctgaattcatcagaaaacaaactctcgcaggccagtatggaagtaaattctacccaaattcgaactttagaagctcataccatgaatactagtttttgttaggatttagaaattgtattgatctgtttcaatcttgtgaaattcagggtgttggagacgttggtggatacattgtgcagtacaaggggaacctcagccttgtaaccgtgagaggagcaggccatgaagtccccagctaccagccacagcgagcgcttgtgcttgtccagtatttccttgaaggcaaaacgctacctgattgcgaaaaatgtggagaggcttagttataaaaaaaaaacttaacttatgtttacaaatataagtagtataatgtgccatgaccacaagttgcattattcccattgttgtccccattctagatagtgcaagaa

SEQ ID NO: 40406 - DNA, 2648 bp, Oryza sativa
aaaggcccgctttgcatctttggatggccacaatggtggcaacatcacatcatttgatcttgtacaaattataacaatttacaaacgttgtaagatgaatcagtgtaaagttcattctgctgtatcttgtgtgtctacgtagtgtatagttggggagcttgtccctgttgatccttgcaactttttgcagacatagatatagtgagagtcagggtcctctggaacaaagccatccggtagtacaccactctctgtcattggaacaggatctaagacagaccttttcgtcttgcccttgaacccgggtctggctgcaaaacattaaaaatgctgatcataaagggaacctaaaagtacaggagaatagaagttatcaatcaggattcatcacaaatacttccactaaaatggagtgttcatgaaaaagaaagaattataaggcttccactaagcaatgcatcagaacacgtaaattgcaaacatggtctgaacatattgtcagataacatttccacgtgcaaaagaaaaaggataaaatattgtatttttacgtacgcagaatgtatagtacaattttccaattgcatcctgattggttcagatgaggtaccctcaccgatggatcaccataagttatctaacagtttaaatgcaaaacttgatcagataaatcaatattagggaagggcagattaaaaaccacattctgaacaaacttttcaaagtgcctaccagcataaagattcctcctggtttaagaagcctgcaatcaaatggttgagctggtgagtctgcagcagcactattgaaatctatggcgtatcttggtgcagatgagactgtgaatatagcttagtggggtaagcaagacattaaaaacctttctacttctagaaccatctgagctgcgctgagaggagcacccacaccacactatggaagtagcaagatcacaatgttgaagaagtaccagaataaggaaaaggaacaatgaataatgtagcctacttaccatcaatgagtccaaagtacctagaagaaatgcacaaaaatgaacaagtggcattacatgtatgcttcaataattgctagaacaccattttaagaactcatacctttatcaatggcacaatcaaatgattcatcagaaaatatactcatgtccctagcatccatttgcatgtctaagtgtcataaggagaccaatggatggtaaatttcagtggaggtggagaaagaaacaaaatggaaaagcaatttaggatacactgcagctgtggaatattgaagtgtttctttctcataatctcaattacaaccgaagaaatgtcaatgttcattatctccgtatagccatcatcaaccatatcctctgacataactgcgaatggcagaacatggagaaaacattttgaattaacacaggtggtattagaggggggaagtgggaagcaataattggtgttccgaaggttagctttactctaccctgaaaaacctaactcaacagcaacacccaaacaccaatgtgtgcccgcaaaaggaaaagacataattgtactaaaaatgtcacaataggacacactaaatttcctctgttcctctttatttcccctactgtccatattccaaaaagacattgaatttgtaaaaatagtgcaaataaacaaatgcgctgccatccagctatggtcccaagatgccttgtaccataacgcagcagcagtaagccaatagcaactttaagctatcgcaggataaaaagtccctagtaaagcagacttatttttgcatatgtagtctatcactctagcaagcgtctgaaaaacaataattttcaggacaacctcctgcccaattaggccatcataaattcacaagaactgcatgctcgtgtcagttgcgtgttatcaatagcaagaacttgtaccttcagaaacagcctaattatagtaatatatcagagcaaaagggcactaatgccactatgtatgagaatggcgccatctgattgccataatggcacagatagaatagactagtagaggcttttagacaagaaaagggtctcttaagacaaaatcaccattcttgacaaggagctttccacaaaactattgccgaaacagcgatttctatcctaataacagtaacagtcactgcctatgcaagtagtaactgcccaagaaaaatcactatccatcaatcgccccccccatttcacaatttgcttaattcacttgatactactatactacgcgcgtagttgaaaaacaaacgtgaaaaatcacaaacgaacaacacacacaagcaaaagataaatttaactttctttctttggaacaaggaaaggaattgaaaacacgagagcggagccgaaagccgcaatctctatggaaagggaggagatggaggaggagggaggtggcgtacgagcggagccgcagccgatcatgaggacgcgggattccggcggggcgaagcggcggacgaaggggcggagcgcggcgtagcgctggtaccagtcgtacggcgcgccgccctcctccacgtagcgggcgtcccagtactccgccttcccgtagctcagcgccctcccgcctccccctcccccgccttctcctcctccgccgccgccgacgccggcg

SEQ ID NO: 40407 - DNA, 1996 bp, Oryza sativa
cctgttcaggcctgtgaaggttgtgcaggatgtacagtgaagcggacgacaggaagatgcagaccgagtagctcagcaggtccaaccccgttgttatcttcaccattttgctcctctcgaacatcttcaccagaaggatcatgacgatgacatgccctactttggttttcagttcgtccagggaggtaatcttcatccactttggtctttcctgaaacaagaagaaaacgaacgatcagttttctgaacctgccacgattgcagaattgcagagatgataactactgttctcaaggcagatgtagggagtgtctatgtttgtgcaaactatggttatatttgattatctggtttgtctgaattttcagtagtgaagttttggttgttttgcaattaaacagttcaatggatagctcacaaaataaaattttcagtccacaaacaaaggagtgatatggttagcaagtacaggttcatcagtaaaaggctaaaacgtgaaggttgttttggcatgcgaagatgattggctagttcttattcagttcctgtacattgtttcccttctgctataatataaaaccagcagttgctgggttcttttttttttttttaaaaaaaaagatgattagctacctttaaagcaaacatcccaaataaggatgatccctgcagagctctgtcagactcagaaggaacatcagtagaagtattgctgatgaacagcccgtacaagcccatcccaaagatcagcatgactgttccagcgagataaacatctgcagagagcagtaaaacacagcagttaatgtaaggttcaatcattctacacaccaatttactgcaccttgcatgcttgcagcctctagagttgataaagactttatcgtatattatgaagcctagagagtaacctaccattctttttgtttttttaaacaaatgagtaacttaccattctactaccaaccacctaggaatatcagaaatttaaggtgtgatggttacagttggtcaccaaaagcttttataacgaacgaactttcattggttgagacgtcacgaagcatgatcgatgaagattaaggtttttaaaataacgaggtggtattgattgagttttaattattacaaacttgaaaaatagattaatatgatattttagagtaactttcatataaaaagttttcgcgcaaaacacaccgtttaatagtttgaaaagcgtgacatgaaaattttaatcttcatctaactcttcttggagaaaagaacggcaccatagagttaaattcgaatcattgtgagttgtgacagatactacctttctttgtgccagctgactgaataaacctttttcagtagctcttacaagacagaattctcaaagagtttaggtagtgacatatttatacttaaaccactttggatcaaacagcaagcagaatgggcatctcaccaatggcttcgacaactttgaggaccatctgccctgtatggacgcctttgagacagcccgaccaatacacgctgtaagcctcttttatgtaaacacaaccctaatcacgagtagacagaagctagatgatcagagccagaaaaatattgacatggatgttctctagtgttctaccctgcaagaaagatattcttgttcttgatacagataattcttgccctgattggaaagaatcaggtgttggagacgaaatggatatgatcacttacattgaggaagcagaggagggatccggccagtgatccggcaaccgcgagaagagccaggaatctgaaatcgaagatcacctgcgtgcgtcacgatggacagaaattttagcctgatttgcaataccaagcatggtaaatcgacgcagatcttggaaagaaccaagcagataccctctcgacggtggtctcgacggcggtggacttggtggtgggaggaggaggaggagccatggcgccgttggccccgccgacgagcccgtagcctcgcggcttg

SEQ ID NO: 40408 - DNA, 4714 bp, Oryza sativa
ttctccaaacagtgtagtttgttacctagattctaagaatctgtacttgtagaattcagaaaatgaactgaatccagatgctgaaaaacccagcttctccagatttataaaagctggctaccaaacagcagattctcagaattttaagctcctcaagcagtactattgtatcgattggtttggagtttgtggagggatctatagatttgaaaaatactgccctaaaatcaccaaatcgaatatgccttctgatttgtcatttggattaaacccagattggttttctcactatgatcctagccaatatgctgtattattttcagttttttgttacagattttcggccccatcgtttcacttttgggtggaataagccaaaagatatatttgcaaacgaaaaataatttgtgaaaaaaacttttatgtacgtattcttaatgatctaaaagcaaaggctgaaaaataaacttcgatgaaaaaatctcaaaatcaactccaaatttaagtctgaaaatttaaattttggctgataagcgtaagcataagcataaacgaaaagataaggctgtttaggagttctttacactgatttgtccttgcaatccgtttaagcccagcatcagggcttgcctagcaacagttctagtgctacaaaatacaagcactgaggcaatgagttcttcctatatggcatgtgctataaaaaatactactgagtagaaggcaacatgtccggcgctgcaatcatgtactactcgtgttctgggcgatgaaggttgtgcaggatgtacagggaagccgacgacaagaagatgcagaccgcgtagctgagcaggtccattcccgtggtgatgtgcaccatcttgctcctctcgaacatcttcaccaggagaatcatcacgatgatgtggcccagcttcgttttgagctcatcgagagagctgattctcatccacctcggtctctcctgcagcaacaagaagtgaatggttcagcggctttcagtttcatgacatgtgagcatcagaagttatcaggaaaaaaaaaagtgcagagatggtgagtgcagatttcgacttctcgagtcagttagtttaatcttgaagtttcttctgaatttaatggctgataccttcaaagcaaacatgccaaacaaggatgatcccttgagagcacgatcagatgcaggtacatcaggaaaatcgttgctgatgaacagcccatacagacccatcccaaaaatcagcatgactgttccagcaagatacacatctggccacaaagcagcagttaagttaaagcacattttgcaggtccccctcttccaaaattgataagaggttcgtataattgttagtgttagatttaggtagatatcaagctaaacaatagaggcatctaaacaatattgtgtcagagttcagatgatatcaagcagaactttaattgctcaccgatagcctcgacgagcctgaggaccatctgccctgtatggacacctctaacacagcttgtccagtagacatggtatgcttctttaatgtacacacaaccctgattataagcaaatgacagatgattcaatctgtaatttcagctccaccatttcgtatacaaaaatttgcttgcacagtcacaaggctttacactgaggaagcagaggagggagccggcgacggcgaggagagccaggaaacggaaatcgaatatcagctgcggccaaaaggcaaaacgaaacatcatatcagacgacggcagctgcgtgcacaggaccaacaaaaccatactttcgcgcgtgtgcgtgtgtgtgtacgtacatatgtaccttctcaacggtggactcgaccgcggggccaatgcctccgccgccaccgccgtcccctccggcgaacgcgcgctccagcgacatggcggcggctgccgagccatcggagcccagcggcgattcgcccgtagtagtggccgtattaaccgacgaggcagcgcacgcgactgccacgagccggggcctacgacacggaagcgcggcgcggccaccgcccgtctccgcgcgccgggacaacgctggagcgagccaaccgtgcaccaccgcgagagcagccatcagctcgaatgctgctggtttgcctgccacgagtggagtacggaaacggacgtggtggtgtgacgcgtcggtgtctcccccacccggtgcttttcatcgccctctcgatcatccggccatgcgtgcgggtgcggatggttggtttctcgcgtgcgatcgaaagggagtgcaggaaagacctggaacgggtcggcaaatccccaatacggcatgcaggcccgcgggcctgcgcacgcgaggacgcgcgagtcacgatcccgctgacatggacgtatacagtgagtattgtagggggcaaccggtctctggctcgtatcagatggcctaatcagtaaaagaaaaaaatcaaattttaaattttcaagcttaatgttgaccttgattttgagatattttaacgcaatttcttttttaacattggcttttaagtcaaaaaaaaacatatttataaaagtttcacctacaaattcatttatatttcctaataagtcgttttggcttattaggaaataagccaaacgattgggacctcggtgtctcggaccctcggtgacggtgaggggccgtttgggcccttttcaccggtggtgaactggcgatgatcatcagaaacgggcagtaggtcgttcagtatccagcacacacggtggcatcaggcatgagttgaagtggtagaacaagtaaacatctgggctctggccatctggggagctatcaacagcagctccagcacgtgatggaatgcatacgggtaactggctgtaagcctgtaacggcgacacggcatgcatggctttggggcggtgctgattgctgtcgctgaaggaagaaatggggtgactcgattactcgagggatcttgaggtgcagtttcgtgctgaaaactggtattgcacatgcgccattcatcccatgaagagagctcttgtacatttgatgccgcaatcctgatatgaaaaatccagtaatgcataccatcatatatatgatatgaagttcaatgaaaagccacgtgttatgcaatcattagctgtcaactgaaagttatctttcaaatgaaacaacacatcatgtgagaacaaaaagctcaatacttaaggtgcataaagtatgctcaactgaaaactagaactactcgtgtaatcgatcaatcaactcttccatcctccgaagaactcatgtacataacggtgccacaagcttgctacataatccctgtgatgcataccttaacatgaagttcaatcaggaatatattgtagcattatttttttttgagaatttattgtagcattacatatatgctaaaactgcctactgattgaagttccaagtccttcaaatgaaacagtacgatcatttgtagacataaagtaaaaaaagtttaggtgtatgatcccataatccaattatgctatctagtttgcagtttcgcgaaaagttcctaagtgaaaatactcattccaagtgttgtatgctgactaggtttgcaaagcacacagaaatagttaccttctttctttctctgcggaggagaagaaactggccatcactgttttcagcttcccaccagacaaaggcaatgttggcacagcggcatacctgaatgttttcaactccatctattccgtcctccaagatctgaagaaggatggctacaatgttgagggtcttccagacacagctgacagctgaggccctcatcgaggaggttattcatgataaggaggcccaattcaacagtcccaacctcaatgttgcctatcgcatgaatgtgcgggagtaccagtcactcacttcctatgcctccttgctggaggagaactggggcaagccacctgggaaccttatttctgatggtgaaaaacctacttgtctatgggaaacagtatggcaatgtattcattggagttcagcccacttttggctatgaaggagatccaatgcggcttttgttctcaaaatctgctagccctcaccatggctttgcagcataccacacctttgttgagaagatcttccaggctgatgctgtcactttggtacccatgggtctcttgagttcatgccagggaagcaagttgggatgagtgatgcatgctatcctgacagtctcattggcaacatccccaatatctactgctatgcagcaaacaacccatcagaagcaactgttggcaagcgtagaagctatgcaaacaccataagctacctgacaccaccagctgaaaatgttggtctctacaaagggctcaagcagctttcagagctcatctcttcttaccaatctctcaaggacacaggacgtggtccacagattgtgagctcaatcattagcactgcaaaacagttaatcttgacaaggatgttccctttgcccgaggaacgtatggagcttccaccaaatgagcgtgaccttattgttggaaaggtgtatgccaagatcatggaaatagaatcacgcctcctgccatgcggtttgcatgtgataggtgagccaccaagtgccattgaggctgtggccaccctggtgaacatagcttcccttgattgcccagaggatgaaatatactcactgcccaacatacttgctcagacagtgggcaggaa

SEQ ID NO: 40409 - DNA, 4431 bp, Oryza sativa
cctgcagccctttggtttatcagaaccatgggtacaacacttgtccaagaccaagttcatcagggcagacagagagaagttgagaaccttgtttacattcttgggagaatgcttgaagctaattgtggcagataatgagctgggaagcttgaaacttgccctcgagggaagctatgttgaacctggccctggtggtgatccaatccataacctgaaggttctcccaacagggaagagcatccatgctcttgaccctcagacaatgccaactatagctgccatgaagagcgccaaaattgttgtagaccgtctgctggagtggcaaaaggttgataatggtggcaagtatcctgagacaattgcacttgtcttgtggggcaccgataacatcaagaccaatggtgagtcattggcccaggtgctgtggatgattggtgtgcgctcggttgctgacacatttggccgtgtcaaccgtgtggaacctgtcagccttgaggagcttggacgtcccaggattgacgttgttgtcaattgctcaggtgtcttcagagatcttttcatcaaccaggtatgaattctgccccagccttacatatgtagaattttgtgcacatgcaaggaaaaatcatagctgaactaatgtacttctggaacacactgatgcagacgaatctactggaccgggcagtgaagatggttgccgaactggatgagccagaagagatgaactacgtgcgtaagcatgcacaggagcaggcacaggaacttggtgtttcattaagagaggcgacaacaagggtattctcaaatgcatcaggctcttactcatcgaatgtgaacttggcagtggagaatgcatcatggactgatgagaagcagctccaggacatgtacctgagtcgaaagtcttttgcatttgatagtgatgctccaggggcaggcatgcgagagcaacgcaagacatttgagcttgctctagcaacagcagatgccacattccagaacctagactcatcagagatttcactcacagatgtgagccactactttgactcagacccgacaaagctggtgcaaggactgcgcaaggatgagcgggcaccttcctcatacatagcagatacaaccacagcaaatgcacaggtgaggacattgtcagagacagtgcgccttgatgcaaggacaaagctactgaaccctaagtggtacaaggggatgatgaaaagtggctacgagggagttagagagattgagaagcggctgacaaaaactgttgtatggagtgcaaaatctggacaggttgtcaactgggtttatgaggaggcaaatgccacatttattgaagatgaggctatgaggaagaggctcatggacactaaccccaattcattcaggaagctagttcagacctgcctagaagccagtggtagaggctaatgggaaacatcagaggaaaacttggaaaagctcagggagctctactctgaggttgaagacaagattgaaggaattgaccggtaaatttgtttgatcaatcagatcctgcattcaaaaaaggaggagaaatccttctgtctcactgaattgagagttgagacttgtacaatttatgtaatttataaaaagttgtaacatgacatacacgaggatacagtgtttaacaaagagggtgcctgtgaatgaaaaatggagcatgggtagaagttctttctttggaatatgttacttattgtcacttaatcacttgttcatttgcagactagtatttgatacctactaggaatataaagcaggtggttgtgaacacagaatatcagtaactattttaagaaaactacactagagtattacgatccttcactccatactttacatatgtacgacaactgtacaaaaacaggaatttagccaacacgaaatagtgtgctaatgtggccaatgtgactacagtagcaagttaaaaatgagaacaccttagtaatttaattgtgaacattccaatcttgacaaagtaagtttctggcatctgattccacatgtaaatgacaccaagaaaaaacagcatatcttgctcaacaaaaagggtgttaaattgaacttacagctgaagtggatggcaaagaagaacaaaacaatatactgaataaactttgttttgttttcccttcccagtccgaagtatacagttttagtgaattcctacatcagatcaattccataagaaacggatcacctgaagccatgactctgattagctctacaaaatctatctcattctgaaccttcattgggtacactgcatgtgcttgagcagtgtatattgttgcaaaagtggcatttgattgcacatttgtcctataaataagtttggtcaaagcttttgattcaaaattgcttggcaaatccattgcaaggaacaacatggggatagcaatactgtgatgaatgtctaagcttccaatagcttgaactagataagaaaagtcaccaatgtgacttcgaggtatgtagaatatctcactgttgcaatgaattatcttatcttcgccaacacttcttttgtagttggcttgatattgaaatggaaagctagcaattgccttttttaccatatctccttggttaatgaaccattcaattttattgccatgtaaggggacatcggaccatgattccttcacctatggagaaaaagatgagttaatttgatgggacaaagaaattcacacatatattttggaaaccaggacatgagcatgcaccttgttggttatccagagcttagccttgtcaaaatcatagaggttccaataattgaggatcatatgatcctgaaggaacataaatcccccagcacctgcaaaccggtcaaacacctttggcaagaacctatagtggaaatgtatcagtaagtgctgcaagctttttacatattcaagtaaatgaaactttactggatgaagtggtcagtaagatttgtgagttatgacgacttgaagcgtaacattttactgttgattggttagaatcataaataccaagctgatttcactcacttgtaagcttgtgccaagttgctgacttcaacagcaagatctgaattgcttttctctgaaagaataacaactgccctgaatatacgaccataaagcaatctccactcaagtgcaacacggtccacaggtacggtgcagtgcactataagcacaacatcaccaaagtgcttcctccattttatgagatttccaatctcagtgctaacttccccaatctcctcaacaccaagatgtacggtaggcagtttcttggggacaaacacctgcttgtccccatgtccaatggtcgcccttggccgatcaatctccaatgacatcaaccttggctgccggtaaccaacagagaccagatcttgcagccacgcggacatgaactgcaaatccttctctccccagaacccctcctcagtcatcgcataactcaaatcaagaatacgttcaaagagtgtctgcttatgtgaccgccactccattaggaaatctatcagcctccctacactgacatggatatccttctcatcatcaaacgggtgagcatgcacattatccatgcggtgcacggtcggtgggtagaccactaagtaacccccaatctcccataatatgcgctgcgaccaatacccacgtataacatcagctgccattggactcactgatactggcaatgcaagcccccaaaatgccggtgaatggaacagtgtattaactgagttgattggagccatcatgccctgaggaagtgcgaccttaggcgcatctgcatcaaaccggagatcaaaagcttccatttccgatgatttccgagtgaagtagaacacagcgtcaacatccggtaggccattgcacagcccctgctgtatgaactgcccgccaccgaacacctgagtgtagaattcttccacacccacctccccggctttgtgcagcggcaacccccgcggccacaccgacggctgcccaaagtgcacgtagggattcaccaccgtgcggttgggatccgcatggctgtactgcaagagcacgccgcccccttggcgatggtccagatcgacatcgaagtgcttggtgaggttactgcccaggacggcgttgcgcgcgtccgcgtcgtagatgacgcgcgcgccgcgctgcacggcgaagaggtaggcggcggccttgcgggcgtggccgcgcgcggggaggaaggcaacggagcggaacccgaggcgcgcctggtcggcgagcgtgagcagcgcggcgcccgggtgcgaccagtccgggggcgtggtctcgtcggccacggcgaggagctgccacccggggaccgcgggcagcgggcggtggcgcgggtggtgggccgccgcggcgaagatgatccacctggaggcgcgcagcg

SEQ ID NO: 40410 - DNA, 10701 bp, Oryza sativa
ttatgggccttgatgggccgtgtgtagccgtgcctatgctatgggccgttgctttgctggcttgcacacgtcatcgcgtgctggctttccaacacgctcgaaaattcaaaagttgtctcccttttgatatccccacaaaaatctcgagccccacttgccggcgacgagatggattcagctcttgccgccgccgccgccaccgccgccgtggcggcgttccccaacttcgccgatgtcgccggcgccgtcgcgctcctcgttctcgccgactcgccgccagcgccgtccccgcctccacctcctcccactgtcaggtactacttccgcgcgcagcactctggttttctccattcggtgttcggcgcgacgaattcaccgccccgtgcggcggcgcctccccgttcattgcagcgacgagctctcgtgctactcgggatcctccgcgtcctactccggcacctcggcgaggtcgtgcgtgtccgactccgcgcagcgcggtcgccccgtcgaccccctccgcgtgctcgccgtcgtcgcctccctccgccgcatcgaccccaaggtaaataatctgatgtgctagatcgcgaacgccaatagtttcatcggtgctaatggctctgctcctcgttgactctaggtgctcgccaaggcgacgaacacgctgtttcagggcgagtcgtcgaagaagaggaagggcgtgtggatccacatcgacgacgatgaggacgagagcgagaggaacagcgctgtggccagcgaggggagcaccgtcacggggaccgcgtctgcaagctccacggccacgtcggggagatcccaccggcctccgcgggcgagtggcggtggcgaccagctgccgcgaagggcggacaagatcatgaagtggttgtcgcggccgggagcggtgccggcaacggagacgaccatccgtgcagccgtcggcgacaatgctggcaccagcaaggcgctgcgcttgtgagtaccacactgctgccaattgcaatttgaaacgcttttgaaatggttgtcatgttaatttcaatttgaagcggttttgaaatggttgccatgttaattccaatctgaagcggttttgaaatggtttccgtgttgctaaattgtttgtgtggaatccgcaggctgctgaagcgtccgggctgcttgcgacgttctggctctggtggccgcaatgatccatatgtttacatggtatgtgaaactcatgcctactgtttgaattgagacgggaatacgaaattcgatgcatgttctgtgctgttgaatgatggtggctcattgtattgtagcttaagagattttcagattggagtagtattaccctttgatagtgtgcaaattttttgaatcgagttagtgagctactgagcttagtaatttccagtggcccagtgggacatacacatttgaagcagttcttaaacctgagttaaatttgcggtagtgctcactgatcactctttagtaccccattctagaagctctatttattgtgttgggagctcagcacaggcaaagttcacagcaacagtgacatgttatgacggccactgcacaggcagacatcacaaaatgtgatgtctcaaatttgtgaattatcagctcttattaactttgcagaatacattcattactatttagctattcccatgatttctcatgagtactattttccttttgatgaattttcaggtcacaggctgacccaatgaagttaactaagttgtgtttatagcaaaagagatggtaactgtaaagctattggagaggccaagtgacttctgagcagtatttagtaatttctactacctgtctgtcttaattactgtttaattttgccttcctgcatataagaagtatagccataggagaaagcaaagttcccatgttagaaagagcttgcagatatatttgtaaagataggctactggatagaaatatagacacacaatcatacacccagagattttatgtcatcgcgctttatattagtgtatgtcgaactggagtaatcaagtataatgagttccattttcagacacttctttttgcaattaactgttatctgaacttctctgtgggaatgaaatctgtgctgttgaataggaattattagatattttgaatagtcccttctgtcagctctttattgtacaaatagcctacggttctgatgaacaaatctgtattgaagttcaatccatttatttctccttctgttgcagaagctagtgaagctaccaatctccacattggttgtttttcacatataactaaagctaaactaacgcgctacgatgagcatacgctagagttagctttgttctgaaatctgacagtggaagcctttgaggctttcacagcttgatccttttgtctgcatactttagttcctcttcttactggagagcatgttcttgaaccagaaagctgagtccttggggtacctctttagcgtcttgtagtccacgtagacgatgccaaaacgggaagtgtacccgagcctccactcgaagttgtcaagcaatgaccaagcaaagtatccaatcactttggcaccatcgtctatcgccttcttgagctcagtgatgtagtttctgtagtatctgattcttactgtatcatgcacaccctgagtgatactgacgttgccaggttggtccatacctgtaagagcacaacattgatcatagtgtaagccttctttaatacttttcattgtcaacaaaactattattcggagaatcagggaccattctgatagaattagtaccattttcagaaaggatcattgtagggtttccatatgtttcctttacataggtcacagccttgttgattccccatggcacaatgtaaagccagtaggagtttgcctgcgtgaattcaatcaattcaactattgaagtgtgatgatttaacttgaaattcaacttttcctaactgttcaacatactactgtacaaatgtacaatacattgactgccacttacttgagctccaatgggcacgccgtttcgttcatctggaaaagacatgagtgcatgagcaactgatccaattaaacagtactacaagaaactgaattatgcatcagaaaatcagaaggatttgggggtggagtattcagaactcacaggcaaacccaacatgccagtcatcctgataactggtcggtgtcaggttccatggcccagggtctttcatgtagaaagaggtgtagtggttgatgccaacataatctattgagtctttcaccatcctggactcctcatcactgaaggttggcatcctgtccttgacgatttcgagcatcgagtatgggtaccgaccatggataatggggtcaaggaacctttaaggagatcatagtgtcagtttgctgatccaaaaaaaagggtactttcagactttcagtttgtggctacactatcacaaaaaatctagactgctactagacctgagcatctgaactctggagtaaataatcgataatttgatcctgaaccagatggtgttttcagatttttaccatccgaggtgaaaatctcttgccctctgtgctgcagccctatcagcattgctgtcactgaatggttcataccagacaaaatccaagagaattccaatcctccccttttgataaagctgttcaattggaagaaatgcattgcagactacattctcagatacagggatagcaaaagtaactgagataatttgcattgcatagtgtaaatccagccttgagctgaactgtcattctgctattttacctgatacttttcgcggtatcgcttgacggcggcagcatgagaaaggatgagatggtgggcagcaaggtatggttctgtcgtggagttgcctcctgcatcacagccagagcaccttcccggggcatggaagccattgtcatatcctagagcagcaacgcatctcggctcattgaaggtaaaccagtccttcaccctgtctccgaacgtctggaagcagaaatctgcgtagtctgcaaacgcctctcttcacagtagaatacacattttttctttggtcaaatatatgcttcaatcagcttacaaattttgaagttcatagttttcaagttgaaatgcttacacgatgtttgggcttagccagcctaagtactgctcatggagtgctaatggtaggtcatagtggtagaggtttgcgtacggtttgatgcctaattcaccaagagaaggtcaggacactgatgcagagaacctttgtagtactgtctaaggtaagcaagtgtcctaggaaagttacctttcttaaccatgtaatctattaacctgttgtaataatcaactccttcctggttcaccatcccagtcccatctaaatttttatagaaaactccaaatcacaaactccactgatccaaccaacaacaacaaaaagaactgctgcaggtacagacataatccacatacttgggaaaattcttgaccaagagatcgaaaatctatacgcatcaaagcccatgttcttcattatgttcacatcttcctacaaccccaaacaacaaccatcaagcatcaaaagagaaagaaacaccacaaaccacaacaacgagaaaacacaatcaccgaatcacacacacataacacattacacaccttgtacctatgatactcatcaaccgtcacatcggctgtggcattattagggatcgtccctgtcaggacacaagaacacggtaacaacaatgagcaccatttaccatctcacctgcactgaagtttagtactctgaatctctgattacttttacctggtttctctatgaaagcgtcccagatgctagggccccggccaccctgcttcgccatgccctccacctggtacgccgacgcggccgtgccgaacacgaacccctccgggaaggctcgccggctcagcccgccggcgtcgtagatctccgggttgagccagtagcattgtgccggtggcagcgtcagcagcagatgagctgctgctgctagtgcaagccgcagtgctgctatgaatttcctcatgtctgcattacacacagagggagcaggaagtctggagacaaaaagggctttgtcttccggtggcatataaaagatgggaggaggtaaaagaaaactgagcgcctgaggcttaccaatttttacagttactgattcagtttttcaccctgtgtttattggcagtttgcttctcaaactaagctgggggcagcctgaatcagaaggcctgaaaatggagggaagttgcaacagatgcgattcccagaatgataggaagggccgcacaatttgtaagtttgcctcagttttctgtggaggtttctacgttccacatttccactattgatgtgcccaactttgtttgttgtgctcccaatcttatcttttaattccttgacgaccttgatggaccccattctgtaaattgattgaatgaatgaaagtttggagccaatgacgctcacactgactgaagcatcgctgtggctttactcctagatgaagttattaaaaaacacggatttttaaaaattaatgagcaaagataaacatattttaacttaagataaacttaaaacacccgtcctaaaatatgatcatttttaaataaaacgatactactttaaccgataatatctacaaaagtaatatgttttaagtaaaaagagttatatattataataatttatttaattataaatctagcaacattaaatttatatgattgattttttttacttttttctactaatagttaaatttaaaaagtttaacttcactcttctaaaaatacttataatttggtacgaagggagtagtaatttaaaatggtgggagtgagtacttcaggctaaccccaatcggtgctagctaggctgtgtttaaattaaaagtttggatccaaacttcagcccttttccatcacatcaacctgtcatacacacaatttttcagccacattatccaaccaaactttttagtcacatcgtccaactaaaatctaaactttatgctgaactaaacacagccccagtatagtgcagcaagagatctggacacgcatacatattgcaagactgcaacacgtgagaagcctttgtcagttgtcgctagttcactgccaagatcagcgcccacacacacacggaaaagcggggactcttgcgcgcagccatccggtccgcgaaacgcgtgcaagtcttgccctcctcctcctcctcctcctcctcgtcgcgccgcgatcctaatcctatcctcccccatcatcttcatctccggcgctgtttgtcgcgtacggcgcaacggccgttcgttcttctccgctagtttaatccgctccggcgacgtacgtgcagcgtggcggcttttgcctctacatcagcctccgcggaaacgggccccgcgacggcgtgcgaatttcttgtgtaataactgcggggttttgtcgtctcgacaaatcgaccgcagctgattgatggcaccgtgcacgtatacgtactagtacgtgccaccaccgtccaccgacacttgtgatcatacggtacacgacagatttgtttcgacgccctgcggctgcggatcgcgtcgggggcccgacccgatgctacgtgctcagacaccgcatgtgtcacgcggcacgaggcttacgtacacacatatactcgtggagttttcggttacccatatcctctaataataaattatttataaaggtaatttttttaatgtgatctaacgacttaagagctcaatgcttaaaaaaaaatatttaaaaaaatcttaaaataaactttaaatttaagttatctttgattttgatttattagggtagccgattgagctcatgatctcgtggcctagccgcctagctctcgatccatgcctcaagctccctctcatcttgggccaaacagcaccactaaagaaaaggccgattttgttctgaatgggaccattatatgggctcgtgcccaatatttgcctctcactctctgaccgcttgcattactgtggagattatgggtattccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaatatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacactttccaagcttgatagccacccccttttattattgccgaaatctagtttcgacagttggcgcgccaggtaggggtagcgtcaagcttttcgccgatcagtgcaatgggttccgtcaccggcatcgacgacctcgtcttcccacccgggcagacgtttcggttcggcagcctcgatttcgtcaccaacaacttcggcaagatttctctccttgactcggaatcagaccagtcgggagagaatcgacttctagttccgtttggattcccaaacgcggcagaaagttgcttcaagaccatctcgatcgagtcagcttcaaaccactcggccgagatcgcatctactccaacaacgccagatcaagacgatgagccttacccatcaatcttgatgcagctccctgacgattcggcagccgtctccaccgccacgccgtctccatcccgtaggcctaggcggaagtcggtcttaacaccgatttcgcctagcttcagggaagtcggcgtcatcctccaaccactcggcacggtttcaacggaccaactggatggctactacagctctcccaccgtcgactcacgtcccaccgaaatcgtggaatacgatgagttcggttctcgctactacgacgacgcggatcttgacgacttcgacggaagcctagaagacaactacactcctcttttcttcggcgtctttatggccgacaatgaaacggaggagcagcgccaagcccgggaagccgaagcacgttgcgagaccgagcgccgccgactggagcaggagcgccaagcacaagagcaagagcgactacgccgggagcagcaggagcatgagcggaacgcgaaggaggctgaagaccgacggcagcgaaccttggaagctgggcgccgagcgcgtgatctcatcggccagcaagatgttgaagggataccggttttccgtacccctcagcagaatgcggttgccgcgatcaccctcctcgacaccctcctcaaggaaaacgagcacaaccaatctgatcatgtcgtcaacatcctgaaccagaccaagaccatgattgcggcctcggttccagttaactccgaaagcgtccacacgccgactggtagccgagttccacacttccgatctcaggactaccgtcatccaagcctcagcatcaccggcgcaggatccaatcgcaggagcaggggtcacgacgagcggtccgcgcactcgcctcccgactaccgtggggagcgccgagtagaacggccacgttctccgcctcgtcgccgccccatcgatcttcgcgacacaatcatacagcgccgagcagctcgaggccgtcaccactcgccagaccgctacgacgacgaccttgatggggtagcagccttcaccgacgacctgcgtcgagtggattggccagccggcttcaaaccgactggaatagagaagtacgacggtaccactaacccagaatcgtggcttaccgtctacggtctcgcaatccgcgcagcaggaggtgacaacaaggccatggcgaactatttaccagtggctttagcggattccgcccgatcttggctccatggattgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaagtggaagtaacaatcataaggaccgcaagcgtaagcctgaggaacttgttgcaaccgccgctcactcttctcgacagcgttcgcgcgtcaacaccttcgacaagattatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaacggaagcagaagttgactgaacgggagatcaacgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagaccttggatgatatgcagattcctcgctccgagctaaaaccaagcaatgcgccttttcacggagtaatcccaggactatccgcaactccacttggccagatcaccctcccagtcacttttggcactcgggaaaatttccgtacagagaacatcagctttgaagtcgccgatttcgagacagcataccatgccatactcggacgcccggcgttagccaaattcatggccgtcccgcactacacatacatgatgatgaagatgcctggtccccgaggagtcctatccctacggagcgacatcaagcaagccgtcacatgcgacaaggagagttgcgacatggcccaaactcgcgagatggcgtcagcccgagaggaaatccgactggctgcaaccacggtgagcgaaggaaaagtgcccgctgccaagatttcaaaaagtggggaaaccgaagccgcgactaagaagattcccttagatccttctgatcctaccaaaactgctgtaataggcgccgagttagattgtaaataggaaagcgcgctcatcacctttcttcaaaataataaagatatctttgcgtggaaaccttcggatatgcccggtgtcggtgatatgggaccgggagtatcatgaccagaggcttgaggcagactcaatcgcccacgtggcctggcaccttcggggacgtcgggcccgagggtgaggtgtccgccctcctcctgatttcccccgagggggggtcgg

SEQ ID NO: 40411 - DNA, 8808 bp, Oryza sativa
atcttaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggggggggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtggtttctgagctctcatactcttccgtgtgcgccaagtttcccttgttctgcctaatggccgagcaagcaaaggcgcacaacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgccacagggcgcgcttcaggccgttggcgcgctcctacgccacccgcctgtcgtccctgacccggagtctccagcccagcgatggctggacaacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcaaccctccgtgcccccggttggtggtgttggctgtagagcctttgtggcgagtcttcggaatgtccgttggcccccaaggttccggcccaccatcaccgagaagtatgatgggagtgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggcccttcgagccgcgcgctacccgcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccccagtgggggtcgggtgtcaggtcttgggctcgggccaaccccgcacccccccgggcgtgcagggttggccggaggcttatcttttttctcttccatatttcaataaaagcagtttcaatttcctaaaggttgtgtctgtgccgttttttccttttgaagaatcttgacttgaaataaggtcactcgtactcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgctcccggcctggccagtctcgatatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagttattcaagattggcgggggcctgggggctcactccgacgcgcccgggtcaccagccttgtcgtcgctgtcgtccgcaccaccgtcaccgccctcctcgtcgaagtcgagggcgaacgcgagccgaagggccgtaccctcgaagctgtggacgatgtggtcggcggcgtcccggacctgcgcgcgtgcgccgtcctcggttccggaagggaactcttccagcgctgcccacggggagaagtcagggtccgagaggcccccaagccgaacggcggcccaaggcccccgacggccggagttggccctccgcctgcttgtccgacggtgtcaggcgcccccgaccctcaggatagcctcggggccactgcgggaaggccgcgcctgtcgccctcttaccccgaggatatcggtgcagaagccgagggcgccccgcgctgcctctcggatgaagagcgccctggagatgcggcccctagcgaagaggatcggccccgccgaaaggtgcagcggcccgtctactttgttagcgaggccctccgggacgccaaaacccgattccctcaggcccagaagatgctatacgctattctgatggctccgagaaaagcaccatcaccatatctccaagcgagacaaatctgctcacccagattcgcgcgctgctcaagtgatgtggcagtcttgaatagaccgcccattatggacaaccaaagttaccaataccaatatgcatggattaagaccgttgggtattttgcccaactatggagaccggtcccacttgtcaccaggctttaggggtggcgtcacacctgaccgcttcccttgggaagggaaattgctctggcataacgccgggggctactgtcggtgatatgggaccgggagtatcatgaccagaggcttgaggcagactcaatcgcccacgtggcctggcaccttcggggacgtcgggcccgagggtgaggtgtccgccctcctcctgatttcccccgagggggggtcgggttgcgtttgccccggccccgagggccgaggcaccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggggggggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcacccggtattcccagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgtcgattataccgacctcaacaagtcttgtcccaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttttcaacacagatcggccgcaacgttgaagcctatgtggatgatgtagtcgtcaagaccaagcaaaaggatgatttaattttggatctagaagaaaccttcgcgagcatccgcgctttcaggatgaaattaaaccctgaaaagtgcaccttcggagtaccgtcagggaagctgcttggttttatggtgtctcgtaggggcatccaggccaacccggagaaagttactgctatcctcaacatgaaaccgccaagtacccagaaagatgttcagaagctgactggttgcatggcggcgctcagccgatttgtttcaagacttggcgagcgggggatgcccttctttaagctgctgaagaaaacagataacttccagtggggacccgaagcacagaaggccttcgaagatttcaaacaactcctcaccaagccaccggtcttagcttcaccacacccgcaggagccgttgttgttgtatgtatcagccaccccccaggttgtgagcacagtcttggtcgtcgagcgtgaggaagaaggccatgtccagaaagttcagcgaccaatctacttcgtcagcgaggtcctgaccgactccaaaacgaggtaccctcaggttcagaagctgttatatggtattttaattactaccaggaagctgtctcattactttcaaggtcactcggtaacggtggtcacatcatttccactcggcgatgttctgcacaatcgcgaagcaaatgggcggattgctaagtgggctttggagttgatgtctttggacatatcattcaagccccgcacttcaatcaagtctcaagcgttagctgattttgttgccgagtggaccgagtgccaagaggatacccccgtggagaaaatagagcactggaccatgcattttgacgggtcaaaaagactttcgggcactggagctggagtggttttaatttccccgactggagaaagactaagttatgtgctttggatacatttttcggcgtctcacaacgtcgccgagtatgaggcgctccttcatgggctacggattgcaatttccctagggataaagcgtctaatagttcgaggcgattcgcagctggttgtcaaccaagttatgaaagagtggtcctgccttgatgacaatatgatggcatatcgacaagaggtacgcatgttggaagacaagttcgatggactcgagctcagtcacgtccttcgacacaacaatgaagccgccgacagacttgccaactttggatccaagcgtgaggcggcgccctctgatgttttcgtcgaacacctttatacgccgacggtacctcacaaagataccactcaagttgcgggcactcatgatgtcgctacggttgaagccgactggcgagagcccttcatacgatttttaacttctcaagagctccctcaagataaagatgaagccgagcagatttcaaggcggagcaaactttatgttatgcatgaagctgaattatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaaaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgagacttcttcatcaacattgtgcatagatttggagtgcccaatcggataatcactgataatggcacacaattcaccggcggagttttcaaagacttttgtgaagattttggaatcaagatttgctatgcctcagtagcacacccaatgagcaatggacaggtggagagggccaacggcatgatacttcaagggattaaagctcgtgtttttgaccggcttaaaccctatgccggcaaatgggtgtcacagttaccatcagtactttggtctttgcgtactacgcccagtcgggccacaggccagtcaccttttttccttgtctatggggcagaagcaatgttgccgagtgaagtcgagttcgaatctttgcgcttccgtaatttccgtgaagaacgatatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttctcattgtatttccctattttgactgtcaaacatcaagttttctccttgaagttgtcagacgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagtaaaaacttttaagaaatcaaaaacttcgcaagaatcatcaagcacagcataaatacaccagtattgtacaaattgagcctccatgtattacattcaaactcagtcagaatcagtcctttcatcatcagagtcttcattactcggttggaggtcgttattgcgaaattgttctacaacatcactcgcaattttatcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaagaacatagcttggataattggtgcagcggcattggcgacgttatcccttgctccttcaagcctcttgatcttaccaaccaggacgtcaaactgagcttgagatttgatcttgcgatctgcaaaacacatttatgatga

SEQ ID NO: 40412 - DNA, 16353 bp, Oryza sativa
ttgcttcgccatctgttccatcctggcggcttgcgctgtttgaaatccagatgattgaggatgcaattatgacagcataaatcaatggaacagatctggatgattaccttttgatgaaccacttagttcgaagtttgcatcctggagctgggcgattcggtcccttaactctttctctgtctttttggcgcactccctggtctcatgcagctggtccctaactgcttctagagttcccaaatgaggaaccagcttttccaaagttgtagtcttggcctcattgcgaagatggattctctgcatgatggatcatggttcagtcctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatacgagggatttcttctccgtcatcacctgatggtcctgatgtgtttccaagacattagacggatatactgaggttatttaaatcaccattgttcgagaagacaactaacctgaagatgtacctagctgagcgtgaggtggtctttgttctttacctgaagacccagctatcgagtcgttaccagcttctggtccttgcgaagtcgtcgtctgcgcttctacctcggggatctcttgatcagggcctgcgtacgactggtttccagtcgggggctcttgagttgttgccgtttcagttgttgccgactggtttccagtcggcggcaggtcactcggattggccctatcgcccgaagcatgggcgccagtcggctggctttcagcggtcggctggttttcagcagtcggctcggggtccttggatatattttgctctgtcatggcaggatcggggtcctttccagatggatctatatcagatggtttcctgcagagtgttctttcagtatttggcattatcttcatcggaaaacatgccgaagcggaaatcataccgagagatctaatacctggaagatgttctgatctttggcattgcacggccagccaattttttcctgggcatggtgcgctttgggggtttattagacaagcccttatccccagatttatcatcgtcgccttcatcatcatcgagtaccagctttctcttgcgaggacctgtttgaccagtcaatttggaggtctgaggttgcggatctggtctgatcgttagccctccacctccctgcgcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgtatacctgtggaggcggattgaatgcattatatggcacaactggcaattgatgagagtagctgactacaattgcatttgagaagattttatacatcctctccttcatgattttgaaatccagggaatctggttcttcacggttgggatcatgtttgccgtcgaactcgaatgctgtgcgggatctttccttgattggcgccagtcggcatttgatgaagtgccgagtgatttgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggacgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacagtacttcagcccaatacttttaacagcgtggcccattgtgttccttagggacttaggcatattttgctttggcaatattatgcacacaacagtgttgcccaatgctgatgaaatcctttttatgcggtcatataattctttggaattattgcaatgcaagttaaaaaggtgtccgacagaaaggcgttatgctgtttttgcaagcttttttaggctacaaaagctgtttgggttaactaggaatgacttgtttttattatagtcatttccttggcgtgttatatgcctgttttcatggtaaatagtcatggcctaggctatttgacttatttattaccataatctttatggtacttgatgggtaatctttagagtttttttattcggatgcctgtcaagtgagttcattcgtgaaccttttagagtgtaaaccactcggatttcttttattgtggctaaaaagcagtcggctagcatgcctatttaggcgccgcgtacgcttttgtcatgtaatgcacaatagtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagagggttacgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaatatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacactttccaagcttgatagccacccccttttattattgccgaaatctagtttcgacaattactatccctgattctctgtttctttagataataatctctgtgattctctgttggccttggcagaaagcgacaattcacatctgctgcagaaacttgcgagagccaacagccaagcgctcttttcctacacgaagcaaaattttgagagcttaagattcaaacagcttcttggtagccagcttctgataatttaaaaaagccagttttcttagcttctggtttctagttcattttatgaattctacaactacaacttcttaaaatttagaccaaaatctatattatttgaagaagcttctaattctgaaagaagttacagtagcaagaagctctctaaacatacctaggcgcgtgtaagtgtaaccttgacaagatcctggaaatggcgctgtcaggctttaattcggatgagtcggacgtgagctggacctgatgtttttgcccggtcttacgtcctaaacgcacttgtaatctacagtcgcctcgaattgacagcggaagcggattacgacatcccctgactagcgcggatctcaaagcatttcatgtacgtccctgattccattttttttagctagtgtatgctgtttcacactctggaatatctgtgtcactgtccaagcttcgtgtaggcagggttcgtaaaaccgaaaggattttaaaaaaccggttagttttcgtgaaacctttttatcatcagttcgtgaaaacagtcatttttagccggttttcgtatcgcgttgatcgaggatcactggttttatcggttctcggcaaatcaatgagtgattttcactccgaaaacgaaaaggcaaacgctgtgtgtagcacctaggagtatactactcctctacttgctcattcgtttacgtgtatctggcggtcaaacgatagtgagtcggtgcaataggaaaaatcagatgaaagttatctgttcagcttcaaaatcacatcccaggtgacacacagacagcacaggaacaaggacacataacccaaccaaccgacatatcaaaatttagttctggtttagttttcaactttttcttcaaatttttaactttttattaaatcaaaatttttctacacatataaactttcaattgttccatcacatcgtttcaatttcaatcaaaacacaccagctcgcaatacatgaatcgcgcacatgtcagtcgaatcgcacacatgtcaggtcaaaacgtcaaagtaaaacttggtttgcgagggatcttctagggagtgcagctctgtagcaacatttgcagatgccgttgaatgaaatgcaaatcatcagcacatgggctgcaaagtctgcaacgcaatgctttgcacatgttcagagttcttcagacccttgactgttaatctgttatcaacaacgagatgctagcacctcgaaagaaccaagaaactgtagaaggtggataaggtcacgatgatcacgccactcaaacgacatggacataatcatattattaatcttttagtagtagtatctaatcagatcttaaccttttcccccctatgacaaggatgttctgaactttctctaattcttgccgggttaaaaaagaaatgcaggaatcaatcgtcgcgtcaaatacaaagttaccacagcaatgatacaatcaccctcagtgaaaataagatgccaaaaaggggctaccgtacgaggacccttgcatacgatatggccccttgtttaaaaggtgacaatggctggtccacgcggaccataccatacaagcaaatcaagcctctctgtaaagcagcccaaaaaataaaaaaaaaaacaggaaaaacctctctgtacgtgcctgcgtggctgcgtgctcaacgtgtgcccgacaaaaagcccaaatcatttcacccttaataaaactataaaatacattcagaactccaaagatcgagaatccaaacaaaaacaagaaaaataaaagacattgtgatgcctacctttccttattttgcttgctttcctctataaatgaatgtcagagctcatgcctttttccttaaaaaacttgtgatgtctacccaacgtcttagaaaaatgccaatgccggagtgaaaaaaaaagtgagatgagcctagcttaaatggttatgttacttaggttgttttcttcccctatctttcccaactcacctctctcgttttccacgcgcacgctttctaaagtactaaacagtgcgtatttgcaatatatatatataggaaagtttcttaaaaaaatcatattaatttatttttcaagtttattttagccaatacctaataaatcatgcactaacggtcgctctgttttacatgttgtaagtgagggttcctagctcccactcccgaactcagcctcttatggcagaacacctcactcgactttaagttttagatttgatgcaggtactcgtatttatggttaaatttttttagtggtacggcaacgaaatgtttggtgtgacttcatcaatatcaaaatatatcggttcaaatcttccggaggtagttatagagggacgaatatttgcgcgttataaccacatttgtatttaaaaaatctaaaaagagaataaccctctggcaaaatttcccaccaaacaaaacgtctcccaagtcccaagaacgaaagggagaagaggacatcacaaaccgacccacccactgacgatccgggcccaccacgtcccgtatgactgtatgagttgtgacgccccatcaccgcagccaccaatacgtaagttgccgcacgagcgaaaaggccacaccaacggtcacagattagcctccgcctcctccctctctcctcctctcgccaccaaatcctccatagtccacaccccaccaccactccaccaccatcccaaccaacaacacttcgccatcacgccgacgccaggaggagccacgccacgccgcgccgcgctcgcggtcgacctcctcctccccccggtgccctgacgacgacatgggcgccgccgacaacgccgccgtacgggccgttcttggctctttcctctctctctgagtagtgtctactgtctactgtgcttcttcttgctcatggggttgctccgttgttggattcgtgcaggcgccgccgcggggagatgtgccggagaggggcagaggagggggggagccggaggcgaaggagagggaggtgaaggtggtcgtggtggacgagccgcctggggcgccggtggcgaggctgcaggcgcagcggccgctggcgccgctgcaggtgaccacgcaggcgccgccgccgcccatgtccgtggcctccggcggcgttgagccgccgccacaggtggcgactttccagcccgtcatgcagaccccaccacaggtaactaaacaaatgcccaatttgctgatttctttttggctgaatttaaaattcggtggtctctgaatcttcttgatttaaatagtgagattggctgagtcttttctacgcatgtggggtgtgtgtgcgtgtgtgagtgagatcaactgtttgtagcacaaaactggttggtggacatgtcaataattttgtttggtataatcaagcaactcttttgtatagttcaatcccctccacttgacatttcggcataaaaatttctgcgatcatgtggcgactttggctgcaacgacaatggcagaattggttttttaactagttccaagaaacagtttttagaggatacagaaagttgagtttgatctcgttttatacaattctaaaccacttgtactactattttactttgaaaagatttgattgggttttggatatattttgtggtataactcgtatctgagtaaaaagaaagttgaagtattttgcaagttggaaatgctttcaatcaatcaagcagattagcaatgtttgcactcagcaacaaccgaataaatcagcaacgcgtgcagctatgtgcgagcccaaagttgctcagcctttcggtgacagaaaaagataagagaggtggtagtgtttgacacgatttcttaatcaatgtagcctaacgtatagccttcattcattagatgactcatgtgtaacttaagctctaatacctccctaatagaatacctctagaatagagtaatgcactaatgcttggaatcgaatctccagttcaccgtacaagttgattttcatagcaattattccataggtaccaaaacctattgcccgttagattaagtagtagattaagcttcaggttgcagaacatgtgctaggtaatgtcctatgctaatccaatttggttgtaattgagtaaattaattaactttgagtgtggcaggtggcgttcgcgtcgctcaattcgcgcgtgtacaccaatggcatcacgctgtgcgtgttcctggtccacctcgccgcggccacgttcgccgtcgggttcttcgtgttcagggccgtcaaggacatcgtgcagcacccgcgttcccggaacgcgcagcgcgagcgaagcctgctgcgggaatggctgcctccggtggagggcgcggtggcgctcagcatcgtgctggcgttcgcgtggcagaaggcggtgcgggcgtggccgcgcgccatggtgggcgtcatcctgtggtccagcttcggcatcacgctggcggtgggcgcgatgctgatgtgcttctccatgccggccaccgtagggctcggcgtcgccatggtgatgttctccatcgggacggggctgtacgcgtgctgggtgacgcgccgcgtcgggttcacggcgcgggtgttcgagcgcgccgtgcagccggtggacaagttccgggggctgaacgggccggcctacctgatggtggcggccgggttcgtgtggatctccgtgtggtgcgtcgcggtgatcggcgcggcgaactaccggttcccggggctgaccatcctcggcctggtgctcagcttgatgtggacggcggaggtgatgcggaacgtggcgaacctgacggcgagccgggtgatcgcgctctactacctccgcggcatgcagtccagcgtgcagttcagcttccagcgcgcgctctcctacaacctcggcagcgcctgcctcggctcgctgttcgtccccaccatcgaggcgctccgcatcgtcgcccgcggcctcaacctcctcgagggcgaggacgagttcatgttctcctgcgcgcactgctgcctccacgtcatgaacgccatcttcgagttcggcaacagctgggccttcgtccacgtgagcttcgacggacacacgttcttcgttcttgttgctccatggtttaagtttgtggtgacaatggcggatgggtggtggtgtttgcagatcgcggcgtacgggagggggtttgtgcaggcgtcgaggagcacgtgggagcagttcgagaggctacaggggatgccggcgctggtggactcggacatcacgagctcggtgtgcttcctcaccggggtcaccagcggcgcgctctgcgtcgcgctcgcggggtcgtggacgttcgccacgcacaagcactacaccgccaccgtctcgctgctcgccttcttcgtcggatacctcatggttcgcaccgcagcttcgcgccccacctctctagacacattttctttcggagatttgttccgagcgagtgaaaaagtatctcgagataccgttacctcacgataccaaatcgtttccgatcgttggatctagctggacaagatggacattgttagatccaacaatcggaaatgatttgttaccggtatctctaggtattttttgttagaccgaagcaaattttttcttttgttgtgctcacgagaatttttgttgtgcagacacggattgggatggcgctgccacaggcgtgcgtgggatgctactacgtgtgcttcgcggagaacccgacgtcgcggctgttcgatcccacgataccggagcggctgcacaagatgcaggaaggcgccgacccgctcgtgccgacgccgcgcttcccgcaacaacaccccggcgccgcctgatcgcgacacaaaaaagctcacccgatcaacgagtcccaaaccctttggagattcttgcagaaacacatgagaacgaggtgatctcatcctgtcgcctgtgcagcctgagctgacccggtaggcgagactcctctcgtcgttgcgtgaatgggaggcaactcgagatggaatcatgaatcctttggaccatgctgcaagtgtaggcgagcagaatagtagtagcagagaatttggacccaacccctattgctagactttcccccttttcgtttctgtaaatttcccccatttttttgacaccaccgattttttgttagtgaaattagatgacaagcctgaacatttcatatttcaggtgtgtaaagaggtttcattacatctataggaaattcttgtgaatattatccaactttttttttatccttttaaggtcatactcctatttgtttccaagatgaccatgatgaagtcatgaactggaccttataattgaagggcacagagtatcagagcagacatgtagttggaccagactgtcttgtgggggcactaacaactttgcataggttggttcatcacgcaataatggatggtagatagtgaaaaaaaatgtcacatctccatatctccgttctacaacctctttcgttttgtttggtgagtgggtgtagacgctgtagtgagcagggtttcatttaccgcggtaaaccgcgcggttaccgcgcttaccgcagggtacggtaaggggtaaaccgcggtaaccgcgtcaaattcaaataaatttgaaaaataatttgaatttttgataaattttatacggtttgtcgcggtttgtcacggttaccgcggttaccgtgcggtaaccgtgcttaccgccggggcgcggtaaccgcggccccggcggtaaatgaaaccctggtagtgagtaacacaaggaaagaaccacgaccaccggggtaaggccgagtttagttttaaacttttttttttcaaacttttaactttttcatcacatttaaaaatttttcacacacaaacttctaactttttcatcacatcgctccaattttaattaaacttttaatttttgtgtgaactaaacacaccctaatgcatttcatttgatgaagtagttgaacattgaattcaatgaactccccccaccacaagaacatccacaatcaatggaagggcgaaaatgtagccgtgcttgcaacagcacatgtccttacgtcctggatgacaagtttttatattgaaacgatgagaggacgctgtgtaactcttgtctttattattttcggtactactacgtattagggcctctttagtttgcggaaagaaatttttttagtgtcacatcggatgtttcaccagatgtcggaaggtgtttttggatacgaatgaaaaactaatatcataactcgcctggaaatcacgagacaaatcttttgagtctaattaagccatcattagcacatgtgggttacggtagcacttatggataatcatggactaattaggcttaaaagattcgtctcgcggattccatgcaaattgtgcaaatagtttttgtttttatctgtatttaatgctccatacatgtgtttaaagatttgatgtgacgtttttgagaaaaaaaaatttatgaactaaaccaggccttactccctccgtcccataatataatagataatgggtgcatgtgacacatctgtccagattcattttactaggatgtgtcgcatccacccattatcccttatattatgggacggatggagtagtatactcctctgatgatgagaatttagcctccacttagcaaaagatctactcccttcgtcccataaaacaccaacctagtactggatgtgacacatctagtactatgaatatagatatacatttgtccagatacattgtactgaaatgtgtgtcatatcctgtttagatttttttttttttaccgagggaggtccatgaactcgtagcgtgtcttgtcaagctttcacccagtcgtcacgttgcgccaccttttgttttgtgtggtccttcgctgaataatcaccgtttgattacgatttttggtcatgtttctttaggctttttacccatggattgtcgccgttggtggaatattcgagagagatgtggaacctttcattgcacgcacgcacacgctgcgccaccaaatttagaccttgtttagatgggactaaaaacttttaagtccctatcacatcggatgtttagatactaataataaatattaaacgtagactattaataaaacccatccataatcttggactaattcgcaagacgaatctattgagtctaattaatccatgattagcctatgtgatggtacagtaaacattctctaattatggattaattaggcttaaaaaatttgtctcgcaaattagctttcatttatgtaattagttttgtaagtagcctatatttaatactctaaattagtgtttaaatacagagactaaagttaagtccctgtatccaaaccccaccttatctccccgaaaagatgacgctcagccttattgtttcacttatgtctatgtttattaggttaaaagttaaattttcagttttaaatttaaagctgattttaatttttttttcattagagtttacttttcagtttttaattttagaacactaagaacacgcatataaaagtttattcacaaattgattttcgtttgcaaatacgttgaataagccaaaaagatggggccgtaggtcttggcgtatttggcctcttttgattgtctcgagtcattttccagtggctgaagatggagacgtttcttccgagttacaccaacgatttcttcattttcttgcgccagatgacacaggagagtatctcgttttctattccgggtcgtgtgttgtaaatttggcgtgcccttgtgcattttgtcacttggtctgtgagtgctaggagggcctggttgacaggccgtgggccgtggccttgttgctgggaccgatactttgggccgtattcgctggaaatccgtgggccgtagcctattgggcctcctcttcgcgcgatttcttcttgatagcgtcggctgtttgtgttccatgtgcaaattatagggtgttcaggcggcgattctctcctgtgcaacaacgctgaaaattgtcaagcgatttctgtccaaaaggcattttacttctatagctgccaaacacaagtacacggcagtacgacacaaatcacgatgctttctaaatttgtaaattggttggttaattgaaacatggagaactgatgttttctcagaataattcttttttttttgcggggaagaagggaatatattactcagaagcaatatcctcacagacagtttgtgagataaaagtacaatttctcagaataattctaacagtaacatcacagtactctaacctaggaaactccatcagagcatactgcttaaacgtaataattacagaaaaaaatgcggtcagaatgacaattgaccacttcacatttctcatgatcccaaatgatccattccatctgttgccaaatgccgagcaggcattgacatccactatatacaacatcacgaaaacctcttgagaatcatggcgtagaggagctcgttccacgcgtccggcacgccggggaggcaccagtggctgcagtccgccctctgcctcgccggcgacctcgccgccgccgcgacattgaacaccgacgggtggccgtccctcctctgcgccgtcatcagcgtgacgttcagcacacgcagcttcgccgccgccgtgccggatctcgatggctcaaatgccgggttcaccatccctggccaccggtgaagtgaaatccttgatgagttcagctcaggtgttgtctccttggcgcaaccaccattgctgctagccctgcaaatttttacagaattgatgctgattgaatgttgcaatgtactatgtgtatgaaatttgtaacagtctacagaaaaaattttctgtgtctgaaccattttcggtttttcactgaccttgtgtgtgctggtgaatatgttctgaaaatgaccagggacttgtgtgggtttacttcacggtgaacccagctggttaatgtgttcattgctctctgataggctgcctcgatgctcatgttcagaatcaacttcttgcctacctggaaattgcagcgtctggcatgacaaggttagtcctatgaaaaagaagagagtaaattgcacttcaaacgaaacgtgatctaaacccaaaaggttgagatatttatagtccttaaaaaaatacctcgaggtatctaaattttacactaaatttttttacctcgatatacttagtacttggatatactaaattttacactagcaagtgtggtaccttccggtatcttttcaaggatggtaaaattatttcaaaaggttttacaggttttactcgtagtttataagattttcctttagttatatgacgcggtctaatgcaaagtgaaatttattttgacatatttcggtgcaaagtaaaaatatggagcaaacccgatgcaacgtgaaactacatttctacccggtgcaaagtgtaatttaggctgtgtttagttcgtgcgccaaatttttttttaagtatacggacacacatttgaagtattaaacgtagactaacaacaaaacaaattatagattctgtctataaactgcaagacgaatttattaagcctaattaatccgtcattagcaaatgtttactgtagcatcacattgtcaaatcatggcgtaattaggctcaaaaaattcgtctcgcaatttacgttcggactgtgcaattggtttttttcgtccacatttgattctccatacatatattcaaatatttgatgtgatggaaaagttgaaagtttgaagaaaaaagttgaaatctaaacacggccttatactaaagaaaatatttgtaacgtacagttgcagaagcctctcacggctccaccagtggccggtgttgaacacgacgacgtcggcgtccttccaccggtgagccctcgcgtccatggcgtcgagctgcagcgtggagcacgcggcgcccctgtgcgcgcggcgcggcggggggcggccgcgccggacgaggtacggcgaccggtagtgctcgacggtgcagttgtagtcgcggaaccggaaggagagcgcgccctcgtgcttggtgatggggctcccgttcacctcgtagatcgacgccgccttgtcgccgtcgccgtcgccggcgaaggcgacggccgtggcgagcatgcatagcatcgactcccactggttgcggccgatcgagtcgccgacgaacaccagccgccggtttcggagcgtctcgagcaaattcttcgcgtcaaatctggaaatggatatcatgatgagtaacagcttgtcagcttggccatcgatgaactgatcgcgagagaatttttggtgttggaaggagaagaaaaccttgggagagtgcaatggcgaggctgccacctccacttggcgaacgcgtcgtccggccggccgttctcccggcaccggaacccctcgtcgacgaacgggcaccgccgcggctcgacagcgggcgccgctcgtcgtcgtcgtcacgcacccactcgccgtcgacgacgtcgcagtgctcggcagcggcgacgacggcgacgtcatcgacggcgtcgctgctgctggtggtggtcgccgccgtcgtcgtcctcacgagcacgctgatctcgccggtgagcctcgcggcgccgaagccggaggagacgcgacgaggaggaggagcgagagcgcggagacgagcacgcaggcggcccacgccacgatctggtcgctcgcctgcctcgccctcgccgccggcctactcctcgcgctcgccatctccattgctcactcgatcacgccgccggcaatggcggtacaggggtaggagatcgaatggattaatcgcttgccgtgatcaacctgatgattgcttactataatatagtattaactcgttcttggtgttgccgttcttgatcgagatggagggacggttgctttgttcgcttgtgcttggaatcaacaaaacttcttttttcttttggagatgttgatgaacaaaactagcgttggatgtttcggagagcccaaacccaaagggatcaaaggtgacggcgagtgcagttaacgaagtggtagtgtgcagttgaacgttttgggttcgtgtcttcgtgatcagagggcgtgcagtttgcacgctcggccactcttttatcttgtcctaatatctagcgatcggtggagtgttgaacttttttgctacacgcaagtaaaaatttcgtacaaacttcttactacttccttcatataggtgatattcttccctgcataaccttcgccaatgtagccatacattaatacaatcgcaactctcattagctcatctgttttggaaatataattaggatgtatttaatgagagcaactatgtaatctaccatatcatttccttagatttgctagaaccacaattatttcgaa

SEQ ID NO: 40413 - DNA, 5919 bp, Oryza sativa
aaatggtcaacaacgcatatgctaagatgataaagatattttgtttagttcagcgttcttaaggggggaggggggaataaaaaaaaagagggaaatggtcaacaacgcatatgctaagatgataaagaaattttgtttagttcagcgtatcttcaggaaaaaaaatctaactaaaaaaagagattaagctcagatgactaaccaagcaaagcaaatgatcattaaactatatctaaacagcgtaaccaagatttgagctatagctgaatttagtggaaatgccatgaatattggccacaaaatgacaacaacacttaccagacaagatgaagccagatattatgagaatctgaaaagaagaattaagcattagtgtcagcagagtcactaaaactcaaagtcatctgcatcaatgtattatagtatctactttaaaaaaccctaacaagaataatctgaggggtgttgcttgagtaattagtgataaggaaaaaaaaaggaattccttttctcctttttgtatatttttcccttaataataaaaatcttattatcgaatgcagcctacttgtcctgaagtacaatatttccctttcacacttcagattaaacttatgaccaattatagaaaaaaatattgtgtagtgctaaaaccacgacataatacagacaatgctatagtaattactcacccatcgagttgttgagatctcactccagccatgagtcacatctgatagatcctttagtgttgttccaacatataccaatgcaagagtgataggctggcaaaaacagatgtgattaaccaaaaaaaaaatgttgcaacacttggtgggttgattcagcattttagataaatggtaatacagtaagccgcaaagtagttaattacagtgggttctactgtgggtgcttttcttgtccatgtcaatatgtaaattgagaactatggaatcaaataccaacttctgaaggagaataatgtataaagcagcagattatgcaaaaggccaacattgagggcatgattccaattaacacaggtaatatagagtagcaaatgatatcagagcctggttccatgttatgcaagtaaaatgtaacatagcagatgataagagccaagttcactggccaaccagtatgtagcttggtcccataaaaattgcttaaataagaagaaattggcataccatcatccccagccaagaagccagcatgtactctccaatgccaacaggagtaacggacaacaggtagttcaacatgttgaacggaagtaaaggaacaagccttaataacaacacaatctgtaggcaaataagtaagacaaacattgttagatagttaaatacactattgtattaaagagaactttagttgcatgcaatggtaagacttgaatagaaggaacaatgaagttcaggatgaaagcaggctcaaaagtttatttttttaaaaaactatataaaaataataacaatcaagcaactatagttgctagaaaagtactttcttttcaagaacatgcaaaagatgtgtacatgattgtataaaaaagagagcaaaaaaacaaaaaatatagcaaagcaaagcaacaaaacatatagaaaatcacaaaaattgtcaaagagaaataatttaaacgaggtgaattctatatgattatacgttgggcatccaaattgttactatttgaatgcaatttcaaaggcattaaaaaacatgtggcacaaaaaaatgctattttacaaagcatttagatgttgatatatccttcatcacatcagaggctagaattccaaactccatggtgcaagaagttaccttgaagccagacctttcgatagcaatagctaccgcttgaaacttgggataatctttgcatttggagagaacatatggccttcctatctgaaaagtactaaaaccttaatcacagaagtacataaaaaatacaaatagtgaaaaccataatcaaaattatccttaccgttctgccaagcaaaaatgcagcagttgcaccaattgttgctccaatggaatcagcaacaaacccaacaggcaggccaaacagataacctcctccaagctggcaagtagaaaatgcacaccagccaattaattgatatacaccagaatattatactctcatcatcttatgtcactatgtcaggtaaacaggaaagcagagcaaacataatttccaccagaacaatacagacaatggtgcacttgtatataaactacatattttgcatatacttatcccaatatattcactaataatcctacaagtgggagtggtgagcagtagaaaatatccaggaaggaaaaggttctaaaacttcttttaaacaaaaagttgtatgcaccattgccatcccatacaacatttactgtatacagttaactgatgactacagagttgtggtacaaaacattaagcctgtggtaaatgatacatcaataaatcaattgaagattgacaagataatactagaattgacagtttattcttaaaattgattctaatgaaccaacgcagcatttctcattttgtttctcattctttcttcagttcaagcacaatgtaaactgtgaaatatatatcccaggtcaggaatcattggtctgcttgagctctatcagtctgtcttagaaaccaatattcatgaaataaacgaccgtaagaaacagaaggtgattgtgcttactgtaagtatggatgctggaacagccaataccgtcaaagggacgtaagcaagagccctgaaatgcacaacacgatagctatcaactatatatcacaagactgtttgcagctacatttatgttcttgaggaacaacactaagtacagataagtaagtctatatataaaaacttgagtcacactacctcagctctatgtcaaaacaatgaaaacccaagtaacaagtagtaaaatacttttacatccccttttcttttttgtatcatgtttgttggctaccttttagcatgagtggttcctctgaaatgcatcattatgtaatacagagagcaccccagacaggtggtgcatgtgtggaaaagggcatgcctaactgcctaatgccgaagatggagggggaacattctgttcactatatcaatcgagttaaatacaagcaaattgaatacttacaataccagaggaccccatggacccaagttatccttgatccaaaccagaaagtccttcaaaatctgtcaatgatgcattgcgattcataatgaataaaatgaaaacgacaagcatttgaagcaaaacaaaaacctccaattagttttaaatatttataatcacaacaaagaaattaaaacaattgctggcaagagagaaacagggcatgcaagaaatgtagaagaagttaacagtacatggaagattgtagacttttctaacaaagataagtctgttaggtgttaaggaactagagatctaacaagacaataaaatcttctacctccgtcccaaaatataaaggatgctagctatgcatcccccctcttcacttgacgctgttattcctgaactatagcattcaacacggatgcagaaagccaaagaaatacccttgtgatgctagaaggacatgtatttcaatgtactgaataattcacacaacaatggataggctaaatagctaaatctccaacaatcctaaaattctaaaatgacaaggtgacgtagcctttcgtacttaataaacttcggccagcttttcaagccggcccggcgacaaggtgacaaggtgacgtagcagcctacagttaactcggtgtgacaatcatcaacgggagagtgcatccaatcacggccacaaacaaagctacatttcggagttctactaagttgcacaacactaccgatattgcacattctttttgttaaataaaaaaaaagttgcgacatgatcgtatctgaaatcaccccgatatgaagcaagcaaagcaaagctatcgcgaaccttgtcaacggggagcgtgaaaagcgcgacgccgaccgcggcgaggagcacggcggcgacggcgaggcggatggccgagggccaggacagcgccatggacgcgagcagcctccgccgccagggcctgagccccctgcagtcctccccctcctcccctccctccgcgccgtccgcccagccccccgccctccccctcgcccgcagccccaccgctccgcctgccagatttgcccccagatctgccccctcctcctcctcccctccgccccccacccccgcgtcacctcctcctcctccgagcctcctacaccctcccgcaccggaaaatcatcgaacacctggcgcgcgcggcgaggcgctggatctggagcacgcgtcccgcgcgttgcgtggcgtgttggcctcgatttttctcggtggagaggaggaagggagagagggatcggggagaggaggagaggcttctcgcggcgcgctcgctggcttggcttggctcgcgcgtacgcctcggcttgcgtgcgtttgcacctaccgctccgacgtcgccgcgtgccggccaccgacaagatgcgacgcgtgtgccgcgacgatgcgacccgggggaggcgaggcgagcgagcaaactgatcgcgcgaggacggtgatttgtgtgggccgagaatattgggcctttctaaatgggcctgaagtgcaggccacgtacataactgagctatacatttattaacaaaatttctcttgaaaatttatcggatgtaaatacagtgtgaccatagtgtagttatatatcgtaaattgcatataactataaaactgtattgtatgtaacttttaaaaatctcacactaacacgctattttcgagaaacgtaggtcgcaagaggacgagactgaatcttctcacacgtgcacgcggtatgatttttttttcttcctgacttacacggatcttgaagtaaatctaacggattaaaattttatgatagttacatataagttatattgcagttatatacaaagtaaaaaaagtaattatgctataattatatattgtgtttaggtttgacaggtcctagaaagaaaaattatcaataaatatatagcaaaatcattccggaattcgtagaacattttgagaatgactaaactacaagataataaatacacacatttttcttatttatatatggcacgtggtacagaagctccagtttgcaatgcaatggttagttctccaaccccaatgcatgcacacgtacgcttgagtacacagtgttcttagaaattaaacattacaaggaactagtacacaaacttccatagctagcccaagatcagaccagcaaacacaagaacatacacaccagtattacaatatgtatatatctctctatatatactataaaaacgaagtgttaagcgactggtggtaattaattaacacacagcaaaataccataatactgctcttcttaatcacacttaccagtgctaatcctgaagaaaacacgcagcttaagctcagtaatgcatggtacattcgctagcttaattagctagtagccgccgcagtggtaggtgtacttgcagctgtcgccgaccttgacggtgtacttgtgctgcggcttcacgaggaatggcggaaggcggagcagcgcgtcgcacacgcacgccggctccacctccttcagccaccggcagcagtctctgttcgcgcggtggtcgtcgtcgtcgtcgtcgtcgtcgtcgtcgtcatcgtcatcgtcgtcgtcgtcgtcgtcgtcgtcgtcatcgtcgtcgtcgtcgtcgtcgtggtcgtcgtcgtcgtcgccgccgtggtcttcgtcgtcgccgccgctgtcgtcgtcttcgccctcacgcacgccggggtggtggcggtggcggcggcggcggcggcggctt

SEQ ID NO: 40414 - DNA, 12273 bp, Oryza sativa
gccgccagcgccgccgccgcctccgtcgtctcctccactatcgtcgccaccgccgccaccgccaccgccgcctccgcctccgccgcccccgccgtcgtcgtcgccaccaccctggtcatcctcgtcatcatcatcatcatcatcatcatcgtcgtcgtcgtcgtcgtcgtcgtcgtcgtcgtcatcatggtggtggtgatgatcctcgccgggaggcaggatggcgcacgcctggctggcgatggcgaactggctgaggcagaacttcttggtctgcgccgccgccggcgccggcacgccgacgaacgggagcacgagcaccgcggcgagtatcgcggcgcggagcacgggggagccagccattgccaccaagaaacggctagctagctagcttcccttcttggatggtagtatatatctacgagttgtacaatgcagttgcttatatagttgtggccttgtaggagagatcgatcgatcgactccatggctgcaagtttgcaacgagatctggaagagtttttctttgcatggtcgctggatatgtggcgagatagatggccggggggtaggaaagcgggcgatgagttgtaggtgcttcatgctcgtggtgtgagtgacttgggagttcggtcggtctgagaattttgagtccattgttgttcacttgtgtatttgaccttttgagaaattttactgttgttaaagttaaagaaagtacttgtagttattaaaaattttggtacttgagttacctaataatgtgtgaagatatcaaattttacgttagaaaacgtggtaccttatgataccttgttaaaattgtaaaattacccttttacttggtagcatcaagttagcagcactttgtgtgacttgattagttcatctgcacaatttgaccttattttcttggtcaggatgagagtctctctctctatctctctctctgagtccatggtcccgttcatttcctctataaaaggtggataaaattttggatattcatcgtggcacgctttttaaactgctaaacggtgcgtttcgtacgaaaactttatatatgaaagttgctctaaaatattagattaatttattttttaagtttgtaataattataacaataatctatttttcaagtttgtaataattgaaactcaattaatcatacgttaataccacctcgttttgcgtacacttaatcttcattttcaggagaaaagaacatcaccatgtattgttcacttgtgtttttactttttgagaaattttattgttgttaagaaaatacttgtagatattaaaaatatagcgtaattgttgaaactcacaatataagttctaaaatttacttttttttcttaattgagatatcttaagaatagctagtcccaaattactttgaacattcatatatcaaccttggggcaaaacaaccatgcatacatctggatcaacaatgtggaatgtcttggtgctactgacaagtggagcccacctattgaagtgttatacagtctacttctgaacttctgttttgcctataatataaaatgcttgtgatatttttcatccatggcatgttgttgtcggctaaacctgcggttgctgggacagccagccgtcgtcgatgaagctgatgtccacaaacttgtgcacctgatcatcgtccagctgcttctcccatgccactctccctgttttgttggctcctggcccttcacacccagcctctgcaaatgtgatggtcgacctgaatgaacagaaacaaaaacaaaaatttcagcttaaaacacaacaacacattaagcccagttaagaactttctcttttttaaaaaaaataaaaaaagagagaaacaacgggtgcctatgagaaaaaaacggtcaatttttttcgataagggcacgtacaacggtgtttattagtggtctctctctactgccatgcaagtaaatttggtgacatggaggaaagagaaaggagtatggttgttatgcatgacaacggctcagagtcgactcttagcatttattagagcaaattttgttgcatggtggtgaaagaaaggaaagaaaagtaagaaaaagtattttaatacataaatgattagagaccatattgtctctaactgttgtaggatgctagtctctaaataacgcagagcttatatccgactctacctttgtacatgccctaatggaatttagtgcaacctctacgttacatatatatatatatatatatatatatatatatatatatatatatataggtatccaataccttataagcatgacttaatacgaaggtttcagggttcaaaatatattctaaatttgatatgaagtctgggttttggcaaatccaaataaaaaaagaggatatatataaaactgcctttactactcctttgggtcattatgaggggaacataatgccgtttggtttaaaaaatgctccttctgagttccaaaaaataatgaatgagattttccttccctttacatccttcattatagtttatatagatgatgttttaatattttcccaagatgttgaccaacattggaaacaccttaatatattttataaaattatagttcaaaacggtttagtagtctctgctaagaaaatgaaacttttccaaactaatgttcagtttctcggttataaaattcaatatgatcaagtccaaccagtagcaagagtaatagaatttgcagaaaaatttccggatgagataaaagataaaacacagttgcaaagatttatagggtgtttaaactatgtctccgatttttataaagatcttgcaaaagacagaaagattttaaccgagaggttaaagaaaaagcctccagcttggacagctaaacatactcaagctgttaaaaagatcaaaggtaaggtcaaaaccttgccctgtctttatattctagatcaagatgccttcaaaattatcgaatcagatgcctcagatcatggttatggaggaattcttaaacaaaaaaagaattccaaagagcagctagtcaggttcacctctgggacctgaaatgaggctcaaaaaaattattcaaccatcaaaaaaaaaatattggccatagtaaaggtcatatcaaaattccaaggagaattattgaatcaaagattcttgctgcgtatagattgtaaagcagcaaaagatgtcctccaaaaggatgtggagaacttagtctccaaacaaatctttgccagatggcaagcaatattatcatgctttgactttgaaatagaatatatcaagggagaattaaactccctaccagatttcttatctcgtgaatttttacagggctatggcacctaaaagagacttatcagcccaagggagaactacagaaagttcaccaaataagcataaatataatgaactaggaaatatcattcctagaacccctacagttcaagaaaagtatgggaataattcatcttatatcctcaatatagatgaggtaattctgccattagaatttggagactctgatctcaatattatcaagattatgggaaagtatttcccacaacaccaatattttatccctgaatatccagggaaagatcaaaattattatgagaccatattatgcgagacaagaagtgcacagatattccatacaaggaatggtgatgatttgggattcacaaaattattgatccaaaaaaatataagtatcgatgattgggataaatcatcaaatccttatgtagccaggactatatattctacatcctgtacaaataaaagatataactattgggattatcagaaggcctgggaaaaagtactcctcgtacaaaattcccagatgaagcattcatggtttattcgcttcaaagaaggatgtgaggagataccgctgtggtttttcagtaattggtggctgaaagcaggggccattcctgaaatcctaccacaagaaatcatcaaagttattacacaagaatcaaaaaaggatctcaaggaatatccttttatccttatgcaattttgtgccgaaacagggatgccttggatactaaaatgggacctcaatattcaaagaatggagttcccagcaaccttaaagcgaaactattatgcaagatggtgggataagtttgcaatcacaccagtaattgaaggaagaaagtttcgagccaaaaacaagaaatctcatgtggctcaattaaaagaagatataacaagagaattattaaaggcaagacccgagttgacaaagggagaattgcaacttcaagtatatgaaactacgtttaaaagattggaagaatcactaaaatctagttctacatgcaaaagtctagatgaagatatggtacaatgcagccaaattaagccatcttcgccaatacctccttattactcaattaagcaagataatgattcagatgaaggaatatcagatttcaatccaacacacatttagccaagatatgacgacagatcttgtcaccaagataatgagtaaagatcttgtcatccccgacaaagatcactattcaagataaggaatctacactattccagataagataagtttatggtcaaaaggcgatattatgacatctttattgaaggtcaaaagcgtcatcaaagattctctccatgaagtctaaagggatatcatgaactctttgaagtcaaaaagagatataatgaagattctctaccgagcgctatataaggggctcactatcacatttcagaggcatcgcattccacacacaacacatctcactcaaccattcctctcaccgctccaccagccatcacactccactccactccatctaagtgttagtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacctatcaaggtatatgaataaacacctggaccgttctatataaacctactatgttctaaatatctaattttatatcttgtacataattcgtatttacagcttgtctttatttcctgtactgcatttatgtttgcataataatataaaaaaaattaacaacctggattgccatccaattgtcacatactaatctcacatccaagattgcatatagataagcatttctatcctcatatctggtgactagacccctagtcactgccctgggttagagctggtatcagagccaagtgctcgtaacctccccaagccatcttctccgaaaggggaggggggggaagaggggtcgggtggcgtgctgaagtcgcggtgatcccgaacggtgtggttgtgttctgaagtcgcggagttcccgaacctttgatcggttgcccgaagtcgtgttgccttgttgagccgcgaaggcgtttatcggcataattcgttgactgggcacttatcaaaggcaaaggttgaacttaattgtgggaaatattccctgccgttgactggaatacatcatatccaaataggttgatcataattgtgggagatttccccgctgttgactggtaactacctacctatcttcctatctttcatataagatgtcttggttggttagatcacgaagagccactgatcaatctgtagtctgttggcactacgtcgataaagaatgcttcatctatatcttttgaggatattgagaaaagtatttccaactggaagatccctaaggttaatattaaggaaatatatcatgtatgtactttttcgtatatatatatatatatatatatatataaatatatgctacttaaggatttatgtccaatcatttatttaaatccttcgtggagcctaattgcctaagcaaagtgatatgcatgcatgtacaagcagttatatttgagcatacataagtggtgtactatttataatagtatgagtgtaatgatatatgtgcgtggtgtaggtttaatgtgagagtgttcgtgcccaacctagacatacgaacatgtttggcggaaccaatgtgtgtctagcccataaaaaaatagataaagtttatgcatagaaaatacatataaactttatatgtggaaacttttaattaatgaaaaattatatataaaaaatcagaatcgaatatataaactgtgggtatataaacttatcagaaaacgaaacggatgccaaaaagaaaaacacagtcatttgcacatgaccaagacacgcgaacgttggcgcattagctctttcaatgaacataatcatcttaaaacaaaacaaaaaaaagtttcttacacattgggggagttccagggctgccatccttggggcacgacgatgttggtcatggacacctggtagaacaccacggtggcgaactggttccacgcgcgcccgaggtactgctgcccggagcccagcagcgagccgcccttgaacaccagcccaccggggtcggcgtcggtgacccgggcgtgcgccgtcacccaccccggctgctgcggcgacggcggcggcggcatgttggactccagcgtgcagttgtcgtagatggactgcccgtagccgaagatgaagtcgacgccgcccctgacgtagcagtggtggaagtagtggcggcccttgaggtcgcacagcgtgtcctggaggggtggtaatgggtcaggtccgtgggttctttcacaagccatcttaacttatttaagtaaaaaaactattgaatttcagtctaacctttttttatccaaccctaacattttctaggctaaaatgttaggcccattatcatccctacctggaaaccgtagaaagcgcagtcgtagaaggcgctccggtcgccgccgatgagcgccgcaaccgcctggacgggcttgctcttgtcgtacttgttataagtgttctaccatcatgtatgtatgcagtgcaatgcaagccagtgtcatactcagtaactcggagccaaatatagaagcaaggtactaacttcgtgtcaaaatgtaacagttttaaactataaatatgaacaatgtatctagacaaattgtccagtagttaaatattgttatattttagaatagagtaagtactttgtttctggtaattagtactttcctaaattcgtaacactgaaatggcatcgagtagtattgagaatactttttccttaaatattccaaatttctacgacatactaaaataatatgaactacataattattgtactagatctagtgagccgcataagagcaagtacaatagcactataagccagttgcaaatatattttaataagataaaagatgagagagaagagcagcgggctacaactctgtagccagctacagcacggactccaagacgcaatgtgtatatgacagtgggaccatatgctaatagtatagtaaacaactattgtatgaattggctgttaaattggctatagaagaattggagctagtagttggctgtactattgaccttgctctaaccaaagcctttatttttttttattttacacgaaagacacatacgtacagatatgacacaccaaactagacacgcacttctattattgataggggaaaaaacctacgggatattcctagcagcactctaccagccgagctatacgttgttctcaacacgtatattttaacatatgcatatgtaccctgaaggagatgctgcgagcgacgaagttgtcggcgaggacgatgaaggtggagctgtcgaacgtcgccgagccgccgacgtcgctgtagccgtggttcaacagctcgtcgatgctggcgtgagcgtgaccggcaaaggtgatctcggtattccaagacccatccccttccagcactatgaattgtttctgactcgggatggtaaccttctccctgcaatccatgcacacacacacgaacacaaacactcaccaacaaaaaaactctcgaaaatccaaacattcttgttgatcttttctttctttcttttgaaatgaatccaaacattccttgaaatggcatatcagattgacagtttgaaacttcttgaaggagaaaaaaggattagcagtttggatacgtactcgtagcttcctgcattgacatggattttgatccagtcgcggttgccgtcgggcacggagttcaccgccgactggacgagcgtgaagtcgccgccgccttggtgatcgacggtgatcgtcctcgacaccggcgccgccgcggagctcgtcgcgatgaacaccccgagcagcagcagcagcgggaggaggaggagctgatcatggcgagatggctgcattttggacacgaatcttgaggagaagaatctctctcgcattgagacgattggtacatgggtgcagaatttatccggtgattaggccaaagcgcgtttacacttgcctgtgctggcatctgcagggtggcgttttacagagtgacagatttggtaggtgttcaactggctgcatatattggcattaaaccaggggaggataatatggttagtttagctatattgatttaaaaccctactaaattttcgctattgttaccacttatacatagagataatttagaaaataccacaaacagtacaccgtattgaaatagaatattagcaccttttcttatcacttgtagataagactattttcataatatatgctgaagtctacaattatacggtattgaaatagaaattactaccctgtcttaaaatatactacgtaaacctagaactgaatgggacatatcgtgatactacaaatctagataagaggcatgcccagattcagtttggatggaaggtatacccaaatatggtacataagaacatacgaacagaaactccttgcacggggatagaggttgtcggagtccgacccatgaaaggcatagtcttatttgcccgtgccctacaaagactctccgagttctacttgaaaaggaagttgcttacccgtgtaaatataatgctccatgggaggtgagtacatcaaatcaagccatagccacaagccgtatcgtagattcatctaaagaaagtccattgttagtcactgactataagtaatcggatagttctcagtgagtactagatggtaagctagattagctagcttgctccaccattgtaacccgtgagagacatcccatagttatacatattaactagattaggactattaccgatctcagggcctaaaccaatataaaaatcccctgtcttcatcttctttactgcaatctcacgtatatttgcgaattaaggatctccatacttcacaaataccgtagatgagtatagtccgtcaacggtatatataaatgaacaaccacaattgacaacacaaatagacaagtgagccaaacagacacccaccacccatatttcccatcttattcttaggttgaaattgcgttgccaacaacttaaagggccattttgatttaaagctatgccaaatttttgtggtgcctatttttggacttgctttagtataattaatttttggtaggataaattgtaacgcctctatatatttgcccaaagctctcactatcttgtaccattgggagttgccaaatattccctagttccatgtcaaaatatagcaatatagtaccagattagcaccacctaaaaaataacaatctagtacgtgattagcaccacctagtactacaaagtatgaatatggagaaatctatgtctagatttgagtcctatgctagttggtatctaataagtattatattgctagtatattttacaatagaagtaataacttgaaatttggatttatttaatattttagagacttgtataagaaaattttcgcacaaaacgcgatgtttgccatccatgtcgtgaattgaacacctcatttgtgaactgctttagcaattgtattccccatcgtagcttttctttattcgtcaactgaacccctcattcgtgaattgaacacctcatttcaaaagcttactaacaaataccgtggtagaatctaaatcttaataaaaagtaatggggccttataaatttaatttttaagtttataataattaaaacttaattaatcctacgctagtgactaatccaattcgaacgggacaagtgcacactccaaccatcccctgcctctgtagaaacaaagcacctccggcttatttggcaacttgagggaaggggattgagagtttacacgagggaattgatggtgagattaagatgggaatttgatttttcatcctagtctcttgtttggtagaggtggtagaaattgatagggagtttagttgaagattagatcattaatgaaaacggatggctgagatttgtttaggcgaagtaaaggaggaattccctcccaattacctgcccctactcaggtattgaaaaggagggagtttattcctcaattacccatccccatcccaccaaaattcacatgtcccccaaccaaacaaaacagttaatagcctcatccctctaaactcccaatccctcctaaaaactccctccaaccaaatagaccgcccgatcatgacccccacggccccaccccatcacccaaaaccaccgtctacgtacaaaacagaactagttttgagaaatggcaagtactggtaggttttagctggttttgcacccgagacaaaaattagatgaacacaagaattgagacatggaaataaccgcttttttcccttatattctaagattaggcatgtcgatacaatttgtaactaagcctctatactaatcttgaaagctgtagtagtgtatgacaattcattacttgcaatgcaataagacaaccttcactacattttcctacctttccttattcctcttgaaaattttgcagtgcgttcctcttgaaaattagcactcaacaaatgaaactatcaatccaaaaattccaaacctctgttcttcgatcatgtgtaaccctaatcagttcagtttaatgtatttaaattaacatttggattacaaattgaacatttaaataccaaagacattgccaatgagacggtaaaccgctaggctaacgacataatctatgggtaactaaactgatacaggacatctcttccccacaattgaactccctcccgtttctgcatttgcagaacagtgctaagaactaagatacatatgtacagtggggccggttccatctcttttgtcaaggagatttcatggtaagcccgcacatgaacggagacattgaaggactcttcacggctcaaaaacgagaaaagaccagatcaaaattatatagcctggaaaacaatgcatgccatgagtcagatgaacataatacaaacagataaacgcaccaagcaactgaagctatgatttctgaagaaataaaataaactgtgtaccattaaatattgtcagcgattatccgagctccagtaacgaaatatattgccactctgccattatgagagtataagttgaaaattaccgcatcatcatgaaaggggaacattgggggaaaaaatatgcaaaggagattgcttaaaaggtttattatcgagaggtaccgcagctgaggctcggcaacagttctgaggtaaatgaggtggaaagctcctctgctcccagtcatctagggtgtttatcatgattgtgtcttccattcctcctccaacctgatatcacaaggatggttaacacaatcgccatgcagagttgctagaactcgaaacaaaaactggtattcttgacaggacacaacatgcagaacaaagtgttgggatcatgaagtagtggtgaaggtaaaagaaatatgacttctttaagagcacaacaaaatatgaaataccatacctccttcatggggaactggatggtccatcgagtgtctagggccaggagggtacttaaatctcctaggaggcattgaccacccagggcctggccctgttggaggattcgatggttgcctacaatgaaatggggtggacggaccatcaaaatggtctggaaatggggggcctgtataccattgacaacaaaggtttgttcaccataaaagtctaattgatgaaaaaacatgtgactgattgtatttcggcagaaatcctaatatagacacacaggcagttagtttaaaacaaccctcataaatatatgtagacagttaggcacaatacttcaacatacctggagggaagtgtgggggaaatcttcctctatcaacttca

SEQ ID NO: 40415 - DNA, 5257 bp, Oryza sativa
  unsure (1)..(5257): unsure at all n locations
ataagctgttgaatgtggggaccacatccacagaaatgatagtatgcgttcatgaaataatataagtagacctcccaccacctggatctactttagtatgcctatgttataatgcttaataaaaaaattctaatgcacatagcactgcctaattactagaacgagtatttgattagattagcgcatagatattccaaactgcatattaaattactaatgaacaggcatctgattagtcagatcatagctatcacaatagcagacaatcgaatgcctggggtatacaataagatcatggttccctcaagtgatcactgtgacaagaaatatctgacatacctacataaattatggtgaatcacataaaaaaaatgcaaatagaagacactaacactagatgctatttgtgctcgtgataagagaaggtaacatgatgcatgcagcaaaaagaacgcatcaagccatccataaaacaatgtaaatgcaatacagttaaattcaaataaatactcacatctgtttagttccataaaagtagaccagcagcttctttttagctgaagaaaggccccatttctctggctcacttatctgtaacagtgtggatattcatgaattgaagtgctcatgattgaaacaactaacacatgctctgaagaaaccgcaaatccttgtaaacaaaccagacataggaatgctaaaaatagaaatggaaagcataaaagttatagagcagcttcatgctacagaccctagcttaatggcaaaagtcaaaagtgaaataccaccaaaaagaatagacgaattactctctgaaataagaatagttgaatgcaaggatatgattcataaagtatcatgtggagacaccatcacaaaagctaaaacaggggacaggtgttgtctaacagttttaggacttgctaacagcaagttcaccaattttacaccatggaactttctccgagaaaggaggtacatgaaaagtaacggttgcacaataaataagcaaacgcctcacaactgaagagcaggagaaactcaagttgttttctataaagcatggcacacaaacatcttgaagcaaaatttaggacaacagatgaacatcaggaattagcaacaggcaagaacgatatgttggacatactaatccaaactaataagtaggtaccctcagaattttaacgaggcccatcatgaaaaaacattacgcaaccaagcttagtcattgatcctcaaggagcctaatctagataaaaaaacgaacttatcataagtctcttgtccttctgtcccacagagagaagatcaatggcaccaactacacctaaccagccaggatgttcatgtacaaaccacaatgctgaatgaacttaatattcaatgcatcaattgatcaaagataagtgcaacttacagtagaaagtattcagagtttccaaatcctatggatgtatccatggagcacaagaaagccctacagaacttcagtaacccactacgataccgaaggctcaaaataccaggaagctaaactgtgttctgagaaactttaacacaaatgtcaacaactcaacaacagcgaaaggttattacacctcaaagcataatgatggcctagcgatcacacagttgtttctaaactatgttgtcatcaacgcagacaggaacatcataagtcgctggcataactcacacatgcataaccattacaaggatgcaactgttgaggagtataatttatggagacatcccaatatggaatccagagctatatatacacacaggttatggaagcaatcaaaagatatctggtattacagttaagggatatgaatcgatttggatccatatttcatatttgagggagccaaactggatccatatctgaatgaggctcgcaccacattcgggcgtgatacaagtggaagacatttgtatctgcgccaaggcccactaccaacatttccttcttctgagctaacagcttaagttccttgcacatataccatgtgatgtacaggcaagggagtaagataaggagtacaagaggcaggaattcataaggagagagtagtgaatgactagaattaaacaagagattatatttatttaggtatagttttttttatatttcacaccacagtatcagtaccaatgaccagagctaaggtgcccgaatctgacccagtccaaaagtctatggagccccaatagcataaagggtgaatctaaactgcattaatgattgacttacatgacaaacacatgaaattgcagtaagaaatcataatatgagcacgggattatcgcgaacttaagaaaagatcaaacatatttacatcacgagctacctatcaccaaactcatcgtacccagaaccctaaacacgctcctcactaagagccacagattaaaattgggggagctaaatcagatcaagcaggcacctaaacctcagttttttttagcacgaatcaacgaggtgtggtaagttcactcacagcataaatctccgaatccgaaattacataaagccattacagagagccctagatcagagaccaagcaatcagtcccactcaccatggccggccacgccgggaagcccttcatcttggcgagcacgaggtcgcccaccttccactgcgccgcagcggccgccgcggccgctgccgcggccgccccgcgcttcttccgagccggcggcatcgccgacgcccccaccaccggcggtcggagggcgcccccctgctgcggctagcgcccgaggcggcagagccgccgcacgacggggtttgcggcgcgggtaggggcgcgtacgggctccgaggtggctgcgtcggcggcggtggcgggggcggcggaggagggaggcatcgagcgccggagcggcggatggggacaggagggaggcggcttaggcttcgagatttttctcttttaattcggttttcttgtcctttttcttttcttttccatttcggtgcattttgatcagaagaggagtagtaggaggactgtaggagagggttgtttgggctaactggggttaatatgggcctacttgggcttagtgcgaaagagtggttaccgctaatgacaacgccaattattgattcgttattgaaaaaaccggtgaaattcagattaatttctctatctattagtactttactaatttctcttcctctagttatgtaaacctagcccgttgcacagcacggacatattagcagttgtcaaaatgtcagtttgaacttttattttttcttttacatagccagtttactaagcagtttttccatatgaatcagcttaataacgccgataaccacaattatttcacggttatcatcgcattttgaaaccttgacttcatcgtaccaatccctccggaaattaaactgtacgggcctcgcaaatgtacagatggtcagatactcagatgcaatgctgttatcaagtttggatccaaacttcagtccttttccattacatcaacctatcatacacacacaacttttcagtcacatcatctccaatttcaaccaaaatccaaactttgcgctgaactaaacataacctaagaaagcaaatcttttgcgaaataaatgcagtgacgttagatcaaaggacagataacaaattgaaagaatcaactcctgacaatttgacatcactttgttcacgcaaagcgtccagtggtctttaaaacatgcagggaaagaaaagctttttttaccaggggcaaaagggcaccaccacaaactgtggtaatgcatgcaactagcttgtcctaagaaaaaaaacatcacacgttgttaagcagggtttacttcctaaaatcagtaaatgtcacattctcggaccaccgttgccatgcactacaaactgattacagatgataagcaagagaaccaatgaaaaaaacagtaaaaggccgcgaggggtaattcgatggtgtcttgtaacttctgtgtcctcagagaatgtgacattgacaacactaccgggaattcacaaaatgcacatgtcgttgcatggaaggctcaaactttgtcagaggcatcctgtgatgtgccctcagaacttttgaccgcagccagcttctcagctaatctttgctccagtgccctttgacccctttctctacagtgagataaacaacagtcaagtgagatctaggatacaaggacagcatacacgcagaaaacataacaccaaatagagccactaattattgccacagaagactgaacactaagaacatccagtcgagtgcagttgatgtcctgactcaatttcttttacattttgttgttggctgtgtgcaccatgtccaaaggctggaaatttaacaagtatccaatatctaaaaaagcatccaattgccaattccactttggttctaatgtttaatgacatcagaaagtgcatccatggagtataagcaatccttatgaaggatacattatggggaaacacaaatataaaattgattgatattattccagggatacaaattaacaaatcaaatggcagataaaggtaccaaaggctcaaatattgattattcattagatggcacaagtgtggatgaaattatgctctaatcaagacagagagagagtgagaaagaaaaccaaccttcttctgttcgcctcaatagaatctgaaccaggcaaaggtgtggtatccaatgtctgacctctagcatcagccctttcagatcttccacaaagaagcctgtggaatattgaagctatcggatccagcacaggtctgcatgttcaattaattggtcaggatattcttccaaactacaaatcaatcaaagttatataaagagggagatttggactaccttagaaattcagggaagaaacttgagaaagagaactcttcgcttgggtctcctttcaagcctgtctctaatctcctttggaagtaccgcaggtaaatccaactcatataaatgccaaacaatataactgggaggtaagagaccagctcctttacgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40416 - DNA, 1098 bp, Oryza sativa
caaagaggaccttgctattttctaattactgaaagggcaaggccactcgggatcaacacatcaacatctctgaactggtctacttgtctctgcaggtaggaggaagctagctcgtaaaaataccacaacaggccctatatatctgtgctctccacttgtggcgagagagcaaaactgcaagtacttctatagttccttgcacctaatgatatgagtttatatttctgaacagaggatcaaatgataaatggggactgctaagaaaagtgcaatctttgttgcactgctgtgcactcacattcttgtgaaccatgcatgtgacagtggtaagaattctgtttatccttcttttgcatttttcctcagctagtctattgttttgttgtttagtttatcttatgatatgtgatttgttgaccatccatgtgacaatggcacagatttttgctctcccgaggactacaacagaacaactttgtccctcaaacttatttttttcttatttttttatagtttttcagcttgtggcgaccttttctttactcggactagagatgcatttacccctttacctctcagttcttcctttgattctttaataactacaattttgatatttatattgaatggaagaaagtcaagataaaaaagtcacaaaatctcataaaaatggaaaaacaattcaaattcctcagtcataccaaatattataatcattgtagaatatcagatatcaaactggatgatccaaagataataaaactcagtggaaactggatggatcattgttacgagtaattttcctgaaacaccttatttctgatatctcatatctgatctgtattgcctttacctgaagcagatgtggtatttgggtacagtgggagtactggtccagagcattgggggagcttaagtcctaatttcacaacgtgctcaaaagggacgtaccagtccccaatcaacattttgaaagatgacgcagtttacaacccaaagttggagccccttgaaatggattatactgctgcaaacactaccattgttgacaatgtcttcaatattgcggtttgatctaaaacagatggttatttgtgt

SEQ ID NO: 40417 - DNA, 891 bp, Oryza sativa
ccgtcctcctgccaccgtggcgcacgcgaaccgacgtggcaggaggagggcggcgctagcatggcgccgccccagggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcactttcactaaaattagaccataactcttttaataaaaccctttgatcaaaacataatgcactctaccactatatgaaattacttaatctaattcaaaatataaccacatgaaatgacatatataagttaaacagtacatagagatgcaatttttttatttttatttcattttttgatatttttttcacacttaggagaacataggaaccaaccgtataaaaaataaactcaaacggataaaatatgtgacatgtagaattttccaaaactctaccaaaatggacaaaatatgtcatctattaaaataggcataactttctcatacggactcagaatcaggcaaataatatatgcacggacatctacagaaaaagttacatccgattctccccggcctcgccgggttcggcgatactaaaacctccaaattccgcttgcaagattgtgttttcgaggagagaagtttttcggtggagctttggaaaattccatatgccacatatttcgtccgtttgagtttattttttacatggtcggttcctgtgagttcctaagtgtgaaaaaaatatcaaaaaaataaaataaaaattaaaaagttgcacatctctct

SEQ ID NO: 40418 - DNA, 708 bp, Oryza sativa
caagctacatattatacaagaggcaaactatgtaagaaaccacaatggcttttctttacaccttgctgattgctaacctggcattgctctacatatcagggcctgtttggttcgcgaaaagaaaatttttgggtgtcacatcggatgtttgaccggatgttggaagggctttttagacacgaatgaaaaaactaattttataactcgccgggaaaccgcgagacgaattttttgagcctaattaatccgttattagcacatgtgggttactgtagcacttatggctgatcatgggctaattagactcaaaagattcatctcgcgatttcctccctaactgtgcaattagtttttttttatttatctatatttgatgcttcatgtatgtgtttaaagattcgatgtgatgttttttggaaaaaattttggggaactaaacagggccttatacacttattcctaccccatttttctcctcccctcctttctactgaggtggaaaatgtttggcacacggagccaatgtcatattagtagctaaaatagaataaaatgctgccgtcacaattgatgtgacaaaagctaccactaaaggtagtcatagggtgaaacttgtccggtttttaaatgtttggggtgaaaaataacttttttaaaggttagggtgaaaattggattaaagtgaaagtttgagacccaaaataaact

SEQ ID NO: 40419 - DNA, 2526 bp, Oryza sativa
cgtgcaccccgggctccccctcacccccgcctgcccaccgcctccgcctccgcctcctcctatcatgggccaacgcacctccgccgcctgcggccactgcgcgccgccgccgccgccgccggaggagcctcgccggtaacgccctcccccccgaaccgaggaacacccctcctcgcccccgtaaacttcgttcccttccagctgctgaccgagagtggcccccctctcgctcctccaggatggcgctgatggggccaagcgccccgcgcccgcggcggcgtcttcctcgctgggagccgcgctggtcggcttcgcgcgtagcaacttcctcccgctaggtgagttttctgcttctacgcgatctcagctagctcgtgcattgctgctgctgttgggtggacttgtgtgtgggacgcagtgtgccttacaggtagatgtagagttgcgaaatttcacggcctaacatggaacaattgaaattccaattctcataaattgtaatgcaataggagtattacctccagctagtttacttgttaatgaccctgatatttcattagacaagagaaatgctagggtagacgggtccagttaccaaattcaacaagtttctgtgaacccaattatgcactagttagttcctctgcacgtgctttttagttgctctatgttgcaaacttgcaatggagatgataccgtagatgtgtctgtgcatccctcagacaagctcaagtacatattttcttagcttgtgtgtttcttatgttaagctctaattgctgggattgctctggccctcatggatcctacactcggatgccttgctcacaaatattcactgtcaaagtacagcaccttcgggatattccttatctcaggttagtgttttaacccaattcatatatttgtggtgctatgacctcacactaatgacgtcctcttgcataggactgactctgcgaaccaaggaacttggtgcagcactagaagcttggcctgcagggctttttggacttgtatgatccagtttttgttccattacaattgtacctgtatgatctagtactattctgatctgtaaatgtatctatgctgagaatagttcttgcttgctgcattgtgatccagccatccaggatagggttgcatatcacattcatgctactgattattcaatttactttctagcatttaattatttagctgaggtcacatgctgcctgtctgatttttgttagagattcaagttcttatgttgttatcgagtgcctaaatatgtttgcttaaatatttattggtacatattttcattcttttgcaggcctcaatcttgctgtttacaccctttttggctcagtttattatgcaaattaagttcttccctcatgaatttatcactggtatgttggctctcattgtgttccccatttccctgttcctattatattatttattgttgcaatgtagtaactcatgccttcatgttatttatagcttgtttgctttgatattgacaacacatctcacagggttggctatgttttgttgcatgccaacaacattatcaagtggagtcaccttaactcaggtactaacttttcctagatttctattcactaatagcttataatgtgcatattttctcatatagccaggcattcaaatttaatcaagttctatcactgctatgcagcttgttggtggtaacactgctcttgctctcgcaatgacggctatatcaaacttactgggcattatgattgtaagcaaagctttgttgctagtttgtcttctgaaccacttaccagcattacttataactaacaacttataaacacattatcgaactaccgacttaattttgttgattcattgcaacacaatgttttgtttgatgccattaaaagtaatatatattttttagtattgaaaataacattagagaagcaagttatttttctcctgagctgaactgattatgggaggaaaatattattttagataaaaatagaaattatcttgatcagagatggttacttgattgcaatccatcatccctgtagaaccttgaagatatctataacattgcctgggccgtaggctaaaatccagcattgactatgaaacaaattatctttgagacttccaagtagcattgaacctcctaattctggcattaatcttcgtatgtattttcagataatgagcattgagcaatcaacttattgtttttagataataatcaaggatgactttttccctgttttccaaaagccaaaactcctatttctttgtaaaatatgttcatatttatttgtgaccatggaattaggtacctctttctcttgcaaagtacattggtgttggagctggggtgtctttgcccacagagaaactatttaaaagtctggttacaacccttcttatccccattattttaggaaaggtatgttgcttttcttatcttgcaaaagatagctaatatgaatgcataattatgtgcctgtcttctttctggattttata

SEQ ID NO: 40420 - DNA, 5871 bp, Oryza sativa
gaaatccatcacgaagtctgctaatggaaaggttactacacgtataggactgggtcgttactatatcgtgcagggtccggtgtctccgagtcctacttggagaccgtttgacctgcgttataaaagggaccccccgagggaacttaagggatcgaatcttagagcctacacaacgaccatagcctacgaagtcggagactacaggagccaagtcgccgggtgatctagtcgaatcaacttgactacggtctcatcggtaccgccgagttctactactccctttgtaatctgtggttctttccatataatcccatatcaactggattagggctattacccgctaaggggcctgaaccagtataatctttgtctcttgtttccttgatgtcgtattacgtagatcctcgtaccaacgtaccccaataccctctatatccggtctacgggtactcaccgtcgatagtggcgcgccaggtaggggcacttggtgctcaaggttctactactatgacatcgagcttcgtcgacaatagagtcaacaccggccccatccaaggaatccctgcttcaacaatgctggtgtggactcaagtcgatgaaatcgtcttcccggtttacaccacggtgccaatctcggctggtccatcaataaccggaaatgagaacgccgtggctataaacccggacggtcccatgtcgaaggatcctcctgccagggcggagaacgaaacatcaacgtcatacgagcccgagaagattcctagcacagccgagccttgtccttccgacaaggactgcgagccgacgaggacaacttccgaggtcaccaagtcctggtgtcctatccacaagtccaggaagcacaacttgcaagtttgctgggtttttctcaacgtacaagctgaaatctgtgcttgcaaagagcgtggaatcctgcgtacttctctaactcgtgatgtctattgtcctattcacaagacgaagaatcacgacttctcaagctgcaaggtctttctccgcgccatgaagacgacgcttcccaaggtccaacagtcaggaacctctctcgaggagacagacaaggaacaaggagcgacgttgacttcggatcgtttcgttggagtaatcgacatcgatcccccactactagaatagtgaatgtcaacgaccaaaaactaacgacggctgcataatcttggtcgttgatactgctttgggccgatttctggtatccgacgacgctagttttttgtggtcactaatgcgtagtgggctgcggtcgttgttgttatttactcaggttggatgggcaattgcaaatggtcgttattactcagcgacctgtgtcctcagctctccggccactgccgccgccgccgccctcggcttcggccaccgccttcgattcgctccacagctgcaagcctgcagctgctgcccatgctccctataactttgctctttgctgctctttgccacacaaaggaggtagcggaacagcgggaggaagaatccccatcattggcataggaaaagtctatcagatcccctccaatccactgctcccttccaattccgaaatcccctcttttccccaaagatatttcgccccaaatcaatatgaatcaacagtttttgattccaaatccgagatcccctctgctacccccacatatttcgccccaaatcagtataaatcatgaggttgagagatgagaggagtgttgattcaccgccatgtctcgcagccgcagtttatcaccggaggtgacaactaggggctgcatcgaatggcctacatggtctcctcagggctcccaaatgtcaatcctccccaccactgaacatcttaatgccaagctcctccatgagtacatctctccacctgatctgcccagccactctgttatttgttccagttcacttgggactcatcaatcgtcgaaaatagtcacaacaggtattctccaatctcctaatgtaaacatttgcatatgatttgtgaaacatattgaattatgtgctaggttaaatgttaaatcttgccaggttaaagtgttggttgtattgtcctcttcgaaactaataaaagctgcaaagtttgctaggtggatactgattatttctatgctgccctcaacctgaaatgtttgatatggtcctgacaatttatttttgtggtagctatggcactttcattagcattaggctgtgtttagttggatccaaagtttggattttggttgaaattggagatgatgtgactgaaaagttgtgtgtgtatgacatgttgatgtgatggaaaaggactgaagtttggatccaaattttggatctaaacacagccttagtaatagaggaatgtaggcaatttgtttgtttgtaggcaagaacagcaagtgttctagctttattcatagaatgaattcataattatattttataaacagaaacattaggtgtgacttctgtgcaattaacaattatagttacatgtgcattagttcttcctaatttgacatatattcttctcctagactgtttttcatgatggtactactagtttgttgattttaattgtaatttgaaataattatagtatcagcagtgctttacttaaatggtgtacatctcttgttttcacctctgctataatgctagcaatacaagttatttctatttacttaaaattgagttctgcatccagctaactctatacatacttcaattgaagggtctgaagaccatagcttctccttggattcagttgggtccaaagaccatagctactcctttgtttcagttgttgaggacactatgggtgatgctgtcgaggacaagatgtaccaagttgtaaaggaagatgaaccaaaggaattacttagagactccaaggttaatttgatggcaaatgttgttgaagacaccatgaaagagaaagagattaatgaagatgaccatatgggttggtactccttagctttagttgttgaggacaccatggatcagcaagtgggagcagacatcatggaccagcaggttgtagaagactccttggtaacatacaccatggaagagagtgatgaagatgaatacttgaaggcagaatatgaaaagggtgcattaatcttcgctagagatgaggcaaatgccttggaaagaaaagaagctgaagctcgttatgaaaaatcacttgaagagattagagatgaatttttgaaaatttatgtccctttgtattttactctaagaaaaaagtaaattcagttagatagataatatataaattcgatcagcatccagttcatggccagttatttgttagcaaagaataactcatgcatctgtaactctgctatcactttagtatcttcaatgaagactatatattgtcttattgtggggtctgacttgattgatctatgttcactatgtgcattcttgtttcagtttatagtatcattctctgcagcagtaagatagtactttgctggacaatatacagtctgaaagtttcacttcaactggaactttaagttatgctagacaccacagggactgggactctgccaatgatttgtttgttctatcccttttaaactttgtatccattgtacagtgcaatatgatttgttcaacaaagttgtaaagtattcaagtacaggtctagatgaagggtgctcgatttgttcaaggaagttgtacatgatttaagtgcagcctgtacactgctatgtgtatttcaagggtatgctaatgctgtaagcctgtaaatctgtaagcataacatcgaaatatttttgtacatgagctatgctttacagctcagaaaatgcatcttaccttttttttctgctctaaacatgatgtgttcgattttctggtcatccttttatttcagttagtatatgtataaagtagcaatacaataaaataaacatcaaactagcttttcccagttggatattgtgttgtaccttaagttagaaaggtgctggtgctgggttcgagtcccctgaacaaaagtttttctaatgattttactttcttttccatacgtttttttttaaaatacatctactatatgttccaaaatcatgctatgtgaacaagatattttttattaattacaatgttaacaccaaatttagtatagtttatggatttgtcgctatcctgcgtatctttgttcttgggttaagaggtttagacaaccaatccaacactgtcgtctagttataaaagtgtactctttcgtataaggtcataaccgatccaacaccatcgggtgtatattcggcatagttcatcaaggcattaggcgttagaggatcgaccgttcaaactagtaattatagtagaagaaaacaaccattatatttctttcaaaaaagacaataaaatatatgccgtgaaatatattgtactaaaatagtgtatattgtaaatgaattttaaggtaaaagagaacagagaaaatgtattgtccgattatgacaaaaatgagtatagttacaaagtttactccttcgtacaaggtcataaccgatccaacgccatcgggtatatcggcatagttcaagaagccattaggtgttagaggattgactgttccaacaagattattacaatagaagaagacaaccattatatattgcataaaactttgaataaacacaataaaatatattgtactaaaataatatatattgtaaatgaattttgagttaaaaagaacagagaaaatgtgttgtgagattatgaaaaaaatgagtctaaaaaaattattagtacagtttcacatcagggacattaaagaaaataagttgtggctttttaaaaaaatttcagatgcatggaaaaaattatggcgggtgattacataccttttttatttttttttggcgctcaaaggaggagttttaggcatatgtccatgtacatatctcctcctccattcataatagacccaatatcttctcccctctcacatcccctccctcaccagattgagagaaccacagatggagcgctaatcattggtgccgatcggctgatcctctacttctccagtgcggcaccgtgccgcgcggcctcatcgcgctactgatccggtggttcccgtccgagtgcttcttcaatcaaaccctagaaagttctactacaggtcactacttctccctttgcattgaaatcatgtcgtttctaatctggtgcctgtcctctatccttaatcaatccatgatgtttggattctatccttaatcaatctgttgcatgtccgcatttgttagacatttctgaattgttgttttttgaatcaaacatattttatagcgctgggctgtcacttttttttgtgtatgaattatttcatctatagtcaactaaaaacagaatgcagtgcaattaatcatattgccaaataataatttatatgatatctatctagtcttgacattttacctaacagtgtattgtaactcttctttgacattaattatatatacagggttatataaaacttaatatcaactagcaattagaggggatggctccaagcaaggcatggatgggccttgtggatgatcggctaaatcacgagtacttagagggtgtagagaagttcatagattatgcattcagtaaattagatggtgtccaggttatacgttgcccatgcatcaagtgctgcaatacatattctttgcctcgtcacatagtgtcttctcacctgaaagcgtatggaatactgaggagctacacattttggtaccatcatggtgaagtcttagcagaacaagagaatgacatagaagttgatgagtatgattcacaggaatttaatggggaaggatataatggaatgca

SEQ ID NO: 40421 - DNA, 1721 bp, Oryza sativa
gtactttcctataaaacctagattgcagaggttatttatgtgtaggaaaacggccgcatatgctaagtggcacaaagagtgtagggttgatgatggagttatgcgacatcctgctgattcaaaagcatggaaggagtttgataaaatccattcatcatttgcatctgaacctcggaatgtgaggctttgtcttgctagcgataggtttcagccgtttgctaacatgcgaacctcctattccatctggcctgtattccttgttcctcttaatttgcctccttggatgtgcatgaagcaacaaaatgtaatgttgtcaatgctactaccaggacctgatggtcctggggatgcaatcgatgtttatctgcaaccattgatagaggaactgatagaactttgggaagatggagttgacacatatgattcatcaaccaagacaaatttcaagctacgtgcacagctcttctttggacagtgcatgacttccctgcttatggaaatatatcaggccatagcacaaagggaaagttggcatgtccagtttgtcataaagaaacaaattcaatgtggcttaagaaaggtcggaagttttgctacatgggtcatcggcgctttcttcgcagaagccacagatggagaaatgacagaacttcttttgatggtacaaaagagagccgagaaccaccaaaggagttatccggagatgatgtgctcaagcaagtgcaggatttacagggaattatattgtcaaaggatatgagtaagaagacaaaagtatcacgcagtgataggggagataactggaagaaaaggagcattttttttgagttaccatattttaaaactctattgctacgtcataatcttgatgtgatgcatatagaaaaaaatatatgtgatagcattattggaacactaatgaatgtcaaagggaagaccaaggacaatattaatacccgtagtgacttaaaactcatgaacctgaggccagacttgcatccagtagatgatggaggaaaggtggttttgccacctacgccttacacgttatctccagaccaaaaaaaaaagcactgcttagtttttttaaagaattgaaagttcctgatggattttcttcaaatataagtcgttgcgttaatatgaaagagcggaaaatgtcaggattgaagagccatgactgtcatgttattttaaatcgtatactccctcttgctctgcgtggactgctccctgaaaatatttatgaaccacttgtggagctatcccagttctttaagaaattaaattcgaaggcattgtcagttgaacagcttgaagaaatggatgctcaaataccaataattctttgtaagcttgaaaaggaatttccaccatccttctttgatgtcatgatgcatttgcctgttcatttggctagagaagctctaattggtggaccaaccatctatcgatggatgtatttatttgagagacaaattcactgcctaaaatcactagttcagaatatggctcgcccagagggttcaattgctgagggatacattgcagatgagtttatgacattaagctctaggtacttggatgatgtcgagacaaaacacaatcgtccaggaagaatacatgacacatctattggtaacaaatctaatttatcaatcttctcctgtgctggaaggcccattggttctcgtaaaactcgagatcttgatatgcttgaa

SEQ ID NO: 40422 - DNA, 1547 bp, Oryza sativa
cgtcagagcagtggataaggaagaactagtgttgagcggcattgcagttagaggaaaaatgaaattgactggctaggaggcgacagagattggggagaaaacatgcatggtaggagaaattggaggtagaagaaacactattagccatttttttttactcaaagaccgtgggggaagcccccacggttaaattatattaaagaagaaaaataagaagtacacaaaaaaacaaaagaagaaagctaagattacagattgtcaatccatgattgaaccgtgggtctataaacttctttgaacctaattaaatgtaggctcaaatcctccttcaaacccttcatccaattgtgaactgatggctgaataccttgaaaaataaggccatttctttcattccatatattctaggttgccagtagaaatagttccataaaactatgctgagaaaagaaatttctttgaacctgcaacatttgatggaattctaatgaagagttccaaacctagcccaactttctccaacatgacttgctgaactcacattgaaagaagagatgttcccttgtttctcttgcattaaccccacacgtcaagcaataagcagtggcattcaaaggaatacaatgtttcctgtcaagaagctccttggtattcactctatccatcaacagcagccacccaaagactttgattttcatgttgagcttactttgccagatccaattaaatgaacaagggggagataaggaccaaaaggagagcttataaaatcgttgatgagcatttaagtataatcgtgtaagttctacaactaataccgtacaattccacaattgttggtcaaagccttccactatcctcatccacataactatgaagaaaatataaaatcatttttgataaaatggattgtcatctcacctatcacattagaaatgccagatggcagggaaggaatatgggaattgcggatcacacgacactggccaaatcagtactctcttcataaccaatgtatccccttacgacacttaaaggccaccaagaaatccatagaagtgcttgacaaatagagaaagcgttttctatgagcaggacagaaaacatatcagaaaaaatatgcaaggttaattaaatgagaacgtgtctaccaactacacacggtggactaggggtgttaaacctggagaaatttgcaaggatgttataagtgatcaggaggctatggcatgaatgaatgcacagacatgggttgaattggacaccgcatgtgaaggtcctgatatacttctatccgcagcagccacaacaataataatagaagatggggccattgccaacttgtaagatttagcttggatgcatggcacgtgtccaaaggatgttgcaccaagagtatatgcattcttcagaagaaaaaaatagagccttgaagtaggccagtaaacacaacacatagatacaagatctcaacctcttacctaatgggggtatgaccattgtgctcttggactaattgatcaccttatgaagcacaataaaagaag

SEQ ID NO: 40423 - DNA, 7924 bp, Oryza sativa
agcatagctttgacagtccatgagtggtggaaggcgttagctgctaacacgggtctaccaaagaaaaggtgtttgcatcatcattttacttacaacacgtgaaatctgaaaggggagaaactaaagagtatcccaacataagaaatgtttagcaatagcgcgacgaagatcgaggatgccaaaatctatgccctaccaagtaaaaatgattctttgatcttgtcctcttaaatttatttttttttctcgtacatttctttttgttaattgtgcaggtcagtttacaatggctacatttaatgaaattggcaaactatagaaaccggtttattaaagaaaacattattcaaggtttacaccctaccggatgaataatttactactctctccgtttcagattgtaaaactttctagcatttcttatattcatttagaagttaatgaatctagacacatatacatctatatgaatgtggacaaaagtcttacattgtgaaatgtagcaagtagtatttatcatcctcctaaaatacacaagcccaaattcccaaaatgcacgtggccgtaacaccatttaccacccacgtgctcctacaagaatcgcatggagccatggacctactgtctactggcttggtttcatccagaaccatgggctcttggcagacaacccggccttctcacagtgttttgattggtacacctgggtacgagcccctgtgctgagctgacgatgaactgtttcgcgtgtcgctgtactgggagtattgggtgggtcagtgggtgggtgtgaggaatggacaactggacaggcgatgcggactgaccggtccgtggcccgtgggggcgcgggtgccgcgacatggacgcgtcggtgccctgtttccagtgaccctgtaggaggagaaaaagaagggctcgccgctgcccgctgtaccacgatcgcgtatcgacacatgggcttgcactgcattgcacacacatgatcatccccgtcacctccagcttgtaccggccgtgtatgtggctgccattgccatatcctcatcacatccagctggtgcctgccctgccctgccagaccctttttctgtgccatggaattctgttcgtgaacacaacagtgaatcaccaagatcgagaccgaggcggacgaggccgcgcaggcacaaatgacaagccgcctctgctccaggagagcacggcgccggcgcgcacaggggcaggacacggcgagggcccggcgcgcgggggtcgacacgtccgcgccgcgggggagagcagagggcgtcaaatccgtgtgtgagtgcgcgcgcgccgtagcggcgcttgtctgtcgtctgtctcggcgatcggtcggtctctcgcggcgcgccggcatgcaacgtcttttctacgacctgtggggtttttggtacgcgcgacgcgctatcatcgccatgtgcgggtacatgtgccgcctggactgggaggcgaccggccggcctggccggcacagtgcggtgtacgcttggcataatggaacgtatagtggtagctgccgtctttggctaagctcgtaagagtgctgtttggccacgactctctctttagtttctctgtcacttaatttagttgattttttttaaaactcatatattttgttgattatagatataactaggtacatatcacacatgagttatttacctgtaaatataagtaattttttaaaaaaaaccctcgaagatagtcaaattaacataaactcctaaaattcgctaggaagagcttgtaagaaactagaaaaaaactgtgatgacggtgatccaccaaaagaaacacacgacttgctaggaagtgatcattctcttctttaccacgttgcaagttagatccacgctgatgacggtgacaaagaaacaaaaagtggttgtagatgaaaatgttaggaagcatacccaaaagagacctccgcttggaggttgaggcttatatggcaaaacgatgaaaactcagcttctcccttaagatccaccactggtggcgaaggaggcttgcattcttatggttgcctcacctaagatgaatatgacggccggtggaatctcctaagaagaagcaaacctatcttacttctaagggagcgtccatggtaaagccagagaccattccatggatgaatttgactggaatcaatagaaagccatgggaataaaaaaaagcgatgttgatgaactcttgcactacataaaagcaccaaaagaaaagcgaaaaaatcctactacctaatccccttcccttcgctggcaaccaaagccgttggaatcgatggaggaaaagggtcgggcaaagaggaacgaaggagcccattttagggcccctttgaattggaggaaaaaaatataaattttggaggatttcaatcctatagtaaaatttcaagcctttgaaacaaatgattgaatcatatccaatcctttggaattcctatagaatggacaatcctataaagattttggaggaaatttagcaaaagcttcaacctcttggtaactttcctttgagtctatctctctcatccaattcctgtgttttttctgcggttcaatcaaacggtcattcttgtgtttttcctgtgttttgcaatcatctgttttacacttacattcatgtctaaattctacatttttcctattcctacgctttcttaatcctgcgaatcaaggagcccttagactgtgctttgctagcttgcttctggttggtccaagtcaggtgctctccaggcaacccaccatatataaccggatactctatccgatcataaatatttaatttttatgacaaatataaacttctaaaagtttgaccacttatttctataagcatctaaattgattatttgtgggtcaaccagaaattgtttcttttttatggaaggtgtaaatttataaaatgtaaaaagcctataataatgttacgatagtacttttcaggttaatccatatgttctttttttaaagttctaacggtttaataaaattttattctaaacgtcggcaattgcttatgaacagagggggcatacagttacatgaagatactggttgtcgaaaaagtacacccgagcaggtactttatgtacatcatagctacgtgtacacgtacttgaacttgcggatacccggacatgtacatgtatatatgtaaggccagtagcagtgcaaggcacgcttgacgtgcctccagcccatttaagcaaggattttggcccaaaattcatctctaggttacgcaccccataccacagtgctggtgacccaatcttgtgaccccacgccttaaaaaaatctcgtgaccttcctcatccttatccccacgacgaaggaggcggcgcggtagcctcgagatggcgacgcagcggcccacgcgacggcggcggcggctcggctgacgacggtaacctcggcagttgcctcgtcgtcctccgcggatctggagcagtggtgcggcgtcctcaggctcgtctccggccggcacgacgtccacggctatcttgagcggcgcgacgtcctcggactcgtctccggccagcatggtggcctcggcggcagaggtcctcgaggcggcggcttcctcgaggccgagcggcggcggcggcgtccttggcactccctccgccgacggcagaagcagcagcaacaacaacagcctccctgagcccacgcggcggcggcggctcggccaacgacggcaacctcggcggtggcctcctcctcacttcaagatcgcgttgatctttctcgtcaccgccgtcgcatttctcttcatcccgtcctctagcttctccccttcctcaccggagccggataggattgaggattccagcacgggagcaagatgccgagcgagggaacgacctccacaacgcaaggaacggcagcacgcgccctcgttttcgacgagataacttgtcgcccagatagggggcgagcaaccaaacagagctccatgctctagtgttacgcacgcacaaatccgagctggcgacgcgaggttccgcgccacgtcccgcactgtgagaggcctaagtacattgttgctggctacagtgaatttgatccgaaaggtttgtgtgtcctgataggttgcaggacatccacaattagacgatgacgacatcaaaagcatgatgtttgaaacagagcccattaattctgtcatattttcagtatatgtactaaaagcacagagtcatgaaatttatatattttgccgatttcaaattacatttttggtttcagaattccagtttcaaaatgggaaactgggttccaacttttacttctggatgatttcatttcacccaaaaccgttttatctccattttaagggaccccaaattaaaacctactacgacctcctcctgttttaatagacgacaccattattttgagatatgcatttgatcattcgttttataaaaaatacataattattattttaatatgttgtaacttggtttcagatactttaagcatgacttatattcttacatatttgcagcaaaattttaaaaagacaatgattaaaagatcggacggagtgtttttgttggtttatcggtcgtacaatataatttgggactctaaaatccatgatctagtacacgaagttctggaattgagctctactaatatacaatatacaagcttgtttgaaagtgtgtggacaagacggggacgtaggggtgaactattgacaagaacccagcaaccagctagcggagcccggccacttcggtggtgtttgaatctccttacataaagataaagatgaagattaagttttttaagcaaaacgatgtggtattaacgtatgattgtttgagttttaattattacaaacttgaaaaatagattaatatgatattttagagcaacttttatatataaagttttcgcacgaaacgtaccatttaacagtttgaaaagcgtgccacgaaaatcttaatcttcatctaacttttgttgatgaaaagaacgggccgaatcttcccttttcttgcaggtaaccagctgattttaattttgctacagtttttgtagccatatctagctcttcgtattactcgagagaacaaaaatgtcttcacacattgatacatacagagaatatttgatcaagatctactccccaattcattttttactccatcttcatgatgtccaattattatctactttctccgagttgataatacttatcgttttgaataaggacacgatctctaaaaaaaaaagttttgaccattattttttattataatatgtataaaagtgttaacaaatacatgattttattaatgtattttttaagactaatctatacatatagtcaccatatttgaaagacaaatattttaaaaataatttataatcaaagattctaaagtttgaccttatacctttgtctaaaacgacaagtattatccgctcgaaggaagtatactactcatccacaggaaaaaaaaagagagccaaaccatcgatattaaaacgatcgaaatgacagggaaaaggaggtcaagaatctacgctgcctctgaatgtttccagctccatacatttacacaccagcttaccgttgaagctcacagccgatacgttcggcgagaacaatgccggcctaatcgcccaagattattagatacatgcatcatgcatgcatacatatataaacagatatatatatatccatgtcatgtcaccaaaaagtgagataaagggatacagaaaaagtgacaccgatcggattacaaaaacaagtggcaagaagtagtgatcacaggatcaaacaaagtacactgcaagcaccagcgaattgaatcgaagaacagcagttgaatagtaggtaggcatatatgcaggggggatgctaggactctcctgccatggatggccattgcttcaactagtgtagctagctagagatctctcactgctgctagtcaaccatagcttgcacattgcgattgcgattgctcactcacaatcctatgatcaccttgattaattcacaaatcaactaggataatctgataatgtgcatgcaaacaagcacgaactggtagtctgtaggcctgccctgtagctacgagctagctagctcacacacacgagcaaagctagctagctgcagctaatcacagtgtgccttatttgacagtgaaattaatgtaggggaaataggaaaactaatagaaaatgccagtagaagtagtagtaattaattaagctcgattatattgttttgtccatgcaagatcggtcgtcgcggtgtcagggtcgtcgtcgtcgtcgccgtcgtcggtagccattagcggcggcgagcggcggtctcgcgctgcgcgttgaagtagacggcggcgacggggaggccgaggtcgttgtcctcggcgaactggcgggtgctgaagcggtccctcgacggcggcgggctcaccgcctgccggcgcttctgccggaacagcaccaggatgaacctgtggatgccgatgtttggccgcgggctctcgtagctcaccacctccctccctgcatcaccattgatcacacacaaaattaattatagagagatcagagaaagctataacctagataagacaaataaatattgttttgattaattagtacatattttttttaaaaaaaaaatagttactacattaccagtttaccacaaattaattgaccttgtattgtggctaattgttcactctggatctctctgatcagtcaattctcatcaaggttcaaaactggcaaagactaaagcaggatgtacaggggaaaggcttaccaaaagaggcatcagtagtcccaggaatatcagtaacaatcctgcagcaaggtggtccaatcaaaaggtcacctgattagctacacatactctatagaatgcattgattgaaaattaatctggaaaaacaatgattaacagcatgcatgacagaatctttgcaagcaatcaatcatggcgtgaccagtgaccacctatacaaatttgtctggctatgtaggtgacacttgtacctaataatgtctaatcaacttgaataagaccgagcaatattaacttgtacaggtagtagtataaattaccagtgaagatgctccctcaggtatggatcactaggccctggcacatcagggtcagtcatcacctgaattaagcacacaagtacaaaggatcaattagcacataatggacacatacatattacagtatagatgtgcgatagtctgatgaatccagcagcagatgagacaggcatacgcaccaatgtgaagaaggacctgaggtcgccgccctggacctcgacgcgcggcttgccggcgacggcggaggggaagaactcgtggccgttgaacacctgcttgttggcgccgtaggtggccgtcatcttcaccgtggggttgaagttgtccagcacctcgccgatcaccttccccacaatgagaggctccagcaccctcgacatggccgtatatctatctcaagattatctcacctgaattgattcgatggtcagtggctgaactagtgaactaataactgatgagctgctaagtgtagtatacactcttgtactgctctctcagctctctctctgaatatatgatgtggctaggtgcaggcaattcagttcaggatggtgaagagagcaaggcgcaggggcgatatttatagatgccaagaggcgagaagagcctatctgttcttgtcctgtcctggctggctatattctgatcgtgcaagctgagtgtgatggatcatagattacacatattttcgaataggagagtagtatcggataaaaagctcaggggcatgtctatcacaccagagatcacattagcatgtcaaattgtttaatcct

SEQ ID NO: 40424 - DNA, 3802 bp, Oryza sativa
aaaaaccaacatgagctaagacctcatggtttctcttgtttgagtcatagaattcctatattttttcctatgctgttaccaaacaacatattttgctaattactttggatttcttccttgtaggattcaacaatacgtgacatttgattcctgtttttttcaaatcctccgttctaaaatagccctaattagacacttcctaggagcgcacatgtttaaaaaaatctgaccattgattagatggattgcattatcgtaacagtagcatagactaatttaatagttataaaattcataaataataaatatgatatgtgccaatcttagtatcacaatttggtcttttattaatttaattctaaaattcaaaactaataattaacatgttgtaactgatatggacacttctttttaatataagcaacttataatttcaaaggtaactaaaaattattagaattttatatttatatagtatcagtaataatagtccattaacttacgggttgatgactaatgtatttaaatcgattagattatggaaaatagctcaatgttcagcactttactatggaatcatcatatccaggacgtgcactctgttttgtcttgaaaaaaccttcaaggattaatctgtggtgttgattgtacaaacccatgcacatgtcagagatggcagcttgattatgctaattaagtggttgcttcttttcttttgcccctccttttaaaaaggagcatatatacaatgtcaatgtaaattctccatgtccacgctatccttttacttgcttgtacattactttgtattaaactatgtataaatgtatattttctttatatcattctttgcagctggagtgatcaagcttggacattctcaaagctgcacagcacagctccacccacaagcatccatttttctcttgaggtaaaaaaggcagagcatgatgaatcatcttgctgttatgggctatgaattgcaaaaggccatgccctgaacggcattgcactagcaaggagttgccactccaggtgattattccttcctgcatccgcagctgctcagcttgggtgcaggaggcggccataaactaagctcaagtggttgaaggaggccttcctccactacttcacaaagtggccctgtgccaatgtgttctctctctgcctgcagcagcaacaaacaaacacttctttccagggaaaaggagatcctcaattatgagctcttcattaggcaaaggttagtgctcttatttccataaatggtggagccacctccaagtacatccatgttctttgcacatcgcaatttagtatagtcatctcatctccctgctgcatgtagcagctactcgtgcttgcatgctgtgtgctaagctaactggagccacactggtaaactacaattgcctaattaacattcaaatcgaagcaaagaagtttaacccgcattctctgccactgggaaacgtcaaattacgttatggatgaattatgatgttctgtatgtgttctctttacagtttacatggatgtattgctcagccaactgttgtctgagtaactttaattatattttactctggaatagtactccctcgtttttaaatacatgacaatattgacttggatataactcttgatcatttattctattcaaaaatttagtgcatacatatatataaaagtataagtcacgcttaaaatacctttaataaaacaagtaatgataaaaatagatcatatttacatagtttttctaataagatgaactatcaaacgttttttctaaaagtcaacatcatatatttaaaagcagagttagtacgtaacaaaaaaagagtagggcacaacctttcttttattggctatggtttcaagtgtgaggcactgcagccacaaattccacttatttgagggcatgttcggaatgatgtgaattagctgtgatatatttgaattgatagggaaatcgcacatgagttaggtataatttgcctatccaaacaaagccttgaagggggcaaggtgccaaggtacttgtgatacttttactgtggtctctgttgttattattttactacctgtattatttttttgacatgattactacctgtattattatcagtataaataatctaaaccattaatttatgagttctactaccaatagaaaaaaaaaatctagttgagatggtagttcacatatatttggtctactagatgagaaaatgaaatttctaggttgattttactacgagtagagaccaccacaaaaagtataggtataatatatatacccaattgaaaattttagttattaattgcaatataaaaagaaataaaacttcaaagaaattttaattgcatccaaagaattgtagtttgaacttctagtaaattcctttttatattgcaattaagaactaaaattttcaattgggaatgtatattgtaccgacaatttttacggtggtctcttgtagtaaaatcaatctagaacttccattttctccttttacatatttttttatttgtcctgagtcctgacagatctaattaatttcttacatccatggtgaaagaatttgaatctatagcagcatgcattgatcttatagattaatgcgagaattttgctttttaccatatagatgttcctagaggaatcttcaattaattatatagttagagttggtcaatgtacaatcttccaacactaaattatatagaggctggtgtaacgtgtgtaagctagctagcttatgatgattcatggccatagatcactgaatccaaaaaaaaaaaagaaaaagaagaagcgaattttaggaaatgatctaatatcaaacaaatagaagtggtgtgacttcgaacccaagccaactgacctaccaccttgtggagctagccagaagacctctactgaatcctaatcctactgtgtcatttggactttggagtttgccagtgcaaaaagaagtgtacagatcagtagatagctacttcagtaatcagtgtaccatcacttggtgcgaaaaatggaaaagacttgtttcttataaggactagatccgcattaaacgctgctttacagacaaccattcaggatgttgaaaaatcacacaccctacatactctggaagatgtaccaggtgaaggtacaaaatgccaaatgctttatcatttctgggcacatgacatctttgccgaatgttctcttcttctcaaatgcaaaagcaaatggaaaaagggtaagctgatttccatgggggaaattatgcttaatgctttcctcaaagcagagcgccatattgtcaatttgtcatcggctgatgagcttaacagccgaaaggacaagcatcagtggcaaatttaattatatatcattttgtggcaacatgtcagtttgcagattcttctcccttcagaatggacgataagaagaatttatttttcaaaagataatggatgagaagatgcgaagaacatatttatcattcttcatcaccagaagtgagcaggggataaaaagctatgttgctatatttcatctgcattggagtgttgaggtcagtaatttccctcaaatggtgaacaattttctgaaacatttttgagggcatatattttcagccgaagatggtacttaatatgaaaacattgtcatgattaatatttgtgataaatatttggttttgcaaatgatttattcaatgacttgatttgaaaagatatgcggatgttggtgtgagtgtgtgtgactaatatggatcatgttataaacttataatat

SEQ ID NO: 40425 - DNA, 43005 bp, Oryza sativa
attcgtgcacgtcaacagaagatgggatcagatttggtatattgtaatttgatttaggaatttagggatagattcctattggaaatagaagttctacttctactcttgagtaagaggtttttatataaatagagcgagaggctatgccttgagggtaagctaagtttgagagattagagagttgataacactttgtattagggtttcatgagaaacttatgagaggagtgttgttattgcactttgtaaaaataaatagatgcataaagttcaatatactttcaagagttttttttatttgggtttgcttgggtccgatagtcaggccgatgacaccactacggttagatcggtggagatggtcggaggaggcgacgcaaaaagcggacaaaccggcgcaagacgatttccatcgaattcgagtgtaacttttaattctgctaaaagtttggtttttggcgttctaaccattcacatttctctgattggtttagttcttgttgttcgacagttaagatcagtttatgtttcagataaggaaagactgcataagagaaaaggatagaattttgtaatgcactcatctgtgatgagacctccctggtggcctagtctccaaccttccttgtggttgtagttcattcttctttagatgtttagctgttttgccatcataagctcatcgatccagtgttttgttttgaagatatatttgtgggagacatattatactgccttaatatgatgttgttgatttttaatatatgattgaccatttacattatttaaaaattagtagataattattatttattctattgtgtttcattattaagatgaactggaaatggcgtttgtttagttggatagagtcagccaatgggaacccctgtatcctcaagtcttctcccttagcaaccgcgcttaataggcggagttaaaaaagataaaatgcatgaaccctaaaactatatgtatacataaaagtatatttaataataaatcaaatgatagaaaaagaattaacaattacttaaattttttgaataagacgaacggtcaaacatttttaaaaaaagtcaactgcgtcaaatattttgggatggagggagtagttgaaacttcgtggcatctaacgttaacgcattaccacgagatatatggacaaatatatattaaatgttgtagatatgatgaatggattagaattcaaatattataaaaatgatataagaatgatgatttagcatgtctgtacgttgagctttagaatgtaataaaatgtagatataattactatgcttttttgttgacctttaaataatcgagtgtttattggattaatgtggcatgttcgtatgttaggctttacggtgtactaataattattatactcgatgtttgtatgtttagttttagtgctttgtgagttgtaactatataaaagaagtatgaatatattaccatgttcccttttcctttgttccggggcaacgctccggtgttctctacttttagtattatactaccagtagaattaaacttaaccgtttattttaaagggtagattagtaatctagtaatggtaatttcggtaggggctgatttatctgtattggtcggacgcaggcatcacatcaggtccgaccgtccgacgcaggcaccacatctcgcccaatgcacgaccactgattgcgactcctcaagtagcccctttaggatccacagaaacgtgagaacaagaacgccgcattgaccgagaacttaacctgcacaagcataaactaaacacatcaagaccagatcacacacaacacaaacaaggatccgctcatttcgaacaaagatgaaacagggagcaaacagaaggttgaacggacccgctcagcagggacggaaagcggcagcatggacctggcggcgcggcgcgcgcgacgggagaccttcctgaacaccgagtgcaggaaccggaccaggaggtccaggctgcggtcctcgtctccgtcgtcgtcctcctcctcccctgtgtcatcgttgtcctctttgctgccgttccagtaggacgcggcggcgcccgagagcgcgagagggcgagaggttcccgaccgtctgagtttgagagtgaaaatgacaaaaatacctctccgcatatatttttttttgacaaaaatatccctccacaattctactatcatcaagtgtggtagtagtagaaatatatttaaaccgttcgatcaaatacgatcaatgattcagattattctctactacaagtagagagcaccagagtaggactctttgttccgtgctataaagatcttcacaagggttatggtttggtgatcaaacccaaattgtagagtacatcggacgattggttaacacaataacatgtctaggacgatatatttttcttgtgttttgtctgaccagtcatagctcgtgtggtataccaagatgggatctaatagtcatagctaggactgtcaaaaaagctcgaggctcgcgagcagctcgagcttggctcatcctaggctcgattcgagctcggctcgagctttaaacgagccgaacccgagcctgagcaaaagctcgcgagctttaccgagccgagctcgagcttctaccgagcctggccgagcttgactatgtatagtttatattgcatgttcaccttattaatataataaactaatagataaatatgtatattagtatctatttacacaataaattaccatgtgttagcgcaatatatttattttaatcattttctactcttttattagtgtgattaactagaaaataactatacttatcaaaagattatcattaaaatatatattatactatttatggccgagctcgaacgagcttgcctaaaagctcgaagatgagataggctcggctcgagctcggctcgagcttgtgtcgagctcgagcttgtgtagacgagctcgctcgagctcggctcgttgatagccctagtcatagcccgtgtggtatatcaagacggaatctcagatctggcgaacgtagcttactttttttttcttctcttatatttttctcccgcttaatcagtttttcttatacacctatttttgtacggttcttttatacattagattagcatgggaaatgaatgggaatgattcagcttttaagatagtggtggtcagtttttattggtacaccggttacgtagaattgcgtagaattggggtgagaaggaaagtaggattaaggcccttctaggtttataaccatcttatgagtcaaaaagctaggtctaaacaaataagttttttttgtcttttttaaagctataaaagccacttttacaccgttaagtcaaaagttaggttagataagttttatttggcttatttgaaaatgaaggtatgactctaccattagacttaatgctttaaagccatcggctttaatacatataaaccaaaaatttagcttaaaatctaaggcaacaaatctaagcccaaataaagagcccataagacagtagaaaaatatattcggttaggaataagttcatccaaggtcccttaatttgtcaacgaattcgattttcatcatttaaccacaaaaccagatacaacgggtccctcaactatcaaaaccggtgcaatataagtgccatggcggtttggagggtggttttagcttacgtggcgcctacgtggctaaattgacccggtcttcatctgacgtggcatagatatggcattgacatggcaatttgatttggaaattaataaaaagagtgaccccacatgttagctacaccaaaagaattaattaaaaatagtggggtccacgttggctccacttttcattcactcccctcatcttcttcctcctctctctccccatctcccctctcctctctccaggagccggcggttcagcgacgcggctggccggtgacggcggagccagggatgacctcggagacgaggacaccagggagctgcgcctgtacggggacgctgacggtgattgttgttactggactcacgcctccgtcgcatggcttcgcttcgcttgcctcctgccatgtttttaccatgccttcttcgtcagtgagatcctctctatatgtgccgttcctttgtagtgatctcgtcagagttggtgttgttgttgttgagctcaccgtggtaggagctgagagggggagagggagagatggggcggccgccgtgctgcgacaaggcaaacgtgaagaaggggccatggacggcggaggaggacgcacgccaagctgctagcgtacacctccacccatggcaccggaaactggacctccgttcctcagcgagcaggtcgtgaaaatcaacgatatcgccattgttgctaatgggatcgagcttgaggtgcatttgatcatatcagatcagatcaaaatatggtgtttttgtttatctcttcttttgctctttcggtgatgcggcgtcaagggaggttcggcggccagcgacgccgcggcgaccccccgtccgacctcctcgccagcgtcgagtcggtcgcctccgccacctcccgcagcatccacgtctccaagttctccgtcggcttccccgacgacgacccggactccgacttctcgcccgacgacccagacctcctgcgcaaccgccccgtccccgaccggctactcgtcgtctccgccggtgtcgccgccaacctcctcttcgccttcctcatcgtctacacccaggcgctcatcgtcggcgtccctgtccaggcgcagctccccggcatcctcgtctccgaggtcatccctggctccgccgccgccggccggccgcgttgccgaaccgccggatgctggagagaggagagaggagatggggagagagaggaggaagaagatgaggggagtgaatgacaagtggagcccacgtgggccccactatttttaattaattcttttggtgtagctgatatgtggggtcactctttttattaattttcaaatcaaattgccacgtcaatgccatatctatgccacgtcagataaagaatgggtcaattttgccacgtaggcaccacataagccaaaaccgccttccaaaccgccatgggacctatattgcactgattttgatagttgagggacccgttgtatctggttttatggttgaaggatgaaaatcggattcgttgacaagttaagggaccttgtatgaacttattcctattcggttatgtgccccttttctcatgggctgttaagtgttaacttgcaagaaccaatcctatctttcgagttgggccttatgcattagagtggacttcactgggcttttgtaagacccacccaacctttagccatccaaccaatgaacttgtagaatgtttttttttaacgaaccgacacaagacagtgtcaatttcattgaatagagcatgaggaaaaaactttacagcttatacggaaattcccgcgcttgcattgttcttcttcttttggtattcagtggtgtgctctatgaacttgtagaatgtgatggactgatggtgatatttgctgaaagtcatgtatattcttgaatgatcgcatccaagcttgtttagtcagtaggacattgaacgattccctcatggttgttcaagtttgaagcttaaattctacggcccaaattcgaagtagtaatttctccttttcgcagcctactacaactactactctatgatgactttcagcaggcagcatgtggactggaaagaaatgttcttcagaatctagaagcaaaggctcaggttcagacagtcgccaacatcagtcttcaaagttgatttgatgcgacgccattagtccaaggttaactttgcaagggtcatgtcactatgagaaagaacattaatttagagagagagagggagagagatagaaagaacaatggcaaagcttaagggcccctttgaatcgcaggattgagaaaacgtaggaataggaaaaacgtaggattttgataagaatgtaagtgtaaaacaaaggattgcaaaacacaggaaaaatacaggaatgactgtttgattgaaccacaggaaaaacacaggaattggataagagagatagactcaaaggaaagttagcaagaggttaaagctcttgctaaatttcctccaaaatctctataggattgtccattccataggaatttcaaaggattggataggattcaatcctttgtttcaaagggcttcataggaaattttcctataggattgaaaacctctaaaattcctatgtttttcctccaaatcaaaggggccctaagttctagaaacaacagaaaactatgacggtccgtattcatcttatgctaatgtaaacacaaaggatccaggatcacagaaagtgatgtaagtatggttagggattgctagccttgactagtacgcagatgtgacaatattaggtctgagtttttcaccggtggcatggcattcagcacaatgtaaacttttcaacacttgtagttgttggtttcgccctgaactccaagaagtatgcaacatggttcagaactcttgaacaggtctaagttgttgtagattcgtagccttgaacagggaaaagaagaggagcagttcaatacattaatctgttttgtgaaaatgacaggatatccaaatattcgtagttagaaggcagaataatacaagggaaaaaatcaagtctttttttttcataaaagaacccacccacatggccacatctaacagacagacaccaacagcaatctaggatctggaggggtgttttctagacaatggagcaaataatctaggacttgaagggatgttccctttaagatattgagattaaaaaaaatcatggaccagttcagtactctattgcatttggtccattcgaggcacgagaaaatatagcgcatatttctgattccgtcatgtgtttcaaattaacctgtctgtcatttgcatcaggtaaacaaaattgcagacaatctttttcacttgtcagttgtcacacacacacacacacacagcgcactgctagataggatcataagatataacttatccccagtgactccagagtctagaagcaacaaaaaaaaaggaataagaaaacgctatagaagtcgatcacagcaaatgttcttcattttcatacgtaactgacatgctagtccagctatacttgacaaagtcatatgtcacagagtctaatagtctacgcccctcttgtgttaatttgcacttgttgaccttctgttctctcctaaaccatatatatcaagaaagtaatcggcacttctcaattaatttctttagagcatagtatgatctcactggctacttatttatgtaagtaaatagccgatcagatcagtgagcatccatgatcaatccaatggtgcacttgctatatttcctgtaagctgactttgattttgttgtcatttctccattcagagaacagaatctccatattacacactggtgcttgaagttggaagaactaaccttaaatgttgagtcaatgttagagaaagatctccactctgtttcttggacagctgatagaagatcaccgatgatagcgaatggcagaaaaaaaaatctttcaaatgccgtcatatacaaagaacttgggttttcctttccctattcccatgctgcattaattgatttttcatgtacagtgtgtactctcaggaaatatacaatattgtctcattcatgacaatgacataaatagttcaatatttcaatgtgctacaggagggcgttttgcattactctactactagtatcaacctatcatcattcggaaattcagacagactatgtggttttgttttttcccactctgataaaacatttcgtcatttttttagcattactggacgccaaccgccgttgtgtcaacatgggagtttttttttttctatggttgatgcgagattgtgccttttagggatttctttctgtgaagaccctatgtttccaaacaaaaccttagaaaatatgatccctctatcgttgaatggcaccttggacattcgagatggtcacgcatcatcaggccatccagtagaagagttcatcattgcatgccttgtgagctccacaatggtcgttgaccgtgttaagtgaaccgtcttgtgtagattaaactcttggcaaggcaatccattaaccaaaaccaaaaaaaactcctgggagtctagctaatgatcaactgatcaagttggcactgtacgtatacttggtactacctctgtcccataataattgtatttttaatattcgaatttatcccaaaataattgtcacaatatagtactaatggtctcattaatcacttctcattcaaaattatctctattttacccttaaccacccttccacttttacatatacaccatttaataaggggcatcatagtttttcttttcaaaccttaatatatgctaaacaatctagaattacaattattttagaattgcaatgaaagtaattgtgaattcataatccgaacaaaggccttttagcaggttcagtgcaaaagctggatgtactttcattgctcaatgaattatccattacctaaaaagaaccagcctttttaattatgttaattaatgaaaagagcgtttggcaagtggacagaaaacataaagtttattgggcaatattggtgcttactagcatggttatgttgagttgttaagaactcaccaaagagaatgaacatagacacattgcgcacagtttgtcaaccaacatgtcgcttgcacgagaacaactcactagtgcatacagtggacaaaggcacctattaatggtaagagctcgtaagttgactacttgcaactatttgaaaattgatgacactgtgtatctataatgtggaggctcatcccatcacccttatcttaaaaatcaatatgagatcaggacagtggcggctaagaaaaccattattatttattcacataataaagaggttgcctacgcgatatttccgttgttgcaagaaacacgatcttcggctacgttctccatcacatctgtctttggtgccatcacctcgacgattttgcaccagccatcgtattcgagtgacgcccacatctatataagaaaataaaaatataaatcacatgggtgtcgagaaaaattaaaaataacaaaaaagtgaccatgcacatgctcataagggccacgcaccagcgacctgtccaaccaagacccggcttgttgcgatgcgagctgcgacgcccgcttgcgcccagagctagctcgatcaacgcatgcatctcaccgatcgaatcgatcggtttctttcacggcctttgacccgtcacacgcggggtcgattcggtgatttcgatcccgtccgctgcacgcagtcccgctctcccacccgaaagcccgcgccgtgccgcctgcgctaactagctttgctacctgctgcgttccaacttttcttggacccactcgaccccggccgatcctgcggtcgagcccttcaaccacgcagcgcacgcacgcacgcatgctgctcgatctgctctgccccggacgaggcgggcggccaatgcgcccgcgtcagacgctcggggttctgtgcgtgccgtgtcgtgtgctcgtgtttgtgctctcgtgtcgtgtttcgtgtgtgccgtgcagcgacctgcgcttagggtacccacaatggttatctataagctctctataagagattcatgtcagtatattttcctacttggaagatattaaatgaatagatagagcaaagctatctactaacttagagatagtctatagagaaaaacgaggcaatacatgagagagctatagatacccacgtagacatactattgaggtggtttactattaatctagtctattgctgagatgtacatgttttatagataacaccttactttaccattgcgggtgctcttatatgctgtggacgtcgtctcgttctcctgggctcgccctttctgtccccgtccgttctagattttactgcctccgttcttaaatataagagattttagttggatatggcatattctaatacaacgaatgtggatataatcaaaatctcttatatttaaggatggagggagtagtactccaaagggacgatacatacctccaactttacttggacgtggacccgacccgatcctgaaattaaatttgaaaaatatactgttgattctttttttcttagaaatattcgtgatgcaaactttttagcagaaatataccgtcgatctcgcacaatcgttgtgcgaaagtgacgagagcgtgaggacgcatgcggtatcacgagatggaagaactagagcgaacggctcacataagaaatcagcgagaccgcatgtcttgtccatcagtattgcttattaacaattttcaacagtcgctatcgctcattgagtgagcgagattgctcggtctcgcggtttggccgtgcgagaccgcgtggtctgacgccgccaccacgcacgtcctcgatttcgcagttcagtgccgcagtttcatcgtgcgagaccgtgcggtttcgcgctatcaccgtgcgacaccgtgcggtctcacgctgtcattgtgcgagaccgttcgcgtcgtcactttcgcggaacggttgtataagatcgatggtatatttctgctaataaatttacatcccaaatatttatgaaaaaaaaacgaatcgaacattatattttcaaatttaattccccgatcctgcgggttcgagcccttcaaccacgcatctgcggccgcacgaggcgggcgtccaatgagccgtgctgtgtcgtgtcgtgcactcgtgcgtatgccgtcttatctcctgcatatgccgtggcctgatctggacgccgtctcctggctcctgcaggttcctcctcacccttcctgtgtctcctgcctccgtccgttgtagtagtaaaaaagggatagtactcgtaactcgcgaaggcgataggagggtgcgcatgcgcggctggtggcgagccgagccggcacccggcagatcgggcgcgcctcacgtctatatagacactcacgggggccgcgtcgtctccatgccctcaccctcgcgcactcccattcccatcctccacatcccgcgccatcgacctcctctccccgggaccgcgtcgctcgcgcgttgcctccacctccagtagcaagtatcaatggcggactccggcaagaagcgggacgggtcggccaacggcgccgagaagaaggcgtcgccgacgccgaagccgccgtcctcctccacatccggttcgtcgttcgttcgtcctctcccctccctccttctaggaacacgcgtgctgcggcctgcgtgcgtccatcgcctttttgctttgttaatttctcgtgttcaacgcagcgtttgtttcgtagtacgtcgtcgtagcctgttcgtgatttgccaccgctccctgtttttacaattttgctgtataatcagctcggttgcggtctcgatctcaagattgacactatctcacataaattaattatgatatgaccgcgtcattgtttaagatcggccaacgggccgcgagcccgcgagaggtcgcgcgctcttgtctgcatgcatgtcgattgtcggggtactcaatgctgtgaccccaatgctttcggcgttaaccatctgtccttttcgttcatcccgaagctaatttatacgcctccatccacgtttcttctgtcctcgaatagttggagtttgcgtgtaggtcttgtgatttttgggtggcttcatgaacaaggtaaaaaggcctttccatcaaaaaggtaggtagtagtagtaaaaagaaaaagaaaaaccgaaataacaggtgcagattgacccggtgggccgggcggctcataaaaattaacgcttctgacttgatcacataaatatcaacagttccgaacaggtgacacgcaactgtacacaccttgatgatcgatagggcctacggcattcacgcacgcaagtactactcctatctacttatctaaagctggctgtttagcccgaatttgattgggccacgtggcttcaatcagtttgcaataaatctatgatttcctgagaaaaaaatataagaaattttttaagagaagaatctggagccatgaggaagaaaaatcgcaggctcccagcatgaggaagaaaaatcgcatgctttaagtacattgcctccacacgcatgagcgaatgatgttgggtcttccttggcagctgggctacaccttgcctgggccagcgggttgagaagatgagttacccaacatcaaatatacttaaagcattacttatgatttatatttttttatatttgtataatgcttttaataagaggaatggtaaatatatgtatatgtgcgtcaaatattaagaatcggagtgagtattttgcaaatattgcactactccaaatgtggtggtgcaagtgtaacgactttacgtgcatatgttccttgcaatattcaaacactgcttgcaacaaaattaatcagccgaaacaagattatcatgttttcaagcccattttaattatcacctccgtagggactagagataaactagctcattacttcaaatcataatagtattgtcaagacaattatcacatacttggggatgggcgtgttggtcttgtggcaaatggacatagtactggccacttggaaacgataagaaaactgtcacatcaacgtgatttttgttgcaatgtcgttgtgaacatatacttgtctgtattttgaggtaatgccaagttatatatagttgttcatcgaataatagaagagggatgtatttgatttatatagttgtatgcatttaaatctccaaagaatggcatattaatgttataaaatatgtacgtatatttgcaaacgttaaaatttccacatatttttgattaatcatctgtattatggttaatcgttggacaatgccttttccgtcccatgattgtattctgctattctgtcttccagaacgcacccacgtccaactgagtatatcaaagcagtgtgaagtgtgaactgctcctaattcttacaatagtttataactgcatgacttttcaacacatcttagtgtcatgttgtaatgaattgaccattgataaggatatatttatataaatgccgacatgcgacacttgaacctcgcaaagtcaacgtagtatcttatatgacacctttaggattataattacatcatactccgtgctactccctccgtttaatattataaatagtttgactaaatttatagtagaatttagtaatatctaaaatatcaattagtttcattagatctaaccgtggatatatttattttgtgttgaaaataatataatattttcctataaatttagtcaaacttaaacaagtttgactataaaaaaaatcaaacgacttataatatgaaacgaatggagtagataatagtagtatatcagtacgtagcaaggtttatagtagaaccggtggtaaccggccaattaacgactggtctgccagaataaatcggccaaataaccaaattggaataatttaaatccaaatgattttaatttttttataataataaatttgatagattcatcaatattttcaacataccgatgtgctttttttaaaaaaaatatatattgatgtgcctcttttcctggcaggtttctccaagaatgtccccctcctcgtgtttgtgttattgctggggctgctgtaccggcagcttcagcctccggttccgaaaatctgtggaactccgggaggccctccggtgaccgggccaagattgcagctcaaggatgggaggcacctggcctaccacgagtacggcgtccctaaggatcaggccaagcacaagatcatcttcgtccatggcttcgactcctgcagatacgacgccctccaagtgtcacctgtaagtcgcgatcgatcgattactgaacacacagtaatctgaaaatgctgagcccctgggttactgaacggaagctgaatgtgtataacaggagctcgcagaagagctgggtgtctacatggtctcgttcgatcgtcctgggtatggagagagcgacccacaccccggtagaacggaggacagcattgcgttcgacatcgaagggctcgccgacgggctgcagctcggccccaagttctacctcatcggctactccatgggcggggaaatcatgtggagctgcctcaaaaacatccctcacaggtatgtatacagtgtacattatatacaccaactgccgctttctgaacattgttgcagggaaaattaaccaaaagtgaaatttgtcctgtacgtgcgcgtgcaggctcgcgggggtgtcaatcctggggccggtggggaactactggtggtcgggttacccgtcgaacgtgtcgacggaggcgtggtacgtgcagctcccgcaggaccagtgggccgtccgcgtggcgcaccacgccccctggctcgcctactggtggaacacccagaagctcttcccggcctccagcgtcatctccttcaaccccgccatcctctcccgggaagacttgaccgtcatccccaagttcgcctaccgcacctacgccgtaagcaaacatgatcgatccatagtactcctacttttttatgcgtgaaaatggatggacgatatgtgctgaataattaaattgcatgggggacggatgagatggttgcaggggcaggtgaggcagcagggggagcacgagagcctgcaccgggacatgctggtggggttcgggaagtgggggtggagcccgctggagatggagaacccgttcccggcgggcgaggcggcggtgcacctgtggcacggcgcggaggacctcatcgtgcccgtgcagctgtcgcggcacatcgcgcagcggctgccgtgggtgcggtaccacgagctgcccacggcgggccacctgttccccatcaccgaagggatgccggacctcatcgtcaggtcgatgctgctcaccgacgagtgagatcaccgaccgaccgaccgagacgcgcatctctctgttttttttggtttttggaattttgggtactgtcacgtaccgacgtacggtggtacgcgtagttgcttgctcctattatcctatcctatatagagaaatgacaataatattttgcggagtcattttgcctcgtttcatctaccacatttcttcgtgactactactgggtctctcaattatctgagccggaacgtgattatggagagcgttggggcccatgtcagttgggccgtaaacgggcctcggcttacgtgcagccccaatattgggccttacggatgtgggctgagagtagttctagttgggctaggtggttgaggggacactgggtgacacacaccaccacagggaataagttcactttgggtccctctacttatcgcccagtccgattttcgtccttggccacaaaaccgggtatgacccatcccccaacttacgaaaaccgggcaaacatgatccctcggcggttttgaaggcggttttggctgacgcgtcgcatacgtggcttctttgactaggtctccatcccacatggcattgacgtggcgcttacgtggcaactatatctcgaaaaaataataaaaagcgtggccccacatgtcagctgcaaaaaattaattttaaaatggtggggcccatgtggaccccacatgtcagcctcactcttctcttcttccctctcccttctctctcttcttcccttcccccctctcactctccttcccgggcagaggacggcgcgggtgggcggcggagcaggcgagctccgacagcggcggcggccatggtcggcgccggcccccgaccggagcgccgccggtccgcgtgaaggcgagcagcgcggcggcgccctggaagacgccatcgacgccgccatccgtgccgccgccgccgaccacccggacgccctccgcgcgcaccgggacgacatcaccgagcgcctctacaccgcgctcgtcgtcctcccgccgccgctccacaagccgcctacgccgtctctcccctccctcatctctcgccgctgacgccgcgccgcgccgctccctcttctcccgccagcggccatcggggagaagggcggcggacggctaggcgagcggcgcgagagatggccgccgccgccccacaccgccatgaggctagcagccgacgccgcaatcctcctccccccgctccaagaaacgctcctcctcctcccacaggccgcgctccctcgcgctggccgtccttgccaccgacgcctcggcgaggaggggaggaggcggaggggagcgcggtcaacgatgacggatggccccatccattgcgccgcccttgccgccaacgccaccgacggctcgcttgctcgcatgcggggaggaagaggaggcgaaaaggccgacggtgagcacgcggggagagggaggaggcggcgcgggagcacgccggggcttcgagtctgccaagtccacctccgcggccggcgggaggaccaaagagtagcggcggctcgccggccgccaccgctccactcccacctacggcccctttgctccgcccaccacccgccgcccctctgcccgccgtccttccgcccaccgcccaccacccgccactcgccgtcgctccacccgtcaccccctctgcgccggcaacgccgccgctcgcccttctgcttgccatgtaggggagagagagaggggggcatagagagaagagggaggctgacatgtgggaccacatgcgtcccacctttttttaatttttttacctgacatgtgggtcccactgttttttattattttctcgggatcaaatgccatgtaaacgccacgtcaatgccacgtgggtcgacgacctagtcaaatggagccacgtcatctaaaactggacacagtactgccgagggacctcttttgcacggttttgtaagttgggggatccgttgtatctggttttgcgaccaagagacgaaaatcgtactgggcgacgaatagagggacccggagtgaacttattccccaccacagcatcgatctgtacaaatgcgtcgatatcgatgtccatcattttgcttcctggcctcctgaacagtacacatcatcgacatgtttgattgcctctctaaacgattctgtacattcagcacgaaacaccatttcaggaaaaaacaaacaaacaaaactgagcatattttgaagttgagttaccctctcgattgttccattcatctgtgcctccttatacatctctaccaaccttacacctcaaatcattaccaggctataatcaccatttcccaaccaccgccacaaatgatacagtactgtattaaccaaatgaaatgaaaagaaataacccattaattatcactaacggggagtaacctaatcatgcccacgaccgacggccatggccggtcaagcacaagcggctagctaatcctccatctccgccttcttgggcgggccgaacctcttctccagccgccggagctccgccggagtgagcccgaacgccctctcgaggacggcctccctgatgccggacccgaacaccgtcgccgggatgcggacgatgccggggttctcgctgttgaaggcgccgtagaccgtggccggcgtgtcgccgacgttgagctggaagtgcaccatggcgcgcgggaacaccatcacctccccctgctcgagcaccttggcgaagaggcggccgccggagtcgacgaacccggcgtacacgcggccggcgaggacgagcgccgtctcggtggcgcgcgggtggtagtgcggcgggttgacgccgccggccgccgagaggtcggcgcgggcgaaggacatccccagggtgtgcaggcccgggaactgcgccggggtgacggacacgccggcgaaccccgtctccggcgagaagttccccgcggcgcgcacgccggagaaggcgaagtcgcccgccgtcaggttggcggggctcctgcacgggtaggccgggagcatggcgagctccaccggccgcccacgcccggcgtccggcacgcagaagtcctgcaccgcgtcgggatcgccccttgccgccatcgccggcagcagcacggcgagcaagaggaggagacaacgacgacgatgcgccatcgattctacgctcgttctgtcactcgttcgtcggtggacagctgcttgctttgcacgtagtagtacatatgtagtcgagcactgatgtcttgtaaggtgagttgatcattgccagtaatcatgcaggtattgatccgtaggttattcttgtattttgtcatgcacgagcagttgtaaagcgtcgatcggccgctttcccggaagtgcagagatggttagaaaagttctcttttttttcttcatgcggaaaagaataggaaaagtgaagggatagaaatatatgtacatatcaatctatagaaaaaaaattagaggtttgagtggatttttttttctctatgcaacttgtaggaaagaaaatattgttttggctttctcatactttattttaacaaatcgaataactcatatagaaattaatcctgagaaatccaaattctttacttttcctctaagaccctatttagttcccaaaacaaaaattttcgtgccgtcatatcgaatgtttgaatacatgtatggagtattaaatgtaggaaaaaaaaccaattacacagattacgtgtaaattgtgagacgaatcgtttaagcctaattatgccataatttgacaatatagtgctacagtaaacatttgctaatgatggattaattagacttaataaattcgtcttgtagttttctgacggaatctgtaatttgttttgttattagactacatttaatactccaaatatatatctgtatatccgatatgataactaaaattaaaaattttctccaactacaccaggctaaatcgaacatgcccctagttctggaagtgtattgaagaagcagggagggaggctctgaagaatggtggcttctgtggattttcaagtggacgctgcacacttgcacagtgcggactgcggaggaccacatgggctggcattattgaccggaagagtcgttcaggtcgtcgtcaatcgtgcgtgcgtgcattgaacctgtagataaggcttccaagaaactcaggaccagggaggagtcataggatccagcatagttggccaatagttcccacgactggttaaaacagaataatctgggaatgatcatgaataataccaataaccggtttggcactcggctttcagttcagtagcttgtgtttatacatagaatgcacatcttttctcaacagtcgactaccgatgaaaatctttcttataacatttgttccctctatcttaattgaagtgctccgagcaacgcatgttgcacggcatatctatcgtaggcatgaccagttgtgacctgtatgtacgtgcgcacatcgatcgccttttgagatcatatatgtgtatgaatcatctgggcagatataatgatgctttcgtggcgtagcaggctgtccatggccgcctccaaccggccgggagcgcgccgccgccggatatagaaagggataataatcccttgccgctgacgcaacttaatcgcactcctgcatcattgcatcttcggccagcgcagcccctccttcacagaaataatgcgttggaatatcatagcacagaaaagttataagcagagagctccattagcaaactggagtataatattagacaggtgatgtctaatctttgtattaggttgctacattcatccaactgttattcacgaaaagatatttcatgaattttataggatttctgttggatttagtctcatttcaagaaaaaaaaacatttctttccattccaaatgaggccaatctgaatcctatggagttcttttcagttgatttcccttaaattttatttttgtaggagttcgaccaacaagtttgtctcatgatctgtctaacggtattttgggcctcaatttcgtgggcttctggcccacgatagcacatcaaacaatggccatcttccaagttgcaaaccttctgttaggcccctttaaatcgcaggaacgaaaaaacggagaaatatgaaaaatataggattctgacaggaatgaaggtgtaaaacagaggattgcaaaacatagaaaaaacataggaataaccgtttgattggaccacaagaaaaacataggaatttgaggagagataaagaatcaaaagatttcttccacgagattctacctctggttaaaatttctccaaaacttgtatgggaaaaggcattctatagaaattttataggattccatagggttcattcctttgattcaaagggctttataggaaaaattcctatagaaataaaatcctgtaaaattcttataaattttctttgaatcaaagggggcttactgtttttttttcgtttcaggttctaccggaggttacttcagtgctgccgtgcctggaactgaactatccaatgctatcgaagaacagaagattgaaagtgacttgtataaatggcggattgcatgatgcaaatagaactgggttttttttttctggtggttgaattgctagcttgcattcctttcgaaatctcttgagagatcatactttattagtcctatttaaattcaatgcttttgttggaacgcgggtgtacctttcaagttcctgttgttccatttggagggtccggccgaacaaatggctgacagcataccgtccatttctaagatttttaatgaactaaaaactgaactacaattgcagatcccttagcacacaaattacgagtttgccctgagtaaccaacgatctgtgatcacagaagatgcatatattggcctttaattaatctcttcttaaaatatacttcctgcttaggtcacttacagggttcacagaactgatgtaattttatgaaactgctaggtctcgatttgtgaaaaccggtcggtattagctggtttctgtacggtgttgactaaaatcatcggtttttacccgttttcggtcggatttcggtaaagctgtgaggagtggtttctacttcgaaattgaaagggtaaaccctggtcacttcatttatttatttttttttgcttacacgcttgacctatttctatgagcaacgagtacatcttgttttttttctaataatggaattcatgtcgacctttgctttcaaaaaactacaaccaattatgcaaagattataggttgaaaaaaaagaaaattacaaaaccacaacttgattaaaaaataagataactacttagattaccaacctaaagatcaagatgaaaccattggcttatatgttatacgtagtccttatcttcatcacatcgagaaacaaattctccaaaaatatcagtcgatcattaccgatcgaaatcagcatcgccgccgacgaaaccataacggaagataaagtcggagagtaactaaggctgtgtttaaatctaggggtgtaaagttttggcttgtcacatcggatatacagacacacatttgaagtattaaacgtagtctaataacaaagcaaattacagaatccgcttgtaaaccgcgagacgaatttattaagcctaattaatccgtcattagcaaaagtttaatgtagcaccacattgtcaaatcatggcgcaattaggcttaaaagattcgtctcgtaatttacacgcaatatgtgtaattagttattttttcgtctatatttaatactccatgcatatgtccaaacattcgaagtgacagggtgtaaaattttgctaggggatctaaagagggcctaagatgtaaaacaacctttcgcccaaatcttagcatcactctaactatcgaaattggcactaggtgcaccaacaaggacctccaatgctacgccttcaagaaagtcacgatattcatgatatcaccattgttgttccggacatttgaaactagggtttcacctaaagtgtccactcgaaagcaagaaggtgaggcaagatattgcgacatcgcctctaggaaagtatgtggccccacaagcatcaccaatgtcaggtgtgcgtgcctcccccatgtcaccacctcagcctcgcgctgtctccacctccactacaccaccggcttgacccacaaccaccgccaacccccaactagatccagctagccctccaactagagggcaactggcaagcatggactagagggcagctgccactaggatcaatgagtgcacttaccccatctctgccattcttgccatcacgcgacaacagatacctgatgatgacatcctccactattacccgccagcaaagacgcaaaagtcgggcggcgaccatgtgagcctctgaataatcccaccttgcttagcttgggaggaggaagccaccttaaaagggagagccacccttcctctattggactagtcttttagagagattgggcctttccccgagtgggtgtgcctatgaactgttggagtccgggcaaccttaagttattgggcctcgaccaactccacctgggccggattgttatcatttggtatcagagttgggcccttgttaagggggtgggaatgatgaggacatcctccactattacccgctagcaaagacgcaaaagtcaggcggcggcgaccgtgtgagcctctgaataatcccaccttgcttagcttgggaggaggaagccaccttaaaaggaagagccacccttcccctattgtactagtcttttagggagattaggcctttccccgagtgggtgtgcctatgaactgttagggtccagacaaccttaagttattgggtctcggccaaccccacctgggcctaattgttatcaataccatacatccagcagcaaggaggtgataccaccactactggagaaaggggctttagtcccggttgggaaccccacctatagtcccggttatgcaaccgagactacgaatccgggactaagtcctgggagaaaggggctttagtcccggttgggaaccccacctatagtcccggttatgcaaccgagactacgaatccgggactaagtcctgggtgaaataactgggagtaaaaatccggttgggaaccccacctatagtcctagttatgcaaccgagactacgaatccgggactaagtcccgggtgaaataaccaagagtaaaaatccattttccaaccgggactaaagatggagctaggccaggtccggttgctctttttttttcttttttcattgtttttaacatcgaatattgattttactccatcgccaaatcatacctaagaaatcccgaatcctcaaatcgatcatctccaaatacatcccaaatcatcacagatcaaaaggatcatcttcaaatcctcaaatagatcatctccaaatacatcacaaattcttaaaaaaaatacatcacaagttctaaaaaattcatcacaaatacatcacatattcacatcacacaaatcaaatacatcacaggatcatgcaataaatcacaagttctcaaaaaaaaatgccagcaggggcgccggccggccggccgctgccgcgccgccgcttcgccacgccggttgccgccgcgcaggctggcccgcccttctcttctcgtgcgctcgctcagccgttgccgcctcccctcctcccctccgcgtcggccgccgcgcggccgacccaccctcctctcatgcgctcgctcagccactccttcgctatgaaggaaggaaagaggtaaggctaagaggaaggaaggagataaggagttagagaggaaaaaaagagatacgagagaggagtttgtgtggagggagaagatgataagtactagggattatatagtgtgttttgatctttagtcccaattagtaacactaaccggcggttgataatacaaaccgggacttcccggttggagttaccaaccgagactaaagattccggaggaccctgacagcatgtgaatcgggactaaagatcacatagtccttttctgcttataaaccgggactaaaaaccatctttagtcccggtttttattgcaaccaggactattgtggtttttaaccgaccggacaaatatggtttttctagtagtgcacatacatataatgaggacagacgattgcatctcctaacactcaaagatacgaatatcaacattcaacaacaaattctgacttctctaaatttctattgaaaatacacgcaaaattaataatggagactagctagcagcaaatccctaagcaacgaacgtgatcaaagcgcacatcagtgcagcgtgtgtaatatttggccattatattagaccatggtggtctggtggatggatagttcagctactgttttcctgaggctgtatatgctgaaatatactccctccgttttttaatagatgacaccgttgactttttctcacatgtttgaccattcgtcttattcaaaaattttatgcaaatgtataagatataaatcacacttaaagtactatgagtgataaaacaactcataacaaaataaattataattacgtaaatttttttgaataagacgaatagtcaaacatgtgagaaaaagttaacagcatctattaaaaaacgaaggtagtatattgtttcctcatctaataatatatatgtatatatgctgacatagttcagctactttcatgagggtgtatagtgaacgttcactatttactaaaagagtgaacatggccataaattagtagttaaagtctgaaattatctgacttcaatagcattcctgaatgtacgtattattccatgattgtaaaaagaaattgtgagatcgacctctatatagagtgaaaccatcttctatatagccacagcccacagtggcggatgtagacaatactgttttttttcttttttggctgagtgcggcaagtttatttcaaaaaatttcataaaggccacgaacgttttttctttgtttgaacgtggaagcaactttcaagttctattgttctactgggcagaatgcaagcaaacaggacaaaaactgtgccatccacttccaatatcataattatgtttgaagcatgcattctttttttttttttttgagaaggagaggctcacctccctcatttcattagagaaatgaaaacagtcctacaagcaatccaaactacttacaacccaactccaagtttgaaacttccaaaaacatcgcacatgactaccaatctaaacattctgaaaagaacagagagaacagattccaccctatttctctaaacaccattctccagcctcttgatgcaaggattccatccatgactcgccttgtacatatcagcggctaccttttttagcagcacagctcccagttgcaagtttgaagcatgcatataattgaactcacactgcacattaattccgtatgcaacacagacctgccatgagtgctacatatatatgatgatcaagtaaagagcaaaatttcatattgggttcaaatctacgtaggagcaaatttcagattgggttatttgaggactaagttccatatttgtttggctaagtttctaatttttttttaaaaaaagactgcgtatatccaattggatatagaagccgggtaaaaaatatccttctctaaaaaaataataataaaagagcaaaatgtgtgaaagttcaattatatgctcataattatgcatgttggagccccaagttgttgcaggtcttcatccttgctctagatatgacaaattcctgcttttatatgctactcttttcgtctcaaaatataagtgattttgtttggaagtgacacatctcagtactatttgttcagattcgtagtattaggatgcgccctattaaactaaaatcacttatattttaggactgatgtagtagaaagctccgttaaattttgcaagattggcatctgcgatttcacatgcttttctctgttgattgtgagctctaaaagcagatacctcagatctgtatatgaattgatcgtctgctcgtactagactgttcgagccattctggctctcagaaacatacatacttatatcgattctgcagtgggccacaacatccctgaaggtcaccaaaccaccacataaacaggaagcaccaaactttacggtgattctgattcagctgttagtcaaggtaaaaaggggacggccacctctcaaattacaggggtcgctatcggaagaaaagaaaacaggcgcatcaggaatagttccttgtgttttgttgggggaaatgcctctcctgtaacgtcgcaactggacgcaaggcggttactctaaatgaaaggcctcgcaaccactcccatgtacatactggtaagtaaagatagattaatcactagtaaaaaatgatttttctgaatgccggtcccgatagattccagacgggtcgtaagcaactggcgccggactgtcgcccacacgaaaaaatgcattattccgtgcgggcgttttaatccgaccgcatatgataatcctcattatcccgtgctgtcgatttaagaggaccgtacggaaaaatcgattctcgcgtgcgggcctcttaagtcgaccgcacgggaaaatacctctccctctttttcttctcacgcacttcaaatttttcacatcctctctcttccttttcccttttattctccctcattcactcctctctctctcttctctctatgcctttcctctcctccccttcccccctctctctcctctctctctatacctctttcctctcctcccctccccaccgagcgcacgaggcgtcgctgccgccaccgccgacggtacggaaggcagcacggcggctgctggcagaggcagcgtggcggcgacggctgacggtcgcggcggaggccaatagcggcggcggcgacgaggatgacggcgaccacgagcggcggtggcgcaacgatgacgacgacgacgggagcagcggcggtgtaatgacggcaatgacgaggacgacggtgatcacgagcggcggttgcgcgaccatggcgatgacgacgggttttgttgggtttatttttctttttttcgtgcgggtggtataacttgaccgcacaggataatcgattgtcccgtgcggtcgacttaacaagaccgcacttatcccgtgcggttgggcagcccacgcacgaaaatattgattttcacaaacctctctgggtgcagacgggcgctacctccgcactgaaaaatgaattatgtactactaccaatctgaatgtaaaagaagaactaaatattactatccatgagatcatcatgacaaaaactagaattgcccagctaaataggaatagaaataaatccagggtaacttgtatcatgagatgggtcaattccaatttgaattccgtacggctacaactctttttaaacgagtcgaagtccagtcttgtcactttccccctttcttatcctcttttttatccaacctcttttatgtattcttgaatgtaatccctccagggcatgcttcatttttttccttacatacaaaattaatagctacaagaattgttttccttacatatatacaaaaaaattgttgtagctttagcaagatttgaacgaaaaaacactggtttccttcaacaaataattaattatgtagtgtttccagctcctaccggctccagcaccattgccgtgcaactatttgctggaagttaagaattttttacataaaacgtcatttttttttggtctcgatgagcgataatttctagggaaaatcggaaccatgccattataattttgcaaaatttgagatataccatcttgacccacatgtcattgactcatgtgggccctacatgtcattgagataccgatggcatatttcaaactttgcaaaattatagcaaaattttacggccatgattggttagtactttgatcagaaatttccattttagaacctagaacacccttgcaacagcgaattgagaaaacaggggatggaaaaaaaatattttggtagaaatacatgtataaaacaagggattgcaaaaatagaaaaaaataatagtttgactagaccacaagaaaaatacatgaatttgagaaaagatatagattcaaaataaactttctatgaggttggagacccatgttaaattttctccaatacatctatggattaaggcattttttttcgaaacaagccgcactatacagtgtgaggttttatattggtatagcgataagaaaagaacaagattacaccctataaggctataattagaaaaagaaaaataaaacaccactacgtgttgacaactcctacacacaaactcggggaaaaatctagcacaaagccaatagttattacacgtgaccagtggctgctcacccaacaataaagtcacaaacacactgccctacacatatccaagcatatagccaccgagaagttcccggtcatcaccacggagatgggtttgtcgagggagagagcgagagagaagaagatacactcatccttcatgcatacccgatggcaacatctaagagcaccgtggtagaccatattgattgaaggctgaaccacggtctcttagacgatgcctccaaggaggtcacgactcggaagtgccaccaccgcccatctaagaaaccttggacttggttttcacctagagaaacctgctaggcagggagggagatgtcttgatagagcccacaagggagatcacagcaccctaaggcgtcacctttgttggaccaaaattgggctaggctttcgtttgtaacctctctcctgcctatggtcacaaccctatcgcctctctaccattcgacctttgttagcacgcaatttccaccacaatggtgcccttcgcccagctagcccatgcccatcttgagatggtccttacgggacctcccactcctaccaccaccgtatcatccccctccccgcgttagcacctcatatccgcatattggcgcttcacaaccaaaccctcctaaacaacaccacatcaagattgccctccaaaccaccacctccaccctcactgtggagctccctatgaccagatctagatacaccggctataggagggtatgttctctaaggagaagaaggggcgcctagccagagaggggagaagggcgggggagggattctacaccgcctgatctaggcacactacacacggcaccaccatccctacaactagcatcacttgtaaggatgttgcacgctgctgccatggtagtttctacacaccaagatccaaccggatccagcatcgtcggccatagatccggcaacctctagctacggcccatcaccaccacaacctcaaagacatcattgtctaacccccacacgttgacccacgtcaccagcggcttggaggcaccattgcttcacttttgccttgcagttgccgtcctagctcgcgcctagcctcagtcggcttgctctaacggtagcgaggtggaggaaggagagagaggggtggtggcaacggctatggttgccgccccgagccatccacacgggagcgacgcgggtgaatagagagcagcatcctatatgaaactcatatgattcaatatattatccgatcctttcatagggttatttaggaaaaaaatattgaattgagtcttaaaaaattcatacactactacatctgtccaaaaatataacaacctattattggatgagatgtctagtactatgggatgtgacacaagtactatgaatctggatatggtttgtccatatttgtagtactaaaatgggtctcatctaatactatgttgctatattttagaatagatctagtatggttttccactcatacatcaatcaatagaccaacctggcttctattttattttctagatggtactactataatttctcggaatctagacgaaaagttaaactgtttgggaaactttcgattctgagataaactgtagctacgagagaaacattgcccttgtttagttctcaaaacaaaaacttttcacccatctcatcggatgtttggacacatgcatggagtattaaatgtgtacaaaagaaaaagaaaaccaattacacagtttgcgtgtaaattgcgagacgaatcttttaagcctaattgtgccatgatttgacaatatagtgctatagtaaacatttgctaatgacggattaattaggtttaataaattcgtctcgcagtttcctgacggaatctgtaatttgtttcttattagactatgtttaatatttcaaatatgtgtccgtatatccgatgtgacaaccaaaacccaaaattttccccaacaaaacaaggcctttgtaaataggctctgaagctcatagtcaacctaaaaggcctagagtgttaaattaggcctggtttatttccccaaaatattttcctaaaaacatcatatcgaatctttggacacatgcatgaagcattaaatatagattaaaaagaactaattacacagttagtgggaaatcgcgagacgaatcttttgagcctaattagtccatgattagtcataaagtgttacagtaactcacatgtgctaatgatggattaattaggctcaaaagattcgtctcgcagtttctaggtgagttatgaaattagtttttcattcgtgttcaaaaattccttccaaaatccactcaaacatctaatgtgatataaaaaaactagctgggtggcccgcgcaattgcgcagctagcgcccaaacaaaatcatatattttttagtatgattttacttaaaatttattaaatacctatctcgttgtcttaagactttgaatgaccaaatcttatcatccccgtgtttctaattatatagtttttaaaagtcacaccaatttctaccccttacttctgccatctccttctttatttgcttgctagatctaccactttctattcattctccttggaacctttaaaaatggatcttatagattttagagtctattatcttgttaggtttctttttataatttctagaagtcacatcaaacgctgccattatactactctgcggttcgtccaatgtcttttctttttattgtcattgggattttaaaaatcgaatataataatcgttcgggttcattttttactttttagaagtcccgccaaaccgttagtggctttgccattgaactcctctgtgacttatctgctgcctcccttctttattgtcattgagattttaaaatcgaacatgattatcattgttttttttactttttagaagttccgaacctttaaaaattggaccttgtagtttttagagtttattgtctcgttgggtttcatttttcataatttttagaagtctcgttaaacgatgccactatactcctctacggctcacccgccgcctactctttattatcattgggattctaaaaatcgaacataactaccgttggaattcattttttattttctagaagtcccaccaaccatcggtggctctgcaactatactcctatactcccagtgcactgcttctcctttttattgtcattgagattcttaaaatcgaatatgattatcaatgtggtttattttttttactttctaaaagtcctagcaacctccttgtccgtttgcttcacgacctacatgttgtccctccttttaattctcattaggattatatttagtgttttattaacagttatatgtcgtatcaaccgacaccactctactcctttataggcatgttatttaatttatcttatcatgtattttaggtggtcttttctttcaatagtccttattttctgtcaccaattagttatcaataaattgtattcctaatggaattctttttttctttttctaattttagaattttttttcaaattttaactaataccgtatagtgttcttttaatatttttatttttcaattccagttgtttcaaaattgtattcctactcaactctcttttactttttttaatttttgatattattttatttttcattctgaattttaattaatctcgtatcgggttcttatatggatttttctttcaatattgcttattcttaatttcgaatttctgttaattttaaattatattcctactttaactctttttttctttttgctaattttagattttatttttatttttcttccgtatattaactaatatcgtattaggttcttatattgactcttctctcaatattcattatttttaattctgaatttcagctatttttgaattgtatttctacttggactctcctttttttttctctgattaatgtgagaatttctagcccccacagcgaacgtggtgcctccttttaaagctattttaataatataatagatttcgcgagctaaacgggagccttagtgacttactcgacgagacaattgcgcccggaaatgctaatgggcgggtgatcgctcccccgcccgcccaacgatcacccgcccgccctctcccctgtactactccatacactcctcccctactacagtacaccacacaatttttttaaaaaaaacaaaaagttagaaaaaattatgtatagaaatactatatataaaaaatttgaattcaaattcaaatttgaatcggctatgtaaacttttggcttataaactttaggtctataaactttacgtgtataaactttagatatatagaaatactatatatagaaaatatttgaattcaaattcaaatttgaatcagatataatttaaattcaaatttgaatcgggtatgtaaacttttgccttataaactttaggtctaaaaactttaggtgcataaactttagatgcataaaaatactatatagagaaaatatttgaattcaaattcaaatttgaatcagatataattcaaattcaaattcaaatttaaaacgggtatgtaaacttttgacttataaactttgggtctataaattttaggtatataaactttagatgtatagaaatactatatataaaaaatatttgaattcaaattcaaatttgaatcggatatataaacttttgacttataaacttttcgtctctaaactttatatgtgtaaacttgaggtgtataaactttagatgcataaatttactaaaataggaaagtaatgtggtgacaaaaaagaaaatcaggtggagggagagaggggaggggatcgatcgctacccccatctcctggcgatcgatcgcccgttaggatcccccaattgcgcccccccagttgttgggaactggagacgagtcagatcatcgacccacacagcgtgatatggaaggcccacctcaaaaggtcgcgtcgcgtcccgccgagattctggaagcgaaaggctgagcgcaatcgcggggcgtccaagtggcccctgcaaaaaatcccccccgaaatcccaccacccccccgcggcgcggccgcatcaacccactggccctgcggcggccacccaacccaacccaacccaacccaagcctcacatctgatcacgacgcccacccccccacgcaagatcgccgcgcccgcgccacgtagccggccaaacgcagccacacagccccggccacgctcccgcctcccgcaccataggccgccccccgcgccctcgcagtctttaacgtcccagcctctcgtttgcctcgcactcctgccgcccatcacccaaccaccgcgcgcctctcctctcctctcctctcccgccgcgcgaatcgcgatcttttcctaagccgcggccacggtttgcctcgctagcttgcagtatctgtatcacacagaggggtcaaggggacggatcagctagctctctctatagctagcaaagccggccatgtgcaagaggagctgcatggcgccgtccgagtcgtgcgcggcgcggccggcggacgagaggccggcggtctgcagctgcggcggggccggtggtggtcaggcggcggcggggacgtcgtcggaccgccaccaccagcttgtgctgctgcaggcggaggcggtggagaagaagaagggcggcaggggggcggcggcgccggacgaggcggcgatggccgacggcggcggcggtggcggaggcgctggggatcaccatcagcaagcggcgttgctggcgccgttgccggtgtcgaggcggccggcgccgtcgtcggtggcggcgggggaggagagggagagcgcgcgggagcggctgaagcggcaccggacggagatggccgggcgggtgcggatcccggagatgtgggggcaggagaggctgctcaaggactgggtcgactgcgccgtcttcgaccgcccgctcgccgccacgcgcggcctgctcaccgcccgcgacgccctcgtcgccgagtgcgccgcccccgcgcgccgcccgccgcacggccccaccgcccgcccgctccgggtgcagaacggctgctcttgatcgtgatcgatcgcctccgatctccatcgatcgatcgatcgagtgctttcgtcaagtttttgcctcccctggccggccggctgctagcttcttccaagtgaaaagttactcgtcttctatgcgaaacctattcggggtatggattatttgatcgatgtcaagtactctacttaatctgtatactacttttgactactggtggatgtaattaattgttaattgatcaccatttgcggcaagttcgatccattcttgttcgaagcaatactccgtctgctctaatataagagcttgctagctgttgattatttcatccgctctctatccttcacctttacctggccatccaatcgattaattagcaaaaaaaattcatgaataagcttccgatctccacatcagatagctgaattccccatctacactgccgaacttaaaaaaatcctaatgattcggatgagctagctatctcctgatcatccactaataaacaacaacaccttaatttgttcctgttcagtttaagttcaaaatcctagctagtatcgcatgtaatatgcagcagcttaattcattcagctctctcatcacatagatctaataacagtaggcagaggtacggtatctctggaattgtgctctaggatcgcaggtttagatcttgaattcttgatcgatctgttactatgagcaaccagcaaatgattctgcatcaacatctcaccgacgtggcctcgttcccttctttcgttggtcgtctttccatttgtggaacagattctttcctacctcctttgctttatgatgtatatggagtatctgttagaataattaaatgggctagcatctataacaaattttgagaataattactagagaaactcaagtatgcactgtacggagggatgtaagtggggtggccaagtgggcaagcgagattttttttccgcttatcacaattctacttagttttatgtttcaaattttgtactagcaactagaaaatgaattattaagcagggttttatactagtaacaagattgttcaggagaaaacatgtatttagtttcactttgttgattgctcgtggaaggagaggtgaatttttacctagggaatgtatggataataaatgagaccataacattgtaacgtagacgggatgccgagtgaaggagagagaaggcacgaagagagaaacattgactcttctttttgaagatttgatgcgaggcacaagatataagggagagttgtgtgtgggtattgtgggaagaaggttagggaaagagaaaaaataatgaataaaaatttggttgtcttgactattaaactaatagtggctctcttaatggcatataaaatcttggagtttgaaggagactcaacggttaaaattgcgtcggtaatacacaattactagtgacgatatacatagctatcaatggtgatacctatcaagtaccaaccatgatacatataggtaccaataatattattatttattaattttaatttaatactctacgatacatcaatgaaaacctatctaagaaagatgtacaacaagtataatagtaagattttattgtttagcccaaccactactggacacatggctaagtaaggccctacaaaacggcgtagtttctctaactactaactagaagaatggtaacccaacacaaaaaacacccatgtcgccctagtgaaataacccatcctgcaccaggagtggggtagggaggttatatgtagtggcggttatagtcttctagaggttttggaccaccctccattttggtacagagtactccatccttcaaatttgataaaaattttgacaaaatagatgtaatgttgacattatataatttagaagtatggtgtaggaccacgcctaacaaaaatttctaaagccaccactgtcctatgacatggaacatggggataccattccaacgtttggatggtgtactctgtaccatagtagctccctttttagcttctctcccccacaaaataccacctcaacctaattttcctttaattatcgcaccaccttaaaattgtgctgtagcagggggtatgaaattgccatggacacccattaaaagtactctttatgattgcaccactgcgaaggaacattgactccagttaacactgaccatttattaatgagaccttttgattcaacagctcaaattgcagttacgtggagtcgaaatcccaaactcgtgcttaatcatgggcctatacggccacatgcattgtggcccaacatcgggtcctgtcttgagagacggagctagcccagcccacggagaagagagcggtccggatctggttggtccacacactccgcatgcagggccgaatagacttgttccccgcgaaatcgtagtacgcgactagctagccagccaccgtccggcccacaacgccggagcgggatcaacgagaaacgcgtgcgagattctggtgcgagccggacggacgatgagtcggatcggcgtcagccactcatcctgtcacagtatcgcccactcgatcggatccgcaccgacactactctcccagccagccacagctcggtgattcgagcgtgggccgcatcggttctggcccatgccgtccgatccgtccgtaggcgagcgcgcgggtcaccgaccgtgttttttttcgattttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatataaagattaaaaatctgtgtgatacgattataaaaatctttcgaaagatgtataggtactcccgtttttttttcccggagtagccgccggtgatcagtgatctggattctctggaaagcggtttcccttccttctttactgcttcgctaatagtagggaaactattctaatctctcgaggggatgttccctcgtttgctcaaaaatcatctaaacggttatgaaaaattctggaaaaatttgacaatattcatacaacacatatatacaactccacaaaatcttaagtccaaactcaactcacacgtcgagatataaaaaaagacaaattcagcgtatgaatagtagcgcactgtttatatctaaatttgtcttttttgtttctcgatgtgtagaacgaattttaacatgaattttgatggactagtaggtatcattatactctacattgtcaatttttttcagaatttttcgcaactatttgcatcgaatttataagaaaaaggtataggattagaatccactcccctagtactagtcgtctttctctttgcccgtcgctctcaggttcggtgattgtcgctgattaattagcagccggcggttcgcgatgtccggtttccgtttctttctgtcgatttctctctcgagatcgtacgtggagtcaaattaagatcggtcatcagtcgcccgcacactttttgcctcaagatccggtaatacggccgcgtgcgtggtgccacgcctgaggcgcaccatcgatctgactctacgggaaaagtcacgcaggtgcatgtaggacgattcgagcttacttgacatatattacacgcgacaggacaagtagtagtataaagctcgggaggacgggttgatcgatatgattgactcggttgttactctacttgtataagattaggaacacgtgtgctcttacgtaacacagcgtgcgtcgtctacgcaccaataatcacccacaaacaataagtagttaagtcgttttcaacgtgtcaattatacgggagacgacatgtttccgtcgacatgtacggtgctagcttagctagcccggagctgctgaggcgacagcgaaggtacgtacgttgccggcagcggcagcggcagcggggccagattgcccagacatggcgcggtcaagagagcggcagctgacacgaagcgggctaccacgccgctacgcccaccggtgcgcgcgcgcggtgacgaggcagccacccacagagaggcctctcgcacgtacgcgatcgcgcgccgatacatcatccgtctcgatctcctagctcgcttcctccctgcttcccaccggcaccgcggcacggctaccgcgcgcgcgcgcgcacacacaaaccaggccgctgtactcacacgtgctcgatcgatcgctagcttatatagcagcaaaaactactagctcgactcagctgtcagctccaagcctatccaagtggaacgcaacagaggcgtcgtctcctcctctcctcgacctctcgcggttggaggtctcgcgcgcgcgtgaggcaacaagtgcccgttcgatcgaccggcaaggatggcgacggcagcgagagcggcgtcgtgcacccccgccgcttgcgctgtgttggtcatccccatcctagtcctgatcatggcaggtgagttcttcgctcaatctagctcacgatcgagcagtgcttctgcaaattaatctctcctcgatcccccttcagctaagctgtctcgcttcaagctagcagcttatactggttcatcagaaagagacgatggaaattttgtgtgttttagttgctatgcatttcacaattaagttcgttcttgcaaattggggatacgatgctagctgcatttcgttggtttttatctggattagcaggtgcatttgccgatattatatcatgtgattgtgattagtaatgcgcagctctttaagacctcaactatggctaggtgctccatggcgtaagacaccgcgcccactaaggctacaaaaccaaatcaccatataaaatccatctcatttctagaagatccttctattgggtatcaatcttcagttttctatcaattctttacaagcaaagtaagcaacaatagtcgggtatatttccctttactccgctccatttttttactttttccccctccaattctgtttttgctcgtcttatctggtcatgagctgtatgtggtttttctttctccacaaagttcctctggaaagagcatttgttcatcatttattattcgcaccgtacccgccagctgaatttggtttgataggcgagttgcaacttgaaaatataggtgaaaacaaagcacagggctcgacactgcacgccgcattggaataattgagttggttagtacgtagtactactattagttcttggcaggatgccttggtggctcatccaccacatgtccatgtggtccagtgaaatcttgcttcccattggatcacgcgcactgtgtatcttgtatattgtattatatctaaaatttctttattcttcatccggggaaataaattctttattcttctacaggattaattagtccagggtaataatagtgtccaattgtaaacacattgtatcttaagaactgagcataactccgttgacgtggtgtaaggttttcccccaacccacctgagtttgaatcctaaacccagcatgtttctcatgatagcactaatgtatatattactccctccgttgtaggttataagatgttttgactttagtcaaagtcaatctactttaagtttgatcaaatttatagaaaaaaatagtaatatttttgaaccaagataaatttattataaaaatatatttaattattaatttaataaaactaatttgataatgtaaatattgctatatttgaatataaacttagttaaaccaaaacatcttataatctggaattttataacctgaaacggagggagtacttttattccgatgtgcctgcattcattgcactcatgatgataatcaagtttgagctgagctagctgttgcaatctcaaggatgaccaaaaatattacatgaatgagattccgtgtttttcactgcattctatttctcagcaccatagcacatcagaacaaataaatgaacaatgatgatgatcactcggaaaattaaacttgacaaaatgcagcaaaatatacagtggcacattttcctcgcagacagaaccatggctcatttttgcatgtatatatgcgtctaatgcaattgctggtcactgaccgtgacaaatcgcatgcatgcagggcaagtgcgagtcgcggaggcgctgtccatcggcgtgaactacgggcagatcgcgaacaacctcccgtcgccgtcgcgggtgtcgtggctgctccggtcgctcaagatcagcaaggtgaagctgttcgacgccgacccgcacgtcctgcgcgcgttcctcggcacgggcgtggagttcgtggtcggcatcggcaacgaggccgtcccggcgatggccagccccgcggcggcggagtcgtggctgcagctgcacgtggtgccgcacctccgcgccggcgcgcgcatcacctgcatcaccgtcggcaacgaggtgttcaagggcaacgacaccgccctccaggccagcctcctcccggcgttgcggtccgtgcaccaggcgctcggcgcgctcggcctccagggccgcgtcaacgtcaccaccgcgcactcgctggacatcatgggcgtgtcctacccgccgtccgccggtgcgttccacccctccgccgcgccgcacctgcagccgttcctggccttcctgtcggcggcgagggcgccgttcctcatcaactgctacccgtacttcgcctacaaggacgacccggcgcgcgtgccgctggagtacgtgctgttccagcccaacgccggcgtcgtcgacccgcgcacgaggctcgtctacgacaacatgctgtacgcgcaggtggacgccgtgtacgcggcgatccaggcgatggggcacacggacatcgacgtgaaggtgtcggagaccgggtggccgtcccgcggcgaccccgacgaggccggcgcgacgcccgagaacgccgggacgtacatcgggaacctcctccggaggatcgagatgaagcagggcacgccgctgcggccgcaggcgcccatcgacgtctacgtcttcgcgctcttcaacgagaacctcaagcccggcccggcgtcggagcggaactacggcctcttctaccccgacggcacgccggtctacaacgtcggcctccgcggctacctcccgcccatggcatcacacgaggcagcgacccaggtaagacggattactcccacattaccattcttttttcgattacatggaagacacacgtgtgttgcgacatcatacgcatagatcagcggtaaaatcttgattgtgcaaagtttttttttccttgattacacggtacacgcgcacacacacacaccagtacaaacgcaacttcacacttacatccaccagtgtttcccaatagagatgaaaaccaacgttacattcttgatctcactaaattcatatgaaagcatatttgcgtaagtataatatttataacattggaatttaaatccataatctcaccatcacatgacatgtgcttattccataaagatcatactgaaatgacactcacgtacttttttttgtctaaaaaacttaacctatgtgaggatttgatataacctactataacgaatctggatagcgtgggttgcgttcaatcatcacctagatcaggcagtcagctatgctttcacctgattgctctcaaaacattttacgtgatgtacgttgtactactgagatagtgaggtggcaatgtgacagagataaaaggccgttggcatttggcaggcaaggaatagaattctccaccaattgaagtgtcccatccgcttgcacttactagcaaaatgcatcatcaaactcaatattatactcctaagttctcttgtgaacctgtcctttacatgagccttgacaagtcatctacctttgtgtcttttttgcaggtgatccattggttcctacttatcgccaccgcatcggtcgttttcgccttatcgtgacagtatcagccactgtacttagtgagtcgtgacaactgcagttaacgggggtgccattcagaagctgaaaatggcttcgcagtgatattagattagaggatagatctaacagaaatttggaaagtattaacccaccaggcttgcactgcctttcgtcttacagtgttacagaggaagagtcatacagaagaattgtcattggtcgataatacatagcaaatcatcagttgtaagcgtatcacattcttttgggatttataaatgatcttgttctattctggcatctaaggtctggaatctggacgtatattcttgcacagctcctatacacattactgtttctcaccaatcaggaattg

SEQ ID NO: 40426 - DNA, 7865 bp, Oryza sativa
ttagaccaatatgatgttaggaacagaagtgactactgaatctacccatgatttcaacctatcagattcatgcaaaatgcatcaaacctatacaactttctccaaacaggtccacgtgtgtagcaaaaaatcatgtgatgactgtaagtttgctttattttacagtgtttcattttcctttgttatgtcccaatgaaatatgcagcaatttctgttgttttacctttcttctgagagaagattctggcaatgcaagttcctgagctcgctgttctctggccttgttcctcctttcaatgtcattgttggtcttgcggagtagaaaccatctaaacaacggtattgcaaaaaaggaaccagcatatacctacaaagggccacatgttatcagtaatcagtatatcatcaatgcattcatcatacattcacaacataatacaaccaacagtttgcacattatgactttcagatgttcccctcacaaaaccaagggttcatgattgatttcaaccaggtgcttttcaacatgactataaagatcaagggattacaacttttatgcaactaaataggccgcatagagcccagccatacctgaagcaaaggaaacagttgcgcaacaaatgagataagtccaccaggtggcactgtcatttgcctacaaaacaaagtttaatgtaaaaaattagtaaaagtgaattacaattcaatggtatttgagggcagaatcacaattcctacttcaacaggttcccaagaatgatcacaccaaaaagattgagtcctcccaaaccagcaaccattgccctttcagatgcatttgctttgctgcaaaacgacaacaccacatatgaatatacagaggtacaagacaaactgcagatttcaaaaataacaaattgatgcaattaccctctaatgcatcaatacagacaattctcggctccaatgcagtgcattccatagtgtactaatgtgtgacttgattccaagaaaaaataaatttacaatccaaacacaagtacatgcacattatagggtaacaaaacacccttaagttagattttggcatcagactgaacaaatatttccttgaattgaaccaaaatggaccaaatagatagaggtagtgcatggtagagagctgcacaagttaggatgacgaggtagatgagctaaaggcaggaattggaaataatggagcttcatttgtcatttgatctgaagtcacagagggtgatgcggacagctttgatagttcgcagttgtgttttaggcagcttggggtatattttaggacctaggccaaagtacaatgttggaaggtagaacaggttccactagagttaaatgcaataacagggaaactacttgaataactcaatgacaaaaaaatgctaacctgaatttccatggtttctcctctaagtacttttcaacactgctaaacatagcagaccatttgttaccaacatattctctaaccccacttccttttgatgaagcagtacgttgcagtgatggaaacctataaagaatgtttccctgaatacaaaaacaacatcaaaatacactataagttgatcagttcaatcaagatgcattcaagttcactaccagttatgtaatgccaccttcagtaagtggtgggattgatggtgtaaacattaagaacaatgtagggatatgtcttagtggcagtcaatatatgcttaaattatgagaagaaagatggacctgttcatcaacttctgggtgtccctggaagcgtaatagaactggaagaataaatgattcatcatcctgtagttcagaatatcatatgcatatgatgagatgaggcttcacgccaacgaacaatccataacttacatggaaaattcatcacagtatttaatttatttagtaatgaatggaaaagtacaaaaaaaaccaataacaacaagaagaatactaataagcattttagaacagaagttatataccttggattgttctgaaattggtggcacatcaagatacggtgctagttcttctgccgtgacaactccaccattcgatgaaatatattgcccaatctgtatatttattcaaggagaagttagaattttgtaacagtacaaactagtaacaaataagagctgatcatgatagttagaaacagaaacagctatatggcctatgaaaagcttttaccatcttccacctcttatcttcaagaccatcatttggatcaccatctccaaatacaaatgaaaagatctgcataattgatttatgaacataaagttaacccacctacacatgacagaattacaccaaggaaatgaaatatcaagtcaaacccttttaaattacagattcaataaaattcatcccatcttccttttctacccgccgccgcctcctgtagtaatcagcgtccaagtacctgttgaagacatatgaaatattattgtgaacgactgaacgatagcaatgtgtacaaactacaaaattaaaagtattcacggtgcaaaatcaaagattgcattaacagctggatgatttagtatcatttttcatgcagtccctacataagagttattttcatgttgatttacgcatgctatgcatagtgaatgcataaaatacaactaacacatatgcatgagtatgactacgtttaaattgattgtatttttgccagagcatttattctgagatggttcgtttcagaagaaatactagcacaacagttggcacagagcccaggcaattttcaaccataaatgtgcaatagccgatgaagtttagcaaccccccaaacgcaaaagtagatggacattataattgtttgtgttccttcgcccaagaatgcactaagataatccagctatgttgaaactcgtcctaaagtgacaggagacttaccaaaataaatctgttggtatgatgatagtagagtcataggatctccgtcgcctgccgcgattatcttcatcactgatacaataagaagtgttatcactggactggaaataagcaaatgacagtatctctactaatgtccccaaatatatagaaacaactaataatggctaaatcttagactatagagtgagattttttattctgaattacatatttatggatggaattgaggagaacggttgataaatatgaagacattgtgcctgaattgctttgagtagaatagagtatagtaattaattaactgaaaatccatctggttatactaagcccacctcgagcttgagataatggcaatgatggtagtgtatacaagcacaatggaggcgatgagcgctgtcccaaatgacactcgcaccaaatatgcacccacttcctgcgaaaagttacagaaagaaaattcacaactgagccaacaaaatgactcgcgcaatttttatcaataaactttttgtttcatctctccagcagtccagcaccttagttttgtcgatcagcggctcgaccttcattctgaacgacttgccagcaagcttcgccctgtagtctttagggaagacgtacagcacctccccttcctccgagacctacacaagtcgcaaccgcttcatgcttagacagccacaaaaggcacggaggttagcaaaaccaaggacgcggtgacaacggagtacttagcagagctaaggaggcgcacctccaggaagccgccggtgtcagcggcgagcgcttgcagcgcgcgctcggcctgcgcgagctgcagccccgcgcgggacgcgacgtcgccgatggtgacgcggccgccgaagtggtcgacggcctccatggcgcggtcgcgcacgccggaggggaggcggtcggtctccacggcgccgccggggcgcgcgagccccggcgcctggatggtccccgcgcgggccctcacgtcgtggcgccaccgcggcgacggcgggtgcgggtgccggccgtggtggtggtgggcgacgcggaggtggaggtggaggtggtggtggtagggagagagggggaggaaaggggcgtggcgcggcggcctgccgcggcggtgaggcggcgggggcggggcgaggcggaggtggagggagagggaggcggcgggcgccatgggtggggggaggtggtggtgggggtttagggcgaggtgggcattctccggtgagaggagtggctgtggaaggcggaagggaaaggggggagagaggcggtggtgtgtgctggccgtggccacgagatcggatttggtctctctgaccggtggatttctgggtcggtctcgttcatggcctgcactagctaggcacgttaagttcaagctcagcaataacgctaagcaaaattgggtgaaaacagatcgaataaagttagttagacacagataatagacaaaatggatgatcaaaagttcaaaacactagaaaaatatcaaaagtattgggttgagtgattagagagaaaaaaaacacggtttacaaagacacttgtaagactattgctccctccatttcaggtgagaattttcagaatataccacaatatgcactgcttttaggatttgtcacccaattcgtactactttcagaatacaccactagagtggaattttttcgtttcgtgccctccgtccacccaaagacgtgcgtcgtcagttcatccatctcgtgccatttgcctgcacgaatttggccgccggcgagctcgtcctcccccacgcgtcgtttgccctcacgcatctggcgagctcgctcgtgttgtccccgagctcagccgccgccgcaccgggctgtcgccactgcgccctcgagccaccggagctcgacgccctccgccctccactgctattcctctctcctccgggcctctcccgcgtgcgccgatggtggcgacggacagtcgacggtgcaactgacgcgggcacgacggacgagcgatgacggggctgacgccggcggcgacggacgggcgacggctgggctgacgcaggcgcgagcagcggcggactgacgacggcggcgccaggaggacggaggacgacggcagcgccaagaggacggaggacgacggcgcgattgacgctaggggacagagtggtacggaataaagaaaatccgcactccagtggtgtattctgaaagtagtgcgaattgggggacaaatcctgaaagcaatgcgtgttgggtggtatattctgaaaattctcattttaggttgcaagacgttttgactttggtcaaagtcaaattgttttaagtttgactaagtttatagataaatatagtaatatttataatactaaattagtttcatcaaatcaataattaaatatattttcataataaatttgtcttaggttgaaaatgttactactttttctacaaacttggttaaacttaaagtagtttgactttgactaaagttaaaacgttagataattttggtcgacatgacgaatgtgttcggccaattcgcggtagcatatagaaaatccattatctaaaaagaattgcagtagcaactcgaaactttaagaaggatagtaccaagtaacagatgaattatttatgagatggataaaatgcagtaaaaaaaacacagcaacgatttctttttttaatggtgaatgttatgacaatgttagtcccaatcaagctacatcttgataatgaatctaatgtattggtttgtttaattttttgtatgtatacaaaaaggttgtgtattgtattgttctcgtatgtgtgtacattccagttttactattttgattagttggttattgtttattggctagtaacatgatatgcagtagtaatattcaaactaactatggatatactttttatgtagtgcattaagttaatgaatcagattgagcggactgttatcttctttatttactcatatgctttctgtttgtaagttatctcaagaaaatcaaatgatatatccatagtgatggactaattatattttttttaagtgatgaacgtattgcatatactgagagtctatacatagaataatgattgttttgttcatcttttttaaagatataaattttacgttaacttccgttattcatatttttaaactgctaaacggtacattttttttaaaaaaaaactttctataaatcatcattttaaaatatcaaataaatttatttttaaaatttataataattaaagctcaattaatcttgcgttcatctttcattttaatctatctcaaacaccacgaatcatactttgtctttcaatcgttcgcatcaagaaccagaaccaggttcttgcagcggcagctaaaagggggggtttttaactatttgccactcttacggagtgccactcttgagatgccactctttcaaatttttttaaagaattaccataagagagagaattaatctttataaatgaccaaatttgcctaagtggagggctacctcagctctgtcaacatgaaagcggatgtctaatgactctttggcccttggtttaaacattgtaatagctgactataaccaaatatttgagcaacatttgagattatatacaaacgtatctaaaaatatggtttatcattttttaaaaaatagtttataatgggcaaatgttcagtaatttgaataagttcaccataatataataatagattcaacgaggtcatatccgtatagaaataaaccatcacactagtttatagaatatatcagttcatattgaaatagaagtcataggatcattagtccagtacatctgatctgagaactactgaactagtgtggatggtctagctcatggatgtaaccatgtagaaatgtagaatccattatttttattatggtgaactggttcaaactactgatttttttcctatgataaacccttttttaatagatagtattttttttaagatacgtttgtatataatttcccaaatgttactcaaatatttggtgtacaagagtacatggtcaaaccaagggtacaagagtcatttgaatttagctttcacgctggcaaaactgacatggccctccacttaggtaaatttgatcatttgtaaagattaattctctttcttgtggtaattctgtaaaaaaaaagttagaagagtggcatctcaagagtgccactccgtaagagtggcaaatagttaaaaacgccgctaaaaggaagggagcgtattctatgcacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttgttacagctaaaatataatgaatttgacgttaagattttaaccctaagtgtaatacaactgaaagtatgtgtatgattttttctagattttttggtgatattttttagttggtgtgcacgtgtatatacacgtgagagcctgtgtgcataggatatgttgcgtaaaaggaatccaccatttgggttcttcccggggtaaaatatcggcccctcgttccctttcggccacgtcaccatctccccttccgaacagcttgccgccaccaccacaccacgccgctcgccgccctcgcggcttcctgccatccgcgacacgcttctcccgcaccgccgcacaccgtcaaaaaaatatcggcgggcgccgcgcaaagcgacctcctccccccttcacctgcgcgcgcgccgacgaggacacagtagcggccagccacccacacagccaccgcgccggaaaacgggctaaacaatggcgctc

SEQ ID NO: 40427 - DNA, 2520 bp, Oryza sativa
catgaccacaccagttataacaaagaaggtgggtgggttctgtatgttattcccatgagacattgttctgatttgtcacttctagtgattatggagtcagggtcttagcatgtatatgttgagaagttatgcatcccatttaatcgatgctgtcatttgcagtcagctaatgaaaacaagtggaagatgtcctttgtgatgccatcaaaatatggtccagacctgccactgccaaaagacccttctgtgaccatcaaggaggtgcccgccaaaatcgtagcagttgcagccttttcaggtcctaatttcatattctcagttttgtttgtgtacccatttcaacatgagcaatgctacacgtactaaatttttcttactaaacttttactaacaatcatctgaaccgtttgatttaagtagatggaagttacaaaaaatctagatgcactcatagcatgacacatcagtgttagtaagaatttagtaaaaaaaagttagtacgtatagccttttcctttcaacattgggatctcgatatgatttttgtcgcatttgcttatgaacctatttgtttttctaaaaatagcaatcttctgcttattggcactgccgttttcacatttgtaacctttccatttcctctgctactttaaaagcacaggtgtcgtccttcctttccctcccccaatcccacgtatgaaaaaccactccaaaaaaaatccagtgcaactaaaaaactagccaacagacaaaaaaaaaaacacattccccagatcccattgcaagggttgaaaagattgagccatgttcccatatcccgttgcaatgcacgggcacatgactagtaatgataaaagcttacctcttatccatcatgtgttctctggagaaatgcataattgaaactgatgagtttgcacagagcgacttgcatcattaattgtactatgtggttccatctgggaattattgtctgatgtaaattgtattgttgtttcccatattcgtactaatcatcaaaacaatctgtaatattagcttttccgttattataaaaaataaaaaaaataccttttctttttcaagtaatgagaccagaacaaggttcacccacttacattatcatcttatcagaaataatttagactttatgtttgattatgttttcaacatactacaaaatcacccaaaattcgatatacattacccctgttattttcaactttccttctcagtacagaaagtttgaaaatggcatgcatctctcatggtatttattatgttttgagctaaaggttaactctctttctttctgctaaagtaatataagttttatagatattgaaaacaccttgaaaacgttctttgttggttcgagaggatacgcaattatgtacattatgcactcctgccaaaatggcaatcatccactacactgacaagtcatcttttatactctatttgctgtaaaacaggtctggttacagatgatgacataagccagagggaatccagattgcgggaaactctccaaaaggactctcaatttcgggtgaaagatgattcagtggtagaaattgctcaggtaaatcttgctcaaaataattgatcaatattctaatgtcctacataaataagattgatcattgactgatcctgggttttactgaatctgcagtataatccccctttcacacttccattcacaaggcgtaatgaaatagcattggaggttaagaggcttgatgcaaacttctgatgacctagattaacaaataagttattagatttcagtgtatataaaaatgcacgcacctacaaatttagaatttcaatcttctctttgctcatattgtatatacatatgtatcgtgtatcagacacaaatttacatgattgtaaaattgaatgttgaagtatcatagttcattttgatattttaatttgtgtatggtattttttagcatagaaggccatcctgtcttaagatctctgtcacaaagctaaagtagacctttttttcctcgtacaacttttgtaccaaacctagaaagtcttttttacagaaataatgcgttcagcagagttttgagcctgccatatttgacactgatgggcatattttcaccaatttagcatgtagtacatgggagcatcagtaacagtaggatatatcattaattcattatggagttcttgaaggttcttagattggttctttaagctggattctgttttggactctgaacttgtaaagctgtgatctttatgcagaaattaagcaaaggggatatattctatcatagtatcatctaatgatttggcttgtcacttacatttacaggtgatatattccttatatgcgttcctatttccttgtttttatcgtgaactagcataaacaattcgcctaattgttgtcctagttggtttttcattttgtgtgcgtgtgcacgtttgtgtggggaaggtgtttgccgttcactggtcatgggcatatctgtacataggtgcttttct

SEQ ID NO: 40428 - DNA, 1025 bp, Oryza sativa
aggcttgagaacaataacctgctcacagctggaattgatgccattaaaatgtgtactatctatgaagcagatcaacactgtcgcctggcgttttttttttttgacatcattggattacctttctcatatactacacctcataatcagcatatgcatactttagctatttgctatgttggtgtcttggtgacatgcagataaaggataagttggctgcattatacttagagggctgtaaagcggagaaaggcgaacctcttcctgttggactcgtggatatgagggaattgaagaaaggcgcggataggtatttcagatacgttggatccctcacgacacctccatgcaccgaaaatgttatctggaacatttttggagaggtactattccccttgcagagtaatagaaacatcatgaaaacttcgtagtgagttatgtttttatactcactggcgcttctaattttgcagataagagaaatgaccaaagagcaggctgctgctttgagggcccctttgcacgggagttacaggcacaaccgcaggccgacacagccactcaatggtcgcaccgtgcagctcaattacatgtaaccccataacggtaatccaaaagatgctttatcctgcggcagctcatctatctgcagataataatgtgctttagtatgtacccaagttcaggaatgtcaatgtaatcggcgccatggactgcaataaaaccttgttcattgtcatggttcacatcattcatttttcttttgtgagaagtctccgaaagggagataacggcatggatgcagggaagacgaagaccctgaatgtatgaattctatgcataggaagacagcggcatcgagggaggacatgaccatgacctcataggaattgtttgatcttctttttaattgaaatgaagtgaggaatttagaatggaatagaagcaggttcgcttaactgttaatcacttgcaaatggaggaatttatcccttatggcttcttgttgctgcctgttctagacgagg

SEQ ID NO: 40429 - DNA, 4591 bp, Oryza sativa
atcctgcttaggataactaaaaggcaccacaaattaggcggatttgaaggaggacatcaacgtctttacaccatgatgtgatgttaatatgtgtgagattttctaaaaatcaactctttgtgtgatggatggagcattcgaggataaacattcaatcaattctttgtgggacagataagagtattaaaatgaagatatgccaaagtgtttaaagaaaaggagaaaaaaaagaaaatataagcatgccaaagttttagggattagaggatagaccactcaactcaacgagattaggggaaaaaaataaaaaggcaattaactaagcatgacaaagtttggaaaaggaaattagggaaaagggaaaaaaatatacatgttaaagtttcaaaagggggaattagggaaaaagaagaaaaattgaagtcaaagtttcagaaatgaaattaggaaaaaaaatagaagaaaaaagacatgtcaaaggttaaaaaaggatattagcaaaaaaaataaaaatgtcaaagtttcaaaaatgaaattagggaaaaaattaaaatgaaaattaggggaaaattttaaaaataaatgaaattagggaaaaaattaaaatgaaaattaggggaaaattttaaaaaaaataacaataagggcccatccgggttcgaaccggagacctcttgatctgcagtcaaatgctctaccactgagctatggaccctttgctgaatttattttggattttagtttactcaaagaaatttaatggcagtcttttctaattattgtgagatggtgatataatcaatgcaaatttcataaggtcactgtcactatactaaatagagcctatatttcttccatgacgactgcgcttacgcttgagagtggacttgatccttatccaaaaaggacaaacagaaacgcacgcacacaaaaacaagagaaaaggagccacctgaatcgaaacacagccgccagatcgcctcaaaaacaaagagaaaattccacgcgtgaagcgtttagactcgtgtccatcgatattgcggcgcgaaaagcaccgggcgtcctcctcccttcaacaaactacaaactacagtatgtatactattagagcaggtttaataatagcgcctgcggctggcgataattttttccacgtcagttagaatcaaactaatagctaacatgcacaataaataaactgtaacatatctgctcatcaatttatagatactattttcttctttaattatcttaccctctctcttcctttacttttctcgaccaatgactgtgattatcagcctctgtagtgcatagcagcgggcccacttctctcgggttgtgcgtgtagcccggcgactgtttagtcgccgacttatcccatttttgctcttctctccgcgccagctcagcatccaagccaacgtggcatttttatcgctggctttcatagcttattgcacctgttcttactagctcgtggaatacaggaatagcctcgtactatacaggaataaatgccattagcaaattcaacattagtcggccggtccactcattgaatagcttcgagtgtttcaagaaatgagtatatatcgcatttaagctctaaagtttaaaacggtgacataggctgtgtttagttggatccaaagtttggattttggttgaaattggagatgatgtgactaaaaagttgtgtgtgtatgataggttgatgtgatggaaaaggactgaagtttggatccaaactttggatctaaacacagccatagcttagaatataattgttgcaagtcattatatatataggacgagcgcgagattttgaaaagcagctaatgaggaggtatctgctgagtatatggaaaatgtggttttcctaagtttttagttatcttttcagattctgtttagaatatgggtgagagtatgaattatttgagatatcttgagtttctaggagaacctgtaattgcgaaaagcttctccgaaatctgtacatggctatagttagactatccaatgatcactagttacttcgtcggttatgacagaaggtagatgaactttcatcattgttgttttagctatggcaaagcaaatagatttagcaaagttcattcaattacaaattttagcattgatgctagtaaatatctttaaaaaatattgttggccaacatagaataactcatacaaaatcgacaattatttgtagacggagaaaccaagtttaattggtttcaacaatggagcatgacatctatcagtgttgagcctgcgcagctaccgtacgtacaagtaactaatctggtttaaaaatttgtgatatatcatgtcaacaaattatttactccctccgtcctattttaagtgtagccatgagttttcgtgtccaactttgatcgtccgccttatctgaaatatttttgtaattaatatttttattgttatgaatagtactttactcgtgacttatgtttttaaatttttttcaaataagacagacgatcaaaattggacgtggaaaaccatggttgcacttaaaatgggactgagggagtaccacataagcaggaacatattttagctaagtgagttaacgagtgagtggctggatagataaaaaaggcccccgcgttgccccacgcaggtgacacggccgtagcctaccttagtccccaccaccccttcgaccctcctcctccacttcgctgccacttgagggaccaagcgaaaaccgtacgacgaattaggatggctgcgatgggggcaaaagcgcaatccaatgcccagatctggcgcggagaaacgaggaaaaggcacaatggtgcattggcgaggagtcttggtgcggtggatagggtcaccaaagtggagcagtggcgtgttggggcagctgagatagagcgcgacggaaggtcatgactaggcctcctctgcgggcttggtggctagatttatatggatctggcatcccctcttaatcggctagagcaacacgagcaacaggcgggttgctatggcggcattagttttctggcatggatggaggccgtcaatattcatgcaaagggtttcggtgccaatgggcaaggtggaggttggtgcctataaggacgggcatgggcagagcatactagcatagtgaagtggatactatatgggatggagctgtccaacggcgaggagttgcacagtcagtgtcttgtcaaggaggctgagtcaatggtgaaggcatggagatcatcaaggagtaacagtggccggaggtggccgcaagaagtgggaggtggcacctgttgggtcgcacggggagacaaccgtcgggctgaacgatgaggaggtgatgggtgatgtgacttcaactcaagatggcagctcgatcagtcgtcacaacaggcacaattggtggatcagatggtgacggggtggttctctcttccatctgctaggcctcctccctctccttgagggcaagtactataagcctctacacacttgctcctgggtgccatgtaaactcacatgatgaggtggatgagagaaatgaagagagagagatgatgagccacctcttatgcaagaggcaatctctattcaaactccaaaagagatgagatcaagaggtcaataaattaataggaaacaaataaagtaaatttaatatggtgtattgggacaagtgtgctagaggtaatttattgtatatattgactcttaattaatgagttgatgatgtgaataagattgggaggctattagagcgagtacaataataggctacaagtcagctgtaagcacatgtggagtagagaagagaagagagagaaggaaagcgggctacagattcgtagccaactgcagcacaaactccaatatgtcgtgtgtacgagaggtgggaccatatattaatagtgtagtatatggttatagataactattgtatgaataagctattagattggatacagatgaattagagctaatagttggttgtactgttaaatttgctcttatcacccctactttaaaactttgctctgtaggtgttccccctctattgggagaaaattgacatttagccatattcaggatggggtttcgctggaatgccactcccgaatatggcttcgttataatgccattgtcaaatgaagccaacgtgctataatgccatttcaaccattttaactgatttccaaatgttttccatcattctctgacatatttgcccctagtcattttgttgactttgcaggggaaaggagaaaggggatcgatccccatccagtcgccggcggtggagcgtagcggcggcggctgcggcgacggggcatagctgcgagttggtggtcgccggctcctcgtcctcatcaccaccaccacgccaacatccgtcggctcgccgtgggcatgacggagagggcgaggagagaggagcggagctcgccgtgcgcgcgacggaggcgacgaacgtggtgaagtggtggggagttgcgggagggaggcataggggacgccggcgaggcactcgaggaggaggtcgtcgaggaggatggagatgggggtcggcgatgaggtgggc

SEQ ID NO: 40430 - DNA, 2709 bp, Oryza sativa
acggagaggaggaagacagaccgagccgtacggagaggaggaagacagagaggagagatgagataggatcaagggtattttggtcatctcaacaagaaaaaacattacaaaaaacattaaactgagaagaaatggatggaatggcattgcaacaagttacccctgtttgagggtggcattttaacgaaaccacttttgggagtggcatttcagcgaaaccccgttttgagaatggctaaatgtcaattttctcctctattggagggtgttcagacatccgttgcgaataaacatgaactcttgtcttcctcctcctagaatttaccttaaaaaagattagccaagtgaggtagtaattcaaacttcccttccatctatttatcgtgcagagtactcgatgcaaaaaaaacaagcagaaaataacacggcttggaatctcggggaacgaattaaacaaacgccattagcttccaaattaagcgacaatccaaccaacccgtcctgtcactggcactgtcactgccgccgtgccaccgtttttcaaatccccatctccaaaccattggcgcctcccatcacacccgcaaattacccattctacccctccattcctcacctcatctcacccctcttcaaaaccaaacctccatcaagtcttcgtctacatcacacactacacaaccaaagaaagaaagaaaagcgagatgccaccgcttactctcgattccctcttgcacggcggcggcggcgagccggaggacgagtgcgaagacgagttctccggttccgacgacgacggcgaggacggtggcggtggttctgaggaatggggcggcgacgttgatggcgagtatgacccgtactccccagcggagtcgctgtggctcaggatcggggaggacatcgactggagcgaggtcggggcggtgctggagcgggaggactccaccaagggcgcctccaaccccaagtcggccgcggcctgcagctgcgccggcgcgccggcggcgaggatgccgacgtgcgccggcggaggcgggacggcgaaggcggtcgtcatcgcggggctgcccgcggcggcgcggaaggcctcgcgggagcacgagcggcggcggcggctcggccgcgcccgagcccgcgcgcgggtgttcgccggggacgccgtggaggtggcggagcccgggtcgcccaaggtgtcctgcctcggcggcgtccggtcgcgggcgcgggcgcaacagccgtgctgtcccgccgcggcagctgcggggagccgccggtggtggtgcgcgccgtggttggtgagcgccgcgtgccgccggtgctggagcgccccgccaccgcgcgtgtaggtacggtggtggttgccggtggaagcaaaggtgaggcgtcgccgtcgagttcagaggcaatttggcgaaggcgacgccgcgacggcggacggcggggtcaggggtcgtgcaaccacgtacgcgacggctgaccggcgaaacgtacagtttggtcaggaattgtgggcccacctcctcgatgaatgtctatctgctttaagttccctgtgactgtacgtgaaagctgagtacggtggccgttcaaattggaattccaatgggcctcgatccatatgcctctccaatgtcacgctctgttttgttcatcttttgtgctaaatgtttcccaaatgttgctgtacaaatgcattgatacgaaattacagaaagaggtgcacataatacgccgccttatcacgagaaatatttgcatatatgtcattgtaaaaaagttggcttcgttcatatgcatcacttaaatgagcttagaaaaaatatcactctcaatcgaggagtcttcgttgaaatgtcatcctgaactattttgtcattggcctttttctttctcccttcgacacagacctcccttcgacacataaaaagctcatcggcagccaccgcaagctcaataccatgttaggaccttgtttgtaatatgaaggaagcattatattcggtataacggttaataaatataattaaaactcaaccataagggacggaaagttgtcattttcttatttttggtctttgttatgcatagtggctcgatagtacggcccatttagaagacgagaagttactactacaccatccgtttatattataagtcgtttgacttttttctaatcatttttttttcaaactttgatcaagtttgtaaaaaatatactaattttttaaatacaaaataggcatattattaaaatatatcaatgttaaatttaatggaactagtttagtaatcgtagatgttgctattttttttataaattcgatggtacctaaactgactaaaaaaaatcaacgtcttataaaaaaacggacgagcgaaaaaaccggacgagcgagaaaaaaaaaccgtaaatgtctgataaaaaaaagggcgaaaaaataatccgattgcgtgtcaaaaaagcgaaaaaaaatctctatctctatctctgtctctactacttaaaaaataataaaagatgtttccatcgtctgtaaaaaatagctaaaaaaaataaaaaaaggtctgactcctatccgattccctctcagaaacagaaaaaaagtccgactatagatccgattcttaatctataccgtgatatcttacacatcttggtgaaacaaaatgatgagcaagattaaagatctgtttaataaaacagaa

SEQ ID NO: 40431 - DNA, 2863 bp, Oryza sativa
ggcaaaaaaaaccgtagatctgaacgaaaaaaaatacgattcctataaaaggtaaaaaaaagtgaaaaaaatgctagattcgattcctttaaaaacaggaaaaaaagtcggattcctataaaggcgaaaaaaaacagaaaaaaaatcttaaaaagtttgtccaattccctaagaaagtggcgaaaaaaatggtttgtaaaaaatagaacgcttgttcgtataaaataaaaaatacacacatgaaaaaaaaaatagaaagggcgaaatttctaatcaatatatatctctactctatctctaatataatctaactatttttaaaaaaaatgcacgagagaataaaaacggttcaaacaaacgcgtgagaaaaaagtcagaaaaaagcaaaaaaaacacgctaaaaaggttttccatcttccataaaaaaaataaaaaaacgcgcgagaaaaattatttccatcgtcggtaacttttttaaaaaataaaacatgcgaggaaaaaactgtcagaaaaaacgcgccattttaaccaatggttttaaaaaaaccgcacaagaaaaaaacaccgtctattaaaaaaatcgctctgagtcggataggatccatcgattttttgccatctactacacggcttttatttcgtctatattctcttgtttttaaaaaaagcaacaaaaataacatttgaaaaaaaacaagcaaaaaaacacgcgagaaaataattggcaaaaaaaggcaaaaaacacacgagaaaagaaaagcaaaaaatggagaaaaatatggttttcgttataaagaaaaaagcaaaaagatcttgttagaaaaaaaaacttttagaaagaaatgcgtcatttctgaatggtttgagaaaatcgcacaagaaaaaaaacaccgtttgtataaaaacaagccgctcattaaaatacaaactcattaaaatacaaacattgccattgacataattattcatgaaaaacgtatattatcattagaattttttcacccgttgcaacgcacttgcatttttgctagtaacatataaaacgagggagtacctctcgcggtaagtactttttgtataacggcctttccggctgttgcaaaaaagggcggctttttttctgaaaaaaaaacctactcaaaagctgctcttagaaaaaaactgatccagccgtcaaaccggcaatcactcaatagattagcactcagagcaatctctcattatccaccattatttatgtagtttcaactgaacattcacacaagttcgaaaaagacatctggaatttacactggcatatatgatgcgtcacaacacaagcaggtacatttcccttttacagagtagctcctactaattcacatcagtaaaataaacacaccccaggggcatgctgttatttatttcttgactcctttcccactgtacagaaaaaaactttaaaagagtacttagctactagtatctgcgaatcaacatatcagaagcattcaaacagaacaccagcaccggatcgtgtgattgatcatcagtttcactgtcacccagcggatcaggttgggcgagcttccccgcccttctgcaatcagccgcgaaaaaacacaagcagaccgtgtggatcagttcatcattcattcataacccagaaattaaccaaatactcctaagttggaggagatcaagaccggctaattggtttgtttttaatttcaccttatcccctttggcggcggccgccctcttcgctgcatcggccttgtccttgtccgccttcctcctctccttctccagcttctccctctccatcttctgctccaccaaatcatgatcaaattcgacattcaaacgtcgtcagtcacaaacagcagtagcgatcaatgatcaggtgaccaccaacctgtatgtagacgctctcggcggcgcgctcctcctcgctgagcaccctgccggtgccgtcgctgaagtagcgcgccacgcgccggcctccctccatcctcctcgccaaaactgccgccgcccacgcgggttgatgaggcgccaccaccctcgccacggccgttcttgtagccatcttcttcttgctccccaagaacgtcttcttcttcctcttcttgctccccaagagtagagtacgacgacgacgcgtggatgatgactcgcgaatcgcgatccctctcgggagcttgccgacctcgacgtgggggcggggcgcccacctatttctagttaggtttttcactttgtcagtgtccgtcggatgctctcatcctgaccattttgcggcgcgaaaccgaagataaggatgggaatatgggattgagatgagaacgccggaactaaccggataaaagaaagaaagccaagtggtttggaaagcaactcgagtagtctgggcctaaaccatcctagtttgggcctcccggctcccggcccggccaaacccgatccatcggaagcacgcgaggcgaagtgattcgtgcagcgggttccaccaaccgcgcggcggatcggacggtggtgcgcgcctctcagccgccgagtccacggcgaccaccgcctcaccaacccacgcaaccaatgccatgtgaataacagaataagtgcgagtaagtgagccctgcggcgccgactcctttttttacgctcctctgccatttccaccctcttggagttggaggggagcacgcgccgaagcgacagcgcgaggtcgagcaggtgaagcgagtggggagggagggagatggcggggggcgggggcgcggggagtaaggtgtcggtcgccgccgtgcagttcgcctgcaccgacgtcgagtccgagaacgtcgacaccgcggagaggtatgttgtccggtatccctaaccc

SEQ ID NO: 40432 - DNA, 2710 bp, Oryza sativa
  unsure (1)..(2710): unsure at all n locations
tttgagcggttctcgttaactgagtcacaagtgacctatattaattcccgcaaaaagaaagtaacctacgcaattgagttcattttcgccatgagatggctacactgtcaacaaatttatagcccgagcatactagaagataaaaaaaaagaaggaaaaagatagctagagcagtacctcaatcccttcctggattgcacaaactgttaagattgaatctgaagctatctttctcttctacttggtcgcaaagctgtgacccttatgccagttagtgtttctgattttgcagaagccgttgccgttcttttcacattctactttattcttttctcatggagatatctgagactgttccctttgttcattcaattattgaggcaccttccttcacattgtgattgtgttgtgtaccttttggttctgtgacgctgataagaataatgcctcttttttttttttaactttgtcacatctattgctatcattaaaccaaatagaatggcaataagttatacctctctagttaatagcttatactaaccacaaatctgagttataaacttttagttacatcattattgtagttgtaactctgacttctgactacaccgtgaaaactgaagcatgtttttcgacataactttcaataaattaactatatcaatgtacaccgagtcaactttccttttcatagcaacagagaagttcaatgccatttggaatttattttgtggcactcttgtggttaaaggctttatatttcaatattgaccaacttgataggctgcgatgtcttattttcttgatgataaatgtgaagaaaagaaacccaaaattgtttggcctgatcatcttactctctctctctcgcccccctacgtttctttcttataccttgagttagtaaataccaaacaaaccagagattttgctgaggagatctactgaaagtaaactcattcagggctttattattcatattgcaggttgataagagaagctcataagaaaggagcaaacattgtccttgttcaggtatatttatatgatacatatatgtgtgttcagtgatgttgacaagctgcaacttgcaatgcttgttttgaaaattgaaccagaaagagcaaatgggtttggatgaatattcttatttgcaatttcgtttaaattgttatgttttgtttgattcagttcagggcctaaaaagattaatggaatgatgattatgtgcactgaatctatatgtcaatgctttaggaactgtttgaggggcagtacttctgtcaagctcaaaggttggacttctttcaacgtgctaagccttataaagggaacccaactataatcaggtaggcttgcctcattacttgattcttgtcaggagtccacaagcaatgtatatgttctatttctgtagttatccctatgcttcattctttcttgttcgataggtttcaaaaacttgcaaaggagctggaagttgtaatacctgtcagcttttttgaggaggcgaacaatgcacattacaattcagtagccattattgatgctgatggcactgatcttggcctgtaccgcaaatcacatattccagatggaccaggtattgcccatgtatagtttatgacagattcactatagactagtcatggactatctgatttaaacaagttagctatttcctttttggctaggttatcaagagaaattttatttcaatcctggtgacaccggcttcaaggtaaacatggttttatatttatatcttgataggtttgcacttgttagtagtaaaaattcactaggtgttaatgtgtaattggtactatgcaggctttcaaaacgaagtatgctacaattggtgttggtaagttatttatgttgttcagtgatattaatgtttggttctgaaagagcatgagcagggtagtaactaatgcaatatcacctgactatcttttatcgctaaaccattatcctggtaggaatttgttgggatcagtggttcccagagtgtgcaagggccatggtgcttcagggggctgaaattttgttctatccaactgcaattggttctgagccccaggataataacctagattcccgagaacactggaagcgcgtcatgcaaggacatgctggtgctaacctggtactgctatttgttttgttataccttatgttttatcagctactcagctttattgagaaatcaaatatatacctatttttatttacgatccttcggtagtttctgatcattctggatccataccaatcatgcaggttccccttgttgcttctaacaggataggaagggaaaccgttgagactgagcatggtgaaagcactataacattcttcgggaattcattcatagcaggtaatttcagcatcttgttcttttactgctggatgtgtaacaaactaaaatcattagcatatggttgtgcagggccaaccggtgaaattgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40433 - DNA, 803 bp, Oryza sativa
tacatattaacctatcatgtcaatttttttgaaaatttttcataactatttagatgacatgtaagaaacggatggacgtctacccgagtgtttaaaacagtttcccctataaatgtctcaaactctcacccatatgattggaggcaaatacagtaagcaaatactaaaatgataaaagaaggttcagatgcacgagtttcacctgccagaagaagaggacaatcttgctgggcaaaactggacccaaccagttcaaacttcaaagcaagattggttttgcgataataagaaaaccggtttcattgtgatgtccagactctagcggttgttcccggcgaacagttcaagtcaataccatcctgattctcgcgcgccgagactttagaatataactccccaggtccagcgcaatacagtatatgtagctaagctgccggctgctgcatgcgaagaattctcactcgccggccattttttcgcaatgcccaatcgtttcctcgcggcggcatctccgcgctcatcgtccgcgtcgcgtcggtctccgcgtgcgtgcaggtgcattccgggcagacgagacgactctgtcctagcctcctcagccgcgagccaaaattcagaaaaatccgcaacaattaggccctgagccatacacgctcgtacgatcgagttaccgccggcggctggcgtgccagacagacggtagtagtatctcatattctcacgtctcacgatcgcaagtgtcaactgtcaaggcagcgaagtcaagcgagacgctgaattattccccggatttgtcagcctgt

SEQ ID NO: 40434 - DNA, 1067 bp, Oryza sativa
tatcctacaagtgtcaacataaataaggtcaatgtttgtctttaaatacctctttttattaggcctcagcaactttatgtccacatcagactatcagagaagcatcatcaactgaccacttaatgcagaagttgtctgagagtcgaccagatggtgagaagaaggatgaagaggcccaaatgcgccgtcaggtaaagcaatctattgctatgattcatcatgcatcttctttaggttcaaagggagagggggttgatctagctttgaatggttctataagtacattttttttaacaaactaaatagaagcttttgccacagtattctgattgtgaacttttggggatgaattatttatgttggcaaatgtaagttgctcatgctcttacgtgtgattgttcattctcttgtgtatttcaggaactcaaggaagtattagaaaaacagaaagaattgggttttgaactccctgaactaccacctggctatctatctgaacatgaggatcaaggcaatggtaggagaagtaactggaaaacacaacgcagggattgtcgttttggaaaccgtgctgataacaaaagatcaaggtatgaccgcaatgattttcagtctaagagacccaaggtacggaaccaaactcattgtgatgatggggcagtgctcaagagcagggagccaaccctcttgcagaaacttcttagttcggatgtcaagagggacaggcataggcttctccacacgttcaaattcatggtccttaacaatttcttcagtgattatcctgataagcccttggagtttcctagtgttaaagtaaaccagatcgaacttgaaagcaacattgctgaagaggacctagatgacttgatgaacagcgagacggcaaaggacagcatccttgatttgaaggaaaatggtgatcagaaagactcgagctcaattgatggagaatcagacctcgatgacgacaatgatgatgaagatgaagaagatgatgatgatggcaatggccagtgctgagagcagcgacaaggatgagaacgaggacgtcgatgcagggcaga

SEQ ID NO: 40435 - DNA, 1880 bp, Oryza sativa
tttcgatgaaattcaccgttggatttgaccacagtgacccgtgacgtctttgaagagtggatctctgattctgtgtgtagtgtgttgggagatttcttcttcacttgctattggttcagtataaatgtataatgtactaacaacagtagtagcaagtttgatgaagcctgaaagacatcacagcactacagctagatttgtaccactgcgggccactcgggagaacgtacgcacgctagaattttttctggtatctacagaaatggaactgattccgtatagtagtagaaatgtagcatgagaattctaaccgggcgcgtacaaaatcgcagtcgtgctcgtctcatcccgctgtatataagcaggcgactcctgtgtacccgcgcacacgcaaaccatttgcatttgagccttttgcttgccttctctcctgtcctgactgcagcgagagatcagtagggagagggcaatggcattgacggtgcggctgcacacggcggtggcggcggtggccgtggccgtggtggtggcgatggggatggcggcggcgcagatgtcgccggcgggggcgccggcgccggcgggcgggatcagcccggcgtgcatggacgcggtgctcaacatgtcggactgcctgacgtacgtgatgaacgggagcacggcgcggaagcccgacgagccgtgctgcccggagctggcggggctgctcgagtccaagcccgtctgcctctgccagctgctcgccggcggcgccagctcgtacgacatcagcgtcgactacaagcgcgccatggcgctcccgggcatctgcggcctcgccgcgccgcccgtcaccgcatgcgcgcgtacgcacaattactccatcgcctctcttttgctcctcccttttttagttcgcttgcaagggtttaattctgcctagcatagttgcaaaccgtggattttgacgaatagtagaacgtttacttgcgtattactagtactagtaatgtttttttgggaatactcaaaagatttgcgcatctttgtatgaagagaataattacagctgaacgagaacacagaaaaaataattaatactccctccatctacttttttttgatagtcatattttatcttggcacacagaccaaggataagtaattctacttatcatccatataaacatgctactagtcattccttataaacaagcgattcactgatatttacgtttctcaatgcgcatgtagccaatcatgtgtgtaagaatggagagtcatgcattaaatccgagaaagtcattaaaatgataggttgttgaagtgaaatatgcttatcaaaaataaaatttttagatttggaaatatgactatcaaaataaatggagagaggactattaatactagcaatgtgcgtgacacaacaccaaaagttagaaaggagaacaacttaaactgcatctgttctttgttcacatcagtctgtagctagctaggtagcttagctagtggaaatgtgatcaccctaatggtttattaccctgtccaaagctccaaatatcatttcactaaccccaacagtatatcttaccattccattcatcgaattttactgttttaaagaccgtataaaattaacttttggttacacacaaaatgcagttcttggagtacctgtgcctatggcgccttctgcatcgccgatggcaggcctcgggccatctactgaaccacaaatgcctggtaagtactactgctcatgtgctttcttggttcagtttcatatcatatatgtatattctgagtatccaggctcaagaaaattctaaacagctcatgataattaattgtgctataacaaacaataaacggagagaaaattggcatgtcttaactta

SEQ ID NO: 40436 - DNA, 1527 bp, Oryza sativa
gttctgtagttgagcagtgtcattgtaggctactacagtgctagggatcctgagtcctgacgagtcagcctgtcactagtcacacatttgcttgatcagctaaactctgcttctggcgatgcatttctgcagagaaatcgccgtcggcctcgccgtccgagtcgagtaaccatgctcccggccgcttcaccgccctcgccgcggtggtcctcgccgttgcagccgccgggatggtttagaaaatgcctggattttcggccgatcgatctcaagatttagcccgacgattcttgtttattcttgccacacatttggctgtgtattaatttacaacacgttacagtacgtatgcgcaatgaacgatatttttctgctttgctttaaattcttataattaactagtaactcttccttgtcgtaagttgctagagcatatggtgagactatatgtacacacgtagtgatatctggccatccgcagtagctacttggggccttctgttaattattttcagtgtttaaatgcttggtttttggaggcgaggtggagaggatttttggaaagatgtgagctggagatgatcaaagtgtggggaaaaaaagcattggattcgccggtcggcaatacacggcggccggccccgatcggccgtaaggcgctgtaggttcatgaatgctaagattccgatcccttcattcaatcgcttcccaactgtttgagaaattttggttgcgtctcctcgtggcgggccatgtgatttccggttgctcctctccctcccgtgcgtgtatgtagggacgacgcacggcacgggggctggatggatcacgggatcaagcggatgaggcgcttgtgatctcgcaacaaagagctctaccaagccgtacgtccgtcgctagccatcgtgccatgccatcatgtgttccgggatccaaaacatgtcgacgccgccgaccgtacgtcgcgatgcgctcgatcgctgcgggcacatgtgtcgctgccagcttctgctcgatcatgtccgcccagcacatgccccggcccgttcgcgcctcggcttcgtgcgactgttcgtgggcacccgctcgttcgacgcagacgctgaggcggcggcgagctccgcactggactccgcgggagcgccgaagcgtcgtccgcgcctccaccatccggttgcagatgctggcaggctgaccgctgacggcggcaactcgacctgctcacatgctgctgaggccgcacaccgccaggacacccaccgtacgaactactccctcaatctcaatatacagtaacctaagataaatttaattttattctagaattataaatctgaacattagatttatagttttatgatgaatctaatcgtatcctaggttgttacatattaggaagttgaaaacgatataattcctgtggaaacaattctcgattggtccgtcagaaattcttggttcttcatgttcatcaatttaacgatttagcgacaacaggacaataacaaattaaaaaaaaatcaatat

SEQ ID NO: 40437 - DNA, 1528 bp, Oryza sativa
aatagtaattgtttctcaggtacatgatattgctattccagaaaaaatggatcattttcctgcaacaagaaatggaagttacctgatccctttcaaagagaacatcccaattattttccatcaaaaaatttttggtatctgcatagctcagtgcgatacgatagttcagatctccgaaccatatcaccttactgaaacaaacagcgtatagcttagaaatatacgcttgacaagatacatatatttactaattacaagcacactaaaagcacattcttactcatgctcaagaattttctctgggatttttcgcacacctctcctgcaaatccttgaaaacagtgtaagcctcagtatctcaagaacatcagagttcctccggaattcatcaccttctttctgacctgaagccaaatggctgcagatgaaacaaaagcttgtctggtgcagtgtcatgctcactgatatgcatccctgcagaagaagtgtactcagaaaaagtacttacaaaagcacttcaaactgatattatgctttgcttctgaccttgtttccaagacaacccagaattcctcgccctatgcaagacgttcttagatgaccaatgtgctgcactagttccttcttcacccataccattacaaaaatgccaaccatttgtttacatgctataagattatattttagttcatcccttgcggtgggaggagaaattacttcactgcgcacagatccattagaatcccttgattgccctttcttttcttcccgttcatcctcttctgacgaatctatttcgtaagcatatgctttggggcaaccaaagcaagcatccctgtaggatgatttggccatctctacagggcagttgcaggccttaagccgttttcgatggactggcatgaaggattttctaatggattttagattagacttctggaagattgtggaactacttgatgtttttgctaggtcagagaacgaagtatcgaggcttgaagaagctcgagagacactagaatcaacagagggagatggctcattctgaaagacattggcattggtttcagctggccggtttaatgcttggtttataagaacaagccatctggcagctggttcgttgtcttctattacaagcacattgccagcattgagaggaacaatttcctgaaaactgtttaaagtttaaatgttacagaattgattagatgtgaacttgaagctacaaagcaaaatatgattcactgatctgaatacaaaatcaatgacagtttttaccacagaggaatcatggaacttcctttctttacctcgttcagctatgtatcaaatactagtatagtcttatatgtcaaagccaacattcaagaaattaacatacatggagaaagtcggataacatgaacagaaaatttagtaaaattgacaaaaaaaatattttccacgtctagtatattaagaaaagggcaataaaagacccaccccaaaacataaatatctgaatgatcatcagggggaagaaaat

SEQ ID NO: 40438 - DNA, 1698 bp, Oryza sativa
ctgaaccaaccggtgttgcaacttggtttgtctgttctgtttgagactttattctcctttgctccgaaaagttttgggcgacaaccctggaacacaatcctattttctgaaggcgagtatttcatttctatacataaagcaaccgtggaaatgtaattagcaagtcaccttcattttttcctccccagtgaaggccattaatcgctgaagccggttaaagaaccttttttgtttgtcagtttgaagtatgaacacgagcccagtgcatcacaaagaatctgcaagcagtacatcatagttttcatatataagtaaaatgccaccaaatggacaattcaaagatgaaccatgcagtaattgaaaaaaaaaagcgtagcgagaaagcggttaagttgaacactaaacaagtcataaaaatccaaacttcagtcttggtctcatttttggaaatcaaagttagcaaacacaaatttactcctgtactagcagtaaaaagaactaaaatagaatgaatggacgatccatatatcacccgctatacaaagaaagaaacaacacgagagcacacacaccaaccttcacaactgaatgaaaccgaagttcttcaaaaaccacacgccacgtcacacgacgatgcaatcttgaatccccccaaacctactctccagtgcaacaatcccaaacgcacacaatgcaatgcaacagaagatatacccacctcggctcctctcccccacgatccaaaaaccacccaaacccaccccccaagggagcagcaccgcagctaccgatgcccctgcccgcaccgcagccagacagccaggagcgcgcgcccttcctcctacctccacccctgctaccatccacccggggatcccggcaagaggtcggaggcggccgaggaatgcacggccattggggcgagggcgagggggaccccgcacggctccgcgacgaggatcctttaagcccggggggagaaggagaaggagaaggaggaggaggagacagctgtaacggaagtagggaatagtttacacacgggctacaagcctagtacagcggattggactgtgggagaatgggagcggggaggcattcgatccgcgcgtgtcgcgaactcgcgatctctctgcatttgcctggagcgccgggggctgggtggcgggtgggggtggagttgaccggggatgggcgatggcgagtttgaggggtgcacgtgcggtggtgcgggcgcgggggcgaggaggagttgagttggatttggtctagggggcaaaatgtggggagaaagtgggggtggggggggaggagtaggacgcatgtcagggagggggggaattgttttttgggttgggttggggacgcgctgtttcgacgtgggggagcatcgtgttcccgcaaagtggcggatcagccccggtttagccgggtttcctttaccgttttgatgaataggagtatcaccgttacccagtggtaatcacagtgaaaaaccatggggggttaaaaactgatataagctcaccggccgccgccccttaccccgtcggcgagctacttgggaagaggaggacgatgaggggaagtagaaatttgatgtggccactttcacgtagatctatctcatgttgattaggatgttatatcagcgaaatcaattcataccgcaataagatctaatttaacccgattttg

SEQ ID NO: 40439 - DNA, 2762 bp, Oryza sativa
cctcctcctcctcctcctcctcctcttcctgcggcgccgcgccatcctacgcccgcaacctgttcgaccaaatccccgagccgaccgccttctgctacaactccctcatccgcgcgctctcctccgccgccggcgccgccccggccgcggacaccgtcctggtctaccgccgaatgctgcgcgccgggtccccgctccccaactccttcacgctcgcgttcgcgctcaaggcgtgctccgtcgtgccggctctcggggagggccggcagctgcattcgcaggctttccgccgggggcttgaaccgagcccctacgtgcagaccgggctgcttaacctctatgccaagtgcgaggaggttgcgctcgccaggacagtgttcgatggcatggttggggacaagaatttggccgcgtggagtgccatgatcggcgggtactccagggtcgggatggttaacgaggctttggggctgttccgagagatgcaggcagcagatgtgaacccggatgaggtcaccatggttagtgtcatttcggcatgcgccaaggcaggggcgcttgatttggggagatgggtgcatgcttttatcgataggaaaggtatcacagtcgatcttgagctgagcacagcattaattgatatgtatgcaaagtgtgggttgatagagcgggcaaagggagtgtttgatgcaatggcggagagagatacaaaggcatggagtgcaatgatcgttggattggcgatacatggtcttgtagaggttgccttgaagcttttctcaagaatgctagagcttaaggtaaaaagatcgttttactgatgtatctgtagtgactgttaattggttttggtgatgattttttcatatacatttacttggacgtgaaaatgtaaaacccattaaatatgggtgtcaaaagaaactaatttatattcgcaatgatgtagttccttaaaattcatgttctttgtttagcatatattttgtcttttgtaccatgctaccataaaacttagctcatgggtgcaaaatttgttggttccatacatgatatcttctgggatagtgacattgctacatgaaggtttgaaatagggagggttttgcattcgcgaaaaatagggagggtttctacattgtcctctatgtattagttcacatgttcaacttagtttccaacaaaatggtagaattcatgcagtctttacaaatatatggtaagtctataaccattctaatagctctaattaaattcttgtaaactgcaaatatgtcaggtgaggcctaacaatgtcacctttataggtgtgttgtcagcctgtgctcacagtgggttagtgaatgaaggccgacgatattggtctactatgcaagaattgggtatcaaaccttcaatggagaactatggttgcatggttgaccttttctgtcgttctagccttttggatgaagcatattcatttgttactggcatggctatccctccaaattcagtaatttggaggactcttcttgttgccagtaagaactcaaatagatttgatatagtgcaatcagcatcaaagaagctccttgagttagaaccttgcaatccagaaaactatgttctactctcaaatttgtacgcatcgaattcccagtgggatagagtaagctatatgaggaaaaagatgaaggaaaacaatgttaatgttgttgctggctgtagttcgattgaaattaatggttaccttcacaagtttgtggtgagtgatgattcacaccctgaaataaaggagataagactgttactgagggaaatagctgaccgtgtggtacgtgctggccacaagccttggactgcagccgtgcttcatgatgttggtgaagaggaaaaagaagttgcactttgtgagcacagtgaaaggttagccattgcatatggtttgttgaagacaaaagcgcctcacgtcattcgggtggtaaagaatttgagattctgtccagattgccatgaagtagcaaaaatagtaagcaagtcatatgatagagaaatcattgttagggaccgtgttcgtttccatagatttgttgagggaagttgttcttgcaaggacttttggtgattcctcaaccgattgaatattgtcccacagctgggggtgagggatgtggcgttgaaactctttggagtccatcaccaaacaataatgactactgatcactgagcataatttggtatccagataaaaaggaatcctggaactgactggaccctcttgccctgatacaagtatacaacctctcaaggtattgaactccacttgattttactttgttttttatgcaatgttcgttgtcttagtgctgctatgaacgggaaagaaatcatattagtgatggagtagatgttctatgcaaccaacagaacctaaaaggagaaggctactttcctgctattgtttgttaaaacgtgcctatcatggtttgttgtccatacattaatagcaacattggttgcattatgcattacacaacttatgcaagttggtcattttaaacacttaatttagttggatacgtacgcaattcattgtttggttagtgtttgtttgttgctttatgccaagtagacgtcacggcaaaagcattaacatagcagttcaaaacattaacatagcattgccactaatcacatagacatggaccacatggtgcatccaaaaggtaaaaagatcgttcagagcctcagagccagaggtcggaactgtggaatgtcat

SEQ ID NO: 40440 - DNA, 1509 bp, Oryza sativa
aagataatgagctcgagtatgcatacatacttcgagcgacaactttcgataacatctcttcggatgttcaacaaacggagcaaacagtgtaacaaagaacaagacacgtggtcacaaatcaaaataataaaggcataagcggtaaaagttttgcattttgttgataaccaacagcttacgagttggatgtatcaacagatgattaagaagctagctggttgtgactccatagtgagaacatccccttgtactttgcagccacaaactggcgtgacagaaagctcaaaggctgctccttgcagcagctggagctgcgtttgatcggctccaatgtcttcagcacaggaacggtccctgcaagtgatgcactctcagatgtcaccagcggagatagcttgctacaatgaggaacggtagggtcagttctgctgccgctagtgctgttgtacacattacgatatgttgcactctcagacggcaccaacggagatagcttgctgtattgaggaacagcaatgtcgattctgttgccgccactgctgctgtacagatcacgatattgagcagcactagcatcagtatttctgctgctgctgctgctgccgacgcttacaccaccaacggtgttgcggtaggaaggtttcctgtctcttttgtggttactgctgctgctgctgctgctactgtggcgagaatgcttcctgtcctttttgcttccactgctgctgcggctgctactgctcttggccggcttgtatttgtagtggctcttccttgaacttctttgatgccccttcacagtgtgagacccagaagtaacaggaggatcatatacatcaggggcccatgaaacactcaaacttgtgacgattcccaactttgcacggcttcctttcattgcagaaaccaacggtggagtgccctgcacatgaacatatatgtgatgttagaaagcacaatttggccccatcttttatgggaagaaaaaaacacatacagcccactgagatcttatggtcattgatgatttcaaataaactcaaaatcaagtggaatagattttgatgggacatgatacaagtggcatcagcagttcagcacaacaactgaaactgttcatccagtgatgctatccaattcttaaagcagaagtgacaacatgatataagaaggcagtgagattttaatgtgcttattaaaaaaatgctaaaagaaactgagtagctattgcaaattaggtgcgtagatatcacaactaaaacaaatacaactggcaaggtatattgaacaagttaggttgaacaaggctgcagtcaaatacttacattaatggaagaatttccagagtctgatttgttgattgatgattcagatgcattgcaactagaaaaggtaggcgatatgaccaattcattatcaatatccactacatcatcagtggaatctgattccagagaaagtagaccctcattttcatcaaagtcttcacccgaatctgtcccttcatca

SEQ ID NO: 40441 - DNA, 7663 bp, Oryza sativa
aaacgggttgaagttagaatgttagatgagagtctgtgtatgcggttataatgacaagaaacactatctaatttagttaacacagctttataagaccattttcatgactgcaaacgtatatttgacttaaatagcaagttcatttaatttgaggaaacaggtatagacaaacagggcatttaactgcttaaatgtctatcctgttctatctctacaaaaaatcaagcacaagatttatttgcccatcaaatacaagggtaaatataagaatatgccctataatattggcatgctgtgaattacaaggcaataaatagtgagaacataaatctatattctaatgatcaaaatttgaaatagaagcacatttcaatgaaataaacaccataacatcaataacagcgaatggcaataaattgggatcgttttaatacctctttcctcgaagaaccagcaatcaccacctccaacaaggccgactgcttctgatcggaagcaggaaagggagagatcggatcgagcacaaccaaatcgaacacgagaacgcgaacggcgcgaagtgaggaccgaggggcgtgagcgcgcgacgatggggaagcaatcgttaaagataattactactactaaaaatattactactactactaaaacacggggaggaggggggcttcaggagatgggagcagggggaggagtccgcggaggcgatggcggcggccgcgcggaggctggcgaacgcggcgagcaccgcaggcatcgtaacctcgcctggcgctcgcaacgctacggattcctatccctcggagatctccaactcgtcggattccggcgaccaaacaacaaccacaaccacaaccacaaccacccccgcacaaaccagatcggccggcccggcgagcgagggttccgcgagggaacgcgcttcgcggatggatctcaccggagcttccccttgaatccgccctgctcggcggcgacggcaacggcgacgacgaaacgcggaggatttgcgaatttgggggagaattgagatcacggcgaggcctcgcgcggattggcttctggggtggcgagaggccggggtgaggaggcggtcgttatatacggcccacctgacaggtggggcccacgttccccttggtcccagtacgcggcgggatatgcgactgggactcggacgcgggggaggggaggtgtgtattaataggctgcctcgatgacaggtggggccacctcgcagtggggctagagagaacggatggccgggtcaaaggcgcagcaggagggtgcggcacggaaggcggaaggcgctcggcgccacgtcggccgcggtgagttttttggaggatggatttttggtccagggaaaactggtgatgaaatgaatgaactgcaacaaatataggatcggacaggggtgcttttgtttcccatcgtctcctgttttttttttcctcactaagctcaccacgtcagacgcatgagctgatgagcatgaaattcaatgtctctggcgtgtgtgcaaagtagacttgatgttgttatctgatgatggggagataaacggagcttatcagctttaaagatttcattgcttttaagatttcagtttgcaatgcaaattatgttttatgtgtacaaaacaatcacgaccttccatttctacaggcagaaccttgctggagggtacaattcggaagagttgattgacttgtatacgaagtagcttacagaaaacaagcttccacgtacttaattaattgcatactaacattttgaaactgaaggtaaaaaaaaagggaacatggtttgcttcatgtgcatatctcttcaacccaaaggtcagcggaagcaatttgatcagatgtatgtcgtcctgctgccctagaacagctgaccgcccacagcttcgtgaatgacagataggcaccagcagcactgactattcagctatggtataaacagctggccgctggcggctggacggtacacacaccaccatgagaatagattctttcagcatttgggaaagatcaatggagcttcctatcaacttgcctggcaaggaagaggccaatagaggaccttttttcctctctcttcagtctttttgcatttgccatggttatatcagtggcatgcatacctgcacgtagaaacaaaaacatcaggagaactttgcctttgttgtgcgaatctggaacggtggaatcgcatcatgtaagcacaaaactgaactttcagaaaaggtggcatatgcttccttatgaactgttatccactccaatgatggcaataatagaacaataagtatatatgcatgtaaataacaaaacaagagagcaattcaggcaaaaacattactgctccgttttaacaagattgggcctcttagtagatacctgcaaacaaaggaagatcggacgaaaggttgcacaggcaaacttgcatgtcttactttcgtttctttctctttgcttgtggctcattggcaattgaacttgtatggctactctgcaatggatgatatattgctctcttcaatgcttcctcatactcattcagtttttccttctccttgttctgataatagcaacaaaaacacaattccagtaaggctagcattgtcaatcattacaattgcagtcaagtccaagatcacatacataaatgttcttataagttgctatttgttgcttacaaactttcagctccatgtttacatcactaagacgggaatcaactggaactgtgcactgttgaaccaattgtttttgacgtccacgaacaacttgtggttgccatacatttaatgccactgaagctctcctgtagacaactcaaatgacaatgaattgagaatatagtagcgagaacccatgatagcacataatcaaggaatggctgtagagcttggaaaaagatgatactgtaatataacaaaccagttgatagactaatgaagaaaaaaaagtatgtagtcattcatgttatgcaagtatcctgtgggtaatctggattctggagactggaatagaagaaatgctaaaattctctaatcaggcaaggtgtgtacaggttactggtgtaccatccactgggatggagggattccatgcaaaggtagtcatttgtcccattggcccaactggattgttttactccatctttccattggaggcaaagtacaagaaaaggtggttcttttacaggtgagattgtgatcagttgctcaaaagccacttggcgcctgtaactcaatttatctaacataataaccattcaagtttgaacacacttcttatcattcatcacaattggtggctatcctgtactcctataaaacttcggggcggttcctttcagttggcagttatgcttcggccatgttgaagctcaaagaaacactcctaataactatagcagttatgcttcagcatgttgaaacaccaagaatattcccaagttaactatagcagctatgcttcagccatgttgaagcacaaagaaatattccctggatgactctagattggagccatgttgttttgtgtgtgagttactatgttctggaatgtgacagtgcaagtgatttgaatttataatcagacagaaatgcctttgaactggattaatatgaccaaccgcaacaactaattcatatgaactaaacagggttcacctactaccgtttaaaaacacaacacgggctgcttttttttttaccgtagaggtctcagaccagctcttgcataaacaagaaaatcaacagattaatggacaagctgcaaaagcaatacatcttgtttgaagcaaaggccagaatgaattccattatctaaataaaacagagaaatagatcttcttatgtgctcacatagaaccaaactacgaactacgcaaatgcacagaaatatgtttttttaggatagtgtattacatattctactttctctaagttgtactctagcatcaagcaaataaggcacacgagaagatagggttttggacaaaaaaaacatacctgaccctctcgaggttgtccagctcctgcgcggcggtcttcatcttctccccttcctcctgcaacgactcttccagctgcgtcagccgcctccggcacgccaacacgcggccctctgcctcgaacaccacccgccgcctcgcctccgccatccgcaccttatgcctctcgaacctgcagaagaactccggtcaccccggcccccacacgcacgagaagaaagctaatcgggacagggagggagttcttacttagttttgtagacggatttggggtggagctgctgctgagaggaagaggaggaggcggaggagggctgcgacgattgggtggggaagtcgcgggagaggagcgcggaccagagggaggggtggagggagaggcggcggaggcggcgggaggcgatggcgagggcgcagaggtcgcggaaccccagcgcggaggaggccgcgcccgcgcccgcgccgagctccagcacgcgcgcccacagctcgtcggggagatccgacgccgacatgtcgggttagggttggggataagcgcggccgcaggtaggacgccgccccgtgcggccgcgcgagctacgccgtcgcgcggttgcgcctcctcgccgcccgcgttcttcgtcggcgcctcggcggactagagaaatcaggaaaggagctcctccgaatcagtccctgcaactgggcccgctgctcgctttacgagggcaagtgctacggtagatgtgattaccacatctaaatttatctattttattcactcatgaattaagagacaactcatacaacgtatcacccgtacacaaacaccaatatctataatactctcacattctttttgaaatttgtgtagaggttacctcttgatttagaggtggcttatcttctctctcctcacttctctcctccacctcatcattcaatctaatgtggcactcttagaggcaacatatgtacattatactacttgccctgagccttttgttgctttacggacggctttgagtttggagtttggacggtcgactccagactcccagagtccacatagattatttggctagagcatagtgcagacaatgaaacctgatatttgccatattggcccagattaactcacaatttgaagaaactattgatatcctctataaaataatagtcagatttgtacttaaaagttgttactctgtactccctccatcctaaaaaaagataaaccttggtttacatgcccaacgtttaaccgtcatcttatttgaaaaaattatgaaaaaaattaaaaagacaagtcacgcatagaatattaatcatgttttatcatctaacaacaatagaaatatgagttataaaaaaatttcatataacacggacagtcaaagttagacacggaaacccagggtttgcctttttttaggacggagggagtatattttaagacaggtagtaaatctgtgtagagtttcgttcaataagtcaacaagatcagctcaaaaggtatatcacattacagatctgttccattaccaagcctaaactattgaagaaagatcctactatgctagctgcaatatctaattctacatattccatcgtggatgtggtctggttccagacgctttggtgcagatgatttacagttatgaatagttttggacacgattccctggaaccaaattgcaggcttgcaaactactcgtcagcaaccgtgcgcaatttcaaccttctgtgaggctgaccagtgcctatggcgtttcaaaatttcaggcactactcgttgtaatctacctggaacctcacccttcaaaatctgttatgccgtggaagtatgttaggtttaagaactggcaaccttcttcttcctggagtggcagaagttagttatctcttcctcattcttcggaccgagtcatatatcggacggaataaaatgctagagatatatctttctccaaagctggggaaaataacctgcaaattcattatttattaaccatctgagttgattataataagatcattgtgatacaaatgaacaaacttcactaagctgcaacatcttttaatagataaaagctctcaccgcaatcaattttccagcattttcaggtcttttagcgacgttaatagcagcaactgtggcagcacctgacgaaatgccaacctgtaaaataatccccataacaagttatgtatcacatatatggcaatttgaggaagatgctgacatcaagataatatcgaatcaataataactccaaagttaatacatttaggcccagtttgaaatagattattgaccggattattgtagtggattatctacacaattatagatatataaattaaatgttttgatgataaacttaacaaatagcttagaacaagcgatataagcaatgcagtagaaatgtagaataaagcttttttagagaacgtatttttagaggcctgtagcaaataatcggcgacaataatctgataaagtagctgaaaataacagggtttaatgtgcagcagctcaccagcaggccctcttttagtgcaagttcccttgcaacatcgactgcctctgtggtggtaacctgcatttttcaaaatcataattaagtcactgcaggaactgtcaactgtcaacattttttttcaaaaataaaaggacaattaaagttgccattgcggaccttcacaacttcatcaagcagctgaacatctaatatgcttggaatataacctgttttaattgacatcaaccaaaaggatgtcaatgccaaggaatatactcttaatatgctcaattcccaaatatgttgattgctaaattggaatggggttattgaacttaccagcattatcaccagagattacactagtttcagcaggttctaccccaataacctgataattaaagggcagtgccaaacacataagtgaatttaaaacaaagatatattgatattaacctaatggaaatctctgtggttgaggaaaccaattgtccaacaagtaatttacaaaaaaggtataataagatcaaaggatttccctgctttgttgtcctcaaatcattgaatagtacagatatttaacacatgtggtgagtttctgcaactaagacataaatttctttagaagctgtgtttttcactttttggaagagcacacaagcacttccaaagttaaattaaggagtaattggtaccatcaaccagttagtgagtaacaatgataacagaataaattctaaagcaacatcgctgaatgactgaatttggtggaaaagtatatcttagtttagaacaaaataagataatcattctgacacagttgtggtcatgtatcatgtgtaaacggcatgtgtttcaaattccatttccactccaaatatctccgaaaattctgataaagttactagggatgagaatggcatattctttatttcatgcagacctagtgaaaatggaagttgcagcacttgtcatttggacacaacatatcccagttttcttcaaagatagaataagagcttaatgaagacaagagtacggaccttaatatctttgttcatcattttcagataacgcccagtgcctgtaatggtgccacctgtgccaatgcttgcaactagtatgttcaa

SEQ ID NO: 40442 - DNA, 1355 bp, Oryza sativa
acatgattaatattttatgcgtgacttgtctttttatttttttttatatttttttcaaataagacggacggtcaaacgttgggcacggaaatcagggtttgtctttttttggacggagggagtacagttctttctcaaatggtgacatttgataccctgtgtacgcactagtacgcggtgcaggagtgtagattctaatccttcgaggggatatttcctcgtataccttttttttctaaattcgatgcaaatagttgtgaaaaattatgaaaaaaattaacaatgtagagtataatgatacctactagtccaccaaaattcatgttcaaattcgatctacacatcaagaaacaaaaaagacaaatttagatataaatagtacgctactattcatacgctgaatttgtcttttttatatctcgacgtgtgagttaagtttggacttaagattttgtggagttgtatatatatgttgtatgaatgttgtcaaattttttcagaatttttcataaccgtttagatggtttttgagcaaacgagagaacatcccctcgagggattgaatagtttccccgcggtgcagcatccaatgttcagtttgtaaaccagatggcagtcacagggcttctgccaattgcagataacatttgcccataaaaatggagtgatacatgaattgttgggtcacgactaatcatgtattgctatcaactaacaaaagaggtcagacgacgtctccatgacacaagagagcgtaagacagcgtaggccatggggtccattattctggtactccgccattaggagagcttagaactggaactgcatctccttggtgtacccgagctcatcaaggtgcgcagccattgccttgttcatcggaggaggaccacacctcaagatctggaacaattaaacacatattatatgtaagtgtccaggttgagacaccatacagaaagcaaaaacttctttctaaacaagaggttccgaaaatgaagatttgagttttacttgaatgtcctcggcaggtgctggcaaatgagctttaatcatgtcctgtgacacaaacccaacgccaccgttccagacttcaggaggctgcacaagcaaaaaatcaacattggaatctgctgcaaatgtctttatcaagtaccatgcatgtcgtaattcctaatatacatttgggactacgattttatagcataattttatttcaagcagaaaaaacacaaatactaaagcaaatgcaactaagagcatgctcttatccaaagaaaaaaaaacgctccttaattattttaatatcatccaggaatctttaaatatttttatgtgaaatctttttcaattat

SEQ ID NO: 40443 - DNA, 1140 bp, Oryza sativa
agcagaacatatgcagtcaccaatcatcctaattggttacagataacatgcatagtggcataaactattattgcaacctcaaaaatatttcgacatgtataatgaatagagaactttcttgcaatattaatagaataaattctttgctcaagcacatgcagctgtgctggattattccgactctcccattcatatatcatttatagaagctttgacattacataaagaaattgtaaaatatctcagctacaaagtactatgtataaattattccactttcatgcagtacaagttgcatgagttttgcatttgaagaaacaaaccagttaacagttatcataaacaatacttgaaatttcaccagctgtcattggcaactaaatgaaatgtgtatgtgcatggtgtccactagtgaatatatggcacaaaagtcaattaaatcacatgatggcacagtaaatctgaaatctgatggggcgatgctaacagtcagaaagaccacaaaattgtatcatagatatattgtagaggcagcaaaaagagagtcttaacaaataacaaagaagtgattccaccttcagaagaatgtcgtcatgcgtgacatttgcatagactaaatgaacttttgtgatatcattagggttctcaagaattgcccttgcaacctgtgagaacataaaaaaaatgtttgtcagtactaactactaagtgacccgcttgcagcaacattaactgcaacatagaactttggaggcatatatgttacttggaacatgggagtgatgcctgatccaccagctagcattccaaaagctctcacttgcccaacttggtatctgaaacgaccctagaacagagaagaaaccatgttaaactcataaaccaaagacaaatgagcacccaattcaattgtgaatgtcacctaatcaataaatgtaagcacataaatgctggctaaagcataatagataacacaaaactctttcagagtcaataaacacccattatagacttaacacaagttgcttggaacagaaagaaaacaaccttaggtcccttcacagacatataatcaccaacttcatttcacggaaatggtgtgacattcttccttgagggtacatctgcattatgagaaaa

SEQ ID NO: 40444 - DNA, 2138 bp, Oryza sativa
taacctctcccccactctccctctcctcatttcttcttctcggcgaacggcggcgggacaacgacgaggagtggtagcaacagggctctcctttctccccaccctggcccctttggctccgggaactggcggaggcgacatctggcagcgagggcacagcggcgggggcgtcgcatggcagcggtgggagcggcgggtgaatggcagtcccggccccttccgccccggcgctagcgacggcggtgtccggcggcgagggcgcggcggcgagggcccgatggcgagggcgttggctcccaggcccaccttctccgtcgtcaacatctctgccccaccacgcgccttccgctcggccctgccgtgcgtcgtccgcatgcgtcggtgtcggacttttttcgcccatgccgcctccaggaggatggcccctcgccctctcaccggagaccgagggggacgacgtcgccaaccggggcctaccctccacctgcgcgccggtcatcccccacgagcccgcctcgacgaccaccccaccgtccgcctctccaccgccgccccgccccttcccggccgcggccacagagggccctatgccgatctggtgggccgctaccgcccaccacaccatcggaccccctcgcctcctccaccgccagggggacgggacccctcacttcttccacccaacgccctccgtcggcactgccgccgcctgggggatctgtttccgccgcccctagggggatgaccgcctcttcaccattgtcgacgatgctctggactccgccaccttccccggccaccgctaccacagtcgtattctgtgccatcgcctcctcttccgcgccggccacccacctgcccatgtcgccgccgctccagagtccaacccagttcctcacagacggcaacatggggaaagagagagggagataagggcgagaaagagggaattggaagaagggttggaaagaggatgacatgtgggcccaacatgtcagcgggtcctactatgttttcttgtgtgaatgacaaataggtcccacatgcttatatttaattctaagatcatataagcgccatgtcactgtcacatgggatgaagacaaagtcaacaccgccacatcagcgccatgtcagcaaaaccgctattgaaaaccactaaaggagtcaaattacaccagtttcaattatatggccaaaaggcccgaggcccgacggcctaagcacggcacggcccatcaagggtcgggcccgtgccggcccggcccgaccaccgggccgtgcctgggcctctccgccggcacgttgggccggcacggcacgatgggccgcatgccaggcccgacacataaacaatagggagtaaaaatagacatattatatgccacggtcgaaagaatagggacgtaaatagacttattttacctatatatatgtcagcccaaagaggagggacgaaaaatagacttttttcactatatatatgtcacagcccaaagaggagggacggaaaatagacttattttcgctacattatgtcacagccaaaagaggagggacgaaaactagacttatttaaaaaaggcacgatgggccacccgcgccttcgagccggcccggcacggcccgacagctggtgggccgtgcctgggtgggaggcgcagcccatgggctggcacggcccggcccgatggctggtgggccgtgcctggtccgggccgtgccgggcgggtcttttggccatctataatttcaatagttcggggagtcatcctatccggttttctggttaaggggtataaattagattcggtgtactttttaagggggtcaaagtggacttcttcccgacctaaaatgattgttggccctgctacccgagatggctggcccgtttgcttgtctgggctgaaaaggccccctttgctcaagtcccgatcgccatcagttgatgctgtaattgctttagtggtgtgattacatttgtcgacaaattttctcctaaaaatttgacagatgtaattatagtacaatcgtagtgtaattacactgtaacttatatgtaattacactgtaacttacatgtaactacagtgtaacttgtatataagtttcgtaacttgtatataagtttcacg

SEQ ID NO: 40445 - DNA, 2360 bp, Oryza sativa
tacagtgtattttcttgtaagttacagtgtaatttatgaaacttacactgtaacttttgtaagttacactataatttttgaatcttccatgtaaattttaaattttgtattggatttggtctttttcttgaggatatggtaatttattgtctattatggtgtttcttaattgctttttgccttttattatatatatcggattttaatctaaagattaaaaatctgtgtgatacgatcataaaaatctttcgaaagatgtgatgtataggtactcccaatgttaaactggggctcttcctgggccgaactatatggttctacaacagagatcagataaaatctctgagacctgtaacaaacaatccgtaagctttcaggagaacaaaaggatgtgcaacattggatagttgcacatgaaacaatcctaaaataattaacttgcacaaaaaacacacacacaataatttcgatacgaaaaggtagggagtacaacagaaaaccaaaagacttcaagcaattcaacttccgcaacagttacgattttttccccacgttttcctatgaacgcagatgttctaccagtgttcccacccctataatttcatatgctgggagtctggaaccccggatcacccctacccattgcgaagaacaaatgccagctgaagggtgctgagcaacaaacataaactcgcaaaattgtaatgtaaatcaaagatgtaagcatttcaacctcaaatgctttagctagagctgaaaataattcacttgcaccaaaaaaataatttcgacatgaaaaaggtaaggtgcacaacagaaaaccaagagacttcaagcaattcaacttccgcaataattaggaactttttttctactttttcctgtcaacacatatgccctatcacactgttcccttcacccccagaatttcatgtgccggaaccccggatcacccctagccactgtaaaaaaaacaaatgccagctgaagagcgctgagcatccaacataaactcacaaaactatagtgaaaatcaaagatgtaaacatttcaacctcagatgctttagctagagctgaaaatatacagaatgatcaatgatcatggtagaaaacatgaactcaaaatacatatacaagcacaggaattgttgtacacttggcagttgtttataaaaaagaaggtagtaatcaataagcattatatcatcgtacgggaatgaaagacaaataaaataaaaaaacaaacatggaataggtgaaacttccaaaaaggatgcacagtgtgacaatgacaggaaaaaacaagtgaaaagtactaatgatcgtaagttttcagtaattttctaaatccttagctctgtttataaaatcaagtaactgaatgtatctttgggttgaggcgtgagaacccacaatacaagcaacaaccctgaaatatgaaggaaaatatgacatagaagtagataaataagtaagatcctgaaatggtatttgacaccccaaaaggtaaggttctttcaccaaaagcacacagcaatatgataaaactataaagtatttgcatcaaaaaatgtggatcataaatataggtgatggacaagaaagcatatgaggtaatatacctcttaaaaagaacacaggccaataatggcatcgcaaaagaagtgcactatgatacagtgtcatttgccagataaagaaacaaagtaggagactgtagaaaattagtgagggcaatcacaaaagcgatgttttttcctttagggtgggatgagaaaatatgaaataaaactgatagacttagttatgaggattgtgctactaaagctgtatgctaggacacaaggttatcacaggggaaagaagcaaagatcattttgggacagatattccaaaagttgcttatcggttgataaataatatagtgaactggccagccataaattttgttaaaatgaagctgtgttatatgattacatttgaagctgtgactatttagtcatgactgcgtgaaacaactgcgcagctgaagccacttagaagctgcccctcgtataagttcaagcaattatcaaggcagccaaattaaggttaaacagactcagaatgggaaaaaaaacatgaacttgagaatgaacagagtactgtatgtctatattgtcatggtatgaaagccagtggataacagtaactagtcatatttcataccacgggccatgaaaaaaaatgtcctgagaaagcagaagctacaagaagtttgcaattaaaaataacaatacttgacctcaacgtgaatggaagagcagtttgtcatcctagtccatcaaggagcaaaatctatacccccaataccgcact

SEQ ID NO: 40446 - DNA, 5050 bp, Oryza sativa
ttcctgcagccctactcctactgggcacctcgcgccccgcctgcgcgtgcggctcggtagttttctgcccgcctcgcgtcgcgtcgcgttctcgcgtggcgtggtggcgtgacgcgctaggtgggcggggaaaagcgacgtcgaggctgtggagggaggcaaccagccgaaccgatcgagggacgagtggaggggagccgaacgagcgtgcgtgcgtgcggacaaaggccggcgctgaaacggagggcggtgacgcatccaacacggcgggcgcactgaagtaaacgcagtaaataaacggacacggaccaccaccaccaccacgtactcctgtactgcagctacagccgccaacgagatgagatgagcgcagcagccgctacagatgtcaacggtgcgcacgttacaggggggattggacgtgtcacgcccgcctccacctttgattgctcctgaatgttctgggtcaaaaatttccgtgcacatcgactgctgaaatcgttcgagcgcacgtctctgccaccaccaccacctgagtttcgtctactgctagtagtatatggttccttcacgtttcactgctttggagcttggagctgttcagattatcagatatggtttgctgaatttttcccttgtttctgtaaatcgttttcctgtcgctatggactcgaggaatcccttgtcagacaagcaaaacatacccgtcgagacagattgcgatgtgttgctaactggccgtaaacaatggcgttgtcttggtgacatccctcaaccatctggctccttgatcggacatgaggagatgaaagttaccaaacccgcggcattcggcctctgcttatgctatacggaaggtttctttagcatttttcgtaccgtttggtcagataataacgtcatggtgtcgtaggagaaaattactaatggcacttttgacgtgagatcaacggactaatgataatggcacatgtttgtcaatcccatgaccgcatttcgtccctaaccaggaggtgtttttttttcctcgacttcacatgggatggtggcgtctttgattcagtgatcaacgcgattaattagtgcctgctcatccttgaccgtgcttgtacgctaacgacaactccgttgctgaaatctggatcgctttgcacggtcgcttgggatgtgaacacatggatactccatacaaaaaaaagaacatctcaggctagtctgcatcggtcgagcacaaattcggataagtaggtacttagaatacgatcctttcgacttgcatgtggcaatgttgttctgttaatagtctgaactttgtcctctgcatccgtcgcacatgcatgtaaggttcctgacggaggtgaaaggcatggctaacttacagtttgttgggtattcttggtctggttctgtgttggatttcgtaaagaaacaggctcgaatggaatgagtcgtttcttgtgtgtttcgtcaggttatatgttggatttcactacgtgaaatcgactcgtatgtagaccgagtcagaaagggattactggccgtcaagagtgaagacgaggtatcctcgcaaaagttgcaaaaaaagttcctcgaaaaaaggataaattgataagaggtgattgaggttgacgaatcctgcacgggcaatcacctccctgaactaagggtctgtggggatcgaggagattgagaagatacgtaaaacgaggtgattcattagctcatgattaattaagtattaactattttaaattttaaaaatggattaatatgatttttttaaagcaacttttctatagaatttttttgcaaaaaacacatcgtttagtagtttgaaaagcgtgcgcgcggaaaacgatactcaatctcctctatcaccctggaacgaacagagcctaagggcacccacaatggttatctataggctctataaaagagatccatgtcaacatattttcctacttggaagatattaaatgaagatagagagcaaaggtatctactaacttagagatagtctatagagaaaaacgagacaatacatgagagagctatagatacacatgtagatatactattaaggtggtttactattaatctagtttattgctgagatgtatatgttttataaaaaacaccttactttactatagcgggtgctctaagaactgaagcttttcttacacaaaagtcaggcatggttgacacgttacagtgacacattaggcatgacagcttcacaatagacgctaaacacacaccgttgtgaagagaagagtctgaattataaagtagtacttgtactaccactgttaaaaaatatagctatttctatcataatactgtcttaaaatgaagctatgttttcacttatctcctcctctcaaccaatcacaactagtttctttcacttactttctcttctcaaccaattacctacggacacacattctctaattattttcacatactttcttaatatccgtactaacttaagaaatgcttacatttagtaaggagaaagtatagcccatctgttgtacaaaattggaagcaaaatcaactcactatatagagacaaacaacggtagttagctagcttatcaattaacactttattttaaagttggggttttcgtttcattatcttacaaaaacattatagtttatttttattggtttttaaatcactagaaacaaatacatgagagtcacgctcatttttttcttcatttttttttcatggattattagccatagagcaaatgatgagagacttcttatgatagagttaataaaatgcttggtacatcacaaacatctcatagttgaaaaataaatgtatcattgatatgtagttccagtccccacatgtaattctcacatatgtagcttgtgtatgtttagttgtttacaatagtgtttttttctaaaatttaactaagaatattgccctcttgttttgtcttaattaattggcaaaactccggcactgtactcacaaaaggctttaattttcaacaatcaggcatatgatacaactttttctcctgaaaaaatggatgtgtgccataaaaaaaatcggcatttgaatatgtctcgtccattgtcatgaaatcagaaaaaaaaaacggctatctaatttgttgttttttgaaagatgttttttttttcagttgccctatttacttattagacgtttgtcctcttgtccaatcactctaggggattagcattgagtcaagctatacttacttaaaaaaatacgatcataactctcaaccatttgatttgattaatcaggagttacagaaaattaagatttaatctagtatgacacatcaacgtatataagacatttttacgattttttcctctatatgtgtgaatttattttccctaataggatttacccttgccccatatgggccatggggtggattatgagtccctttaatttgtaacctcaactccacagaacaaggtcagtatggaaaaaaagagatattttagaaaaaaaaaaagagtagctaaagtaagggccctgggaattggaggattggcaaaggatttttggagaaatcaattttcataggaatcttttctatataggctcctttcgtccatgggaagaagatagggaattttttatataagattgtatctctatagttaattccataggaaaataagcaagagctcttggaaacctttttttttcaatcttcctatagtgtaatcaaatggtttcttctttcatttctttttatttcccatgtttttaaattttagggcttgtttggattataagataggaaaaacatagaaataggaaatgaatctaaatgtaaaacagagaaacgaaaaacaaaggaatacaaaagttgagagcattcggatcacaggaaattaattgcctaagatttgcatgcatgaagcaaaaaaaaaagagcttgaggtggatggttttttcatgtacttttcctatgaaattagcatcaaaggaaactctcctttagatttcttacaaccagttttcatgatctgaatgtcagaaaaggaagaaattgttatgcacagtattactccaaaaatcatgtgaagatcctctgatccgaataagcccttataggattgaaaaaacttttggttgatgtgttttccctattcgtatgttattttccatcacgcgttttaagaaccctttgaaacgcaggattaaaaaaacgcacagaaatataaaaaacgtaggaattgaagtgacatgttttactaatcctacatgaatgtaaaacgcaggaaatattaagagtggccctttgataggaccatatgaaacaaataaagcaaatgaaagtttccaagaggttagatctcttgctttttcctatgaaattgagctatatgaatgcagtcctatgaaatattttctatactttcctataaattaaagggtatcaaaaggcttcatagggaacatttcttaggaaattgaatcttccaattcaaaggggacatgtctaattattgaacgtgcggtattcacaactccgtgttttagagtgggggcatatctaattttgtcaacaaaaaaaaaatcccgtaggtgaacatcaaaagaagaggccctcaggcctcaactgctccgtgttactccagtctacagaccggagaaacacatcgtcgatcaggcaagcggcaagccacaactgctccgccgatctactcgctgccaacaacaaaacatgctcattagcagatggaacaaacagaagtggtgcaaactttgccatcagatattcactcacctctctccctagcatcttgattgctactacgacacgtcaaattatacggcgaaaacactgaaaaccatcctttttatctaccacgtctgacggtctgagcgaacagtactcgcatagcgtggacacatttttttccctctgattacgatcctatccacttatccaggggcatgtgagctcacatgggtggacaaaatggagccccaatctctcacaccgttacggacgacaagtacaacaat

SEQ ID NO: 40447 - DNA, 2738 bp, Oryza sativa
gcctgtggatatatgtatactaattagagtttaatgtgtatttttgttacgacttgtagaagtggaattggaatttgcatgtttgttaagtgatatattacatattaacctatcttgtaaaatttttttaaaatattttcataatcatttaggtggcatgtaagaaatgggtggacgtccactcgagagattagaacccatcctccatgtgcagaactgaaggagtagccagaaagaaacttgaaaagctgacagcgaagtacacggatccttttcgcatcggtgagcaaagccgggcccaaatagatgtcctaacaaggtcagtcttgttttatcatgggccagtgtacagtgggccgatatggacggaccgtttcgttgaaaaaggcttgggtttgaacttttaaaccagcaacgcgcgacccggaaagtagctctctcccctccacatgatattcagattattttcagtagctctctcgttgacatgatatccagattttctttttaccttgtaggaaaaggagcaataagattcaggtgtttcaaaaaaaatattttcaaaaaggtgtgttgacttgacctttctttcgttgatctcttgaaaagaacgatttttttttttggaaccaatcggcgcttagatgtgctcatttcattaaatatatagcatgataattttttttatagagctagagctttacatctgagcgaggaaaagaaaacgaaaaataaaaagaaagaaataaagcagctactgcccactggctaattgtttagtcaaggacggctagatacgattgagatgcaacaaaatcccaacacccaatcataacgatttaatcagatttatcattcgtattgttgttatgtttcctcgtgcgtacacccccttgatcataattagctcccgaccctgaatccttgacagcaccggagccccctgaatcgctcgcagaccgcggttttgcgtgctccccctgtgagcaaaagtgagctatacgacaggttgttcaatttgtcctgtcgaagaggcctttgtcttaaccccgtacacgatagttttgatggcaagatgtggagagctaactattctctgtgtgtgtctttgttcgccgtcgaatgtttcgctcgtcagccattggaaggcacgagattgcgcggttggtagcagctaacgacagccaaccgttgtcccgtgaatctttcatggactaaagttgattgagagttactctcttcgtcccataatataagggatcttgagtttttgcttacggtttgaccacttgtcttatttaaaaaaatttaaaattattatttattttttttgacttactttatgatcaaaagtaatttacgcataaattttcattttttatatttacataatttttttaataagacgagtggtcaaactctacaaacaaaaaataaaattcctttattttttaaaagggaggggagacactttatatgtgcctgcgtacaggagttgacatatagctttttgttctttaagtaccttctttgcggaatgttcaaaagggcccgtttttgtttattttgcaacaaaacagagacaatattcggacctaaaaggaagctggatttctcaggaagtcaagctgtcaaagaatgggaggaagacaacagaagatggaacaagatttaggaacagactggagctagaagtctactcttgtcatgtgatttctcctgcgacgtcaaaaacggggcgaatcttcatgacagatccgtcgaagtctgggagcagtgtctcgccgccctaagacagagccggttttgtatgcttcctctgtggtcggcagccactcgttgccttccatgacccgtgcacccattttataatctctgttaatgcgcgaattgtagaaagaaaatgattagacctgcagcgattcatccaattgacaagccaacactcccttgacaaaccatcagtaatcttaaaataagtttatctaatatagtatgcgatatattttagtactacgaatctagacatatgtatatctggatcataatattagaatatatcgcatctcgtattagattaactataggtgggaattttttttcccgagaacagatgaaggaaaacaagcattcatttgaagaagggtaattgaacttcggacatgtttagttcgtgaaaagaaaaatttatgggtgtcacatcggacgtttgaccggatatcggaaggggtttttggacacgaatgaaaaaactaatttcataactcgcctggaaaccacgagacgaattttttaagcctaattaatccgtcattagcaaatacgggttactacagcacttatggctaatcatggactaattaggatgtttctccttaactgtgtaattagttttttaatttatctatatttaatattctatgcatgtgtccaaagatttaatgtgatattttttgagaaaaggttttttagaactgaacagggccgtcattcatgctaagctatactagttgctagtaggaatttactagtctagctatgtttttcagcagggaagccaagtttgcagctgacaatgagtgcttttactcgattagcacgttgtgcaagtgcaaactgaagttagtaagctactgaatggtactactacagcacttgatacagagattcagatccgcttatctccgtcgaaaggaacgtatccggtactccataattagctaattactccgtttcat

SEQ ID NO: 40448 - DNA, 2131 bp, Oryza sativa
ccccgaggggctcctctctcaaatccatcaaccatcacaatgagacaacgattaatcaatccatcactttcccatttgctgctctttggtcaccactattaatgtctttcagccttgccaacgacagtacgacacgagacatgttgatcgctagccatatctgacagtatatcaagctcgtgagtccacagttgaaaatgttactcagctttctgcccactgtcttgtctgcagaggcgacgtcgatcgtgtcgagagctgacgacgaaacgctctgagctgagatttctactgcacaacacccccggaccttaagcgattgcagtgcagtagttaactgttcaacgtcactctctcgctctgcgtcgtttacgccactcagaggagagcgcgatgtgtccggaaatgatcacaaccgaacaaaacattggacatcaagatcgtcagccacacatgcagtacgcaattatggtttatcaaatcggtagcaccactaatagtcaacgatcgatggagacaatgcgttgattgtactaattaatcaggcatgagatattgagctcgtggatctcgtagaaatatatttatctgctattgtcattgagtaagcagtacacaagatgtacaaaacgggcggatggggtggacatggacacatgtacgtgcagatacatatatcacaaggaacttgttgaaaagtttccttctcttttttaaactagagtggtagctagctaatcaacctcttcacccgatctgataataatcggtgaagacttaactaactaagcccctgtccaagcactgcatatatcacacatgcatgtcgatcactacgtacaaaagctaatactgaatattcctatatgtatcgatcaacaaggccctgcagatcagatcagatcagagatcgtttcatgctcttccagggctcttaggatcatggcggttgttggcgccggagccagggtagtcgttgacctcgatcaccatcctcgccgccacttcgtcgaggtctcgctcttcagccgccgccgccacaacctgtatcatcagccacaggattacaaattgttattaactacgtatagataaatatcgaagtaatactgtaataatataaaccaatttgcggtagtagttaaaacagtcgagaatgttcttgcacgaactgaggtgagacactactaaatttatctggaaaggcgtttgtcagtggggaaaacacgaactgtgtgcacaagtgggaagtgtggccatgcatgtgaactgcactatggccggcctagcaagcagctagctgtgcatgtgagtggagcgccccagcgacccaacagcagaaacagctgctgctgcatatcacatatgctctgatctgctctaaactcatgactcatgagagagctcagctcacatgcaagggaaaagccacgagctcgtcaacctgtagatagcttattcactgtgcgtttgcctactacttgcgttggccacctgtgcggccgcgagagacgctgtgcaatcggggtgatatggccatgcgacacgctgcactggccctgttggtgtggtgcgcatagttgaatagtttgtttgcatgtgagtgctttgccattcacgggagtgcatggcactatggcactatgcaaccttgtggagaagaaaaatactgtggcttttgctttaaactagagtctagaggcacagttaggccatatggtactgacagttcaataatcaccagcaaactaggtagagtaatttgacatatcagcctgtgtgagagaaacaaagaaagaaatacctgaacaggcgcctccagagcagagactgatgcttggtggttcctcaaggacacgcttcctacgcaaacaagatcagcaactaatcaaccacaagcacggatcatcgacatactgaattaaaacagagcaagaattaatgaaaatcagccggagacatcaatcacttactggacagaggcacagatgaaaccaggggaagaagaagaagaaggccacacaagattactagaaccaggagcggcgccttcctctgcgaaacctgctccatcttcatctctcctgtatcgttcgaacgtcctggtttgtttctttcaccgccactgggg

SEQ ID NO: 40449 - DNA, 2669 bp, Oryza sativa
attcctgcagcccgatcgagtttctttcactcgccttcgcttgctgttgctacccacggctgcagagatcgacgctgtactactctgggggccaaggcgattgataggcaaaggcgcaaagcggtggaacacccaatggcggagtcgcggcggcggtggtggggtggattttatacggaggccacgcctccccctcctacgtgctctcgctgtcgacttcgacccgtccgtccccacgctggtgcgtgccaaagtcaacttggcgagcacttgggtttttcggctttaccgagggcgtcgtcgtcgtctcttcgtcctcgcagctccgcgacactgacctttggaggacgaggtgtcgtcgcgtgcctgcgtccgtccgtgcgatctgggtggtgtgggtgtgggtgggtgggtatcctgctgcgctgtgtggcagaggcgcgccgcgtgtgcgcgggcctcgcctgacatctgcgccgcttgattgggttcccggtcagcgccgcaacgatggatggatggctcgggtgcgcgcgtgctgggtcggattagatctggctggtgcttgtattgggacgctcgatcatccactgtgtagaaaaatcttaatcttagtctggtctattattaattttaaacacagacatagtacaacgaattagacacccataatacacgcacaccgtatttatataagcactttcgaaaaaccgagctggtatatcttgagattaacgaagtcaccataaactccccgctatcgacggatacgtcggatatatcgcctaacactgaaaaaataattaaccgtaaatatcatcagttgtttcaaatctataatttgaatgtctaatataaaaaaataattaaccgtaaatacaatcgtccgtgtcaaattaagctttgtagtttgcagtagctatttgagattttaaaaggggtttacgtactatataactggattttttttatgtgcgagccaatcgtgaagcaacaggtggatgagtatgtgacgtgcatggcatgacacttgaacacgcgcgaacgtgtccaagctgtcgtgcaccgttgaagttggatgagcaatgtgcggggcttcttccaaggtggatcgcagcgagaagttgggcgttgttcgttatccacagtggattttcttttttgccccagtgcatgtacctaaccgtactgtcgtccaacaccatcgtggagttgtggctggaaaggaatgaatgtactttccatcgccgagcagtcaacgagcaagttaaattcgcagcattgcgttctcacgtagtacggacggtggctaggagcgacgagtggccgacgcgccggcgccgcggaccgcacgttcgcttggccttcgtggacgctgtggtcacctgggaaaaaaaaggagagggaaaaatcgtcgcgagaacgtttctgcggcgaaagctatctgaaaacggaaggaaaagcgaccgcgatcgaggcgaggggacttccttttccgcggcacgattgctcggtgagcactgagcagtgacctcattcggagtcatttcgtcgccacaaaggggcgttggtcccttgcgtcgccgaaagatcccgtttgccaatccgcaaatgcacaactgagacatgcatggtccctaatacttacaaaaacgtacttacatgtatgcacatacacactgatgtataatttgtcctgcattttctgaagggattcgtggtgatgtttaactgacgaatggtttttgcttttctgagaggaaatgttcggtgcacaaattgcagcccatcacggctagagaaagaacccaataactctggcccatcaaattaacgccttcaaagttgggccgtccaacgaagaggtccgcgagaagaatctaagccgtccgatcacgctgagatatttcccctctcctacggcctccaccgtccgtttctccgtcccacggcccatcatcctccccaacgccggtggcgcaaagccgcaagcaaaacccttcccttcctcggagagaaggtatcggcggcgagattttcctccctctcgccgtcgccatgggcggcgcctccaagctgctctcctccctcctcctcacctcctcgccgctccgcctccgcccctccgccggcgccttcgcgctcttcctctccccgcccgcgtcccgccgccacctgctgctctcctccccggctcccctccgcaccctctccaccgcctccgcctccgccgccgccggcggagcctcttcggattcgtacagctcgggctcgtgccactctccttttcccgagtggtcacgcctggtcgaccgcctctcggcggcgggctacggcgcgcgcgcaccttcccccgccgatgagctcgacctcgaccccgaatgcggcctgtcgtccgacgctgaggccgcggtgtcctccttcctcgccttcgcacgcgaccggcctgacctcctcaggtctctgccgaggaaggacgtggaggtcttggtggccaacgcggcgccggctctgttcaaggacggggaggcatcagagctgcgtctgcggcaataccttgccggggaagggagcgatgtgagttctttccctgtttttttttttcaagttggctccttgcttaatgggttgttggtcttggttgcagtagattttacttacatgtggtc

SEQ ID NO: 40450 - DNA, 2502 bp, Oryza sativa
taaaatgctatcactgaagatctgaaaattttaccaggtgactcagtcagagagagcggaaaccatcgatattgttcggtacttattaagttacgcatacggttctccggtcagctatttgaaagataaggaactgactgattcagctgtgagaaatatcttggctgagtttgtaagttttagtggatttcctcaaacctccagttacgccgaatcaacagctaggcaaaatacattgggctctaggcctccaggacaaaatattgaaatgaagcgaggtgactggatctgtacaaggtatgctagttctctacttctgtctttttattttcttgtttgaacagttgcatggtattgatcaccttactttaaggagtcaacctactgaatgttgtcagttgtcacaaagtatattgtcttaacaatcacaaccaagcaggttttattttgcatcctaccaagctttgaacttttgataacttaatttatgttcaaccaaacatgaccaataattctcataatttagttcaaagagccaatcattccacaatgttgacttgtttgaatgcatttgaggatatttgcagtttttgattttttttattactaatgaattgtttgccccctcttcgtctttcataatattacattgaaaatgtgatttgcaaccttgtctttcatactattccattgaaaatgtgctttgcaacctgcagatgtagctttatgaatttcgctagaaatgcgagatgccttgagtgcaatgagcatcgaccaaagaagatgttgactggtggagagtgggaatgccctcagtaagagatctggcatgcttgttctaaacttatgtgatttgagattcatttttatttcaaattagcttacttaacttctttcctcttgccaaggtgtgtgtattataattatgggaggaacatgtcatgcttacgatgtagttgtaaaagaccaggaacaataccaccaaatcctgctggtgctggtttagatggagtggcacagtttcttaatacatccattgttggtaaatctgaaattgagagaaaactcgctgaaaatgaccagaaggcagaaaggtggttgaacaaagtatcccaacttgatgattctgctgatttaagtagtctagcagccgacgaggattttcctgagatcatgccgattaggaagggggtcaataaatttgtggttagcacacgcaagacaccattggagagaagactggcaaatgcacagtacagcagtaacaatagcccccaagatggatcatctgactccaagataagtaaaacattagacaggattcttgggcgttctacatctacttcggtgcagaacaatcaatctggtgatggagatgtaaatactagttcaaataaaacaacaagcaatcttggtggcattgatcctgttcctttcgtgccattatctgcagatcagtttgctaagccacaaaatagttttggtgatggacaatcagacacccaaataagtacagaggctgattccatggcaaaaagccaaatggattcaatggagaggagagatgacaagcgatcatttgataccactgagaatggtccaagaaagttgcagagctcagtaatgtaaaggactttccaagtgcaatttctgatcaagactttcctgagattatgccaatgaggaaaggtgagaatcggtttgttattagtaagaagaaagaccgctcactgacatcgccacagtacaaaaggcgcagtgtgctcgagcatgctgataattccaatttcatcccatttgtcccattccctcctgattactttgccaagaaaaataagcctgtggagaattcatcagatgcaggaatagtgccagaaggccctccatcagctgaaaaattaccagaaacaaaatattcatctggaaatctgggaaattttcagaacagctcacaggtgatgggcagtcaggcagcaaacaacatgaacaatgagaacaggaacggaaattatccacatcaaaacttgagtacaagtggttatgggtatggtgaaagcatcacttatcagcatcaaccacaatctcaagggatggtcggtcgttctggtggtgcttctgaaactggcactcggaatgcaaacaacaaccagggaagctttagcgaaagcagagatagatctacttacaacaggggaagccattccgcacagccaccttataagtcaggttatggtaacaataacaatgcttggagcagtaacaacaatggcagcaataatgcttggagcagcaccagagattatgacaatggtggtcggagcgacaacaatccctattacaacagcagtacttggagcagcaacagcacctatagcaacaacgctgcctggagcagcaatagcagctacaacagtaacagcgcatggagcagcaatagcagttacaacagtaacagcgcatggagcaacaatagcaacaacagttggagtggctcatactctg

SEQ ID NO: 40451 - DNA, 4405 bp, Oryza sativa
acttgtgaattataactgtagcaccccagtttcttggtttctatatgatctccattaattttttgtgcttatattgttgattatgcttccatgtttcattttatcgtgccccatattgtgccatgagttggtttctacatgttctccattaattttatgtgcttatattgttgattatgcttccatgtttcattttatcgtgctgcatgtgctaattccttcgtttttttgcttgtggaatccaggcaggacattgtgaaagtttcccaagtctgaaaagatggttctgaagtaagttcctgtacctaacgattttgttatgtttagttgatgccttttgatctttttcaaaataagatctcaccatgatggtctttaacgtgttgttttcttggttttacaggactgaactttgccgttttagtgggcagaagatatacccaggcaagggtatcaggttcattcgtgctgattcccaggtaaccctctttgtccattgaagtttgaaagtccaatctatgattaagttagggggtcttttgcatacaatttcaagtgttctcttctgcaggtttttctgtttgccaactcgaaatgcaagcgctacttccacaaccgcctgaagcctgccaagcttacctggacagctatgtacaggaagcagcacaagaaggtgcaacattttcatcagattcattcatatattggcattctctgcccatgcaatcaacaaattcccctatttctgtgcttacgtaatataaataacatgtttattttgatggtttgcatgaatttatttagtgtggcaagcacagtgtctagagttccataaacaacacgattgttccaagtggaaatgtgaagtttgattctgtatatcataatgtctttttgctggacacaatttcttgggtagcaagcctgtatattgcacgtcattgcaattgtgaatatcttatggatacatgcatatgttgtatccttgagccacatgatatgcagttatccaagtacatctatccaccctttgttcatgtgtatgctcatgtgcagttatccgagttttctgcagcaactggctggaattgctgccttatatcatgcccttgctgctatttttctgaatttcaacgttgcactgtaggacattcatgctgaagctgtcaagaagaggcgtcgcaccaccaagaagccatactcacggtcaattgttggtgctacactggaagttatccaaaagaagaggagtgagaaacctgaagtccgtgatgcagccagagaagcggctctccggtacattttccacctttctaggctattggtctgcatttacatatccatttaaattgttttttgaacttgaatattatttatgttggtaaagctgaaatggctgattttagctgctgcccacatttgttcattttcatgtaatagctgttgctccttcatttcagcagatttatttttcttaagaccactattgttgaatgattctgaacttaattgtgcattgtttagtgcatgcttgcatgctatagtttgatcaattagcttcgggtgcttccttttgccccctgaatattttgggccatgcaattttttgctctcagattcaaactaatgtgtgcttttgatatgtttataacagtgagatcaaggagcgcatcaagaaaaccaaggatgagaaaaaggcaaagaaggcagaggtggcaaaatctcagaagacacagtcgaagggtggtgctacccagaggggtgctaaaggtcctaagattggcggcggtggtgggaagcgctgaaagtctcttgcatcatagggagagttcttctggcttagccttctctccggccatatcgtagaaacagtaccttggtcaagttagcctgccgtcttgaattttcacctttttctgtgagatgacttgtcctgaatgcttcgggtattttgttagtcaatttacaattgcacttatgtttggctattataaaattatcaagttttctgcattgacaattgcgcagtgagtttgatggccttaatttatttgccatctgttttgatgtttcaatcagtcagtgtgttatcatgttcttacaccgtatggtggcaggtgccatcgctaaagacgtaactatcgataccctcctttttatttaatatacaggcatatgattattaagatgtttgaagcgaacaaacagcaggcatatgatttttttctcccgaataaaatgtgaagacggcaattatttttagtatttaacattgcagtaacctagtaataatctacgcccaagacatctttacttagatttttatctacacattaagacatctttgtatacttccatttttttctcccgaataaaatgtggtgaagacggcagttatttgtagtaggaaacattgcagtaacataataatctacgcccaagacatctttacttcgattttcatctacaccttaagacatctttctatacttcgatttaatcagtaataaaggctgaaatgacagaagtatgataaatttcctcagaaaagttgacaactaggcctgaacatctatattcacacagattgacagtatgatgcaatgtatgtctttgctagtcacgaacctacgtgttcgccggattaagccgcttcaacagcactgcatccaggagatttcctcacatcagtatcagccatacattgcctgacgttcatagcttcgctccatctatgagcactcgcatatgcattgcttaacagagtatagtttccgctgttgctgggctctaactcattgagcttcttggtgacgatctctgcaatggctacatcaccatgcgtattgcatgatcccagaagtatcctccaaacaacagggtcaggatctatgggcatctcagtgatgaatctcagtgccttctccaactgaccagcacggccgaggagatcaacaacacagccgtaatgcttcatctggggttctaagctgtaaagtcttttcatgctttcgaagtggtcaagcccttcctcaacaagcttagcgttcgcgcaagcgatcagtacaccaaggaaagtgactccatttggtctgaatccttcagtaagcatagcttgaaacaaattcagagattccttctcgaagccattgtttgctagcccaattatgattgagttccatgacaaggtgtccttctccttcatttctttgaacacttgcaatgcttccttggcacttccacatttcatatacatgtcaatcagagaattctccataatggtgtcagctttgatgttgtttctcctcacgtactcatgaacccacttaccaagatcaagtgcacccaaatgtgcgcaagaagacactacactggcaatcacaatggcatctggtttcaccttggctctctgcatttgcctgaagatctcaagagcatcagagaagtgattagcttgtgaatatccagatatcatagaactccatgaaatcaaatctttcttaggaatttgatcgaatattttccttgctgaaactatatcttgtccttttgcatatgcagcgatcattgcattcattgttacaatgttcctaaccttcatgttaaagaacaccttttcagctgattgtaactgtccacgtcttccaaagtaatctaccaatgtattgcccaagtaaacatccacctcaatgcaataatcctctatgtacctgaccatgtaatctgccatgctataatctcctaaacgagtacacgcagaaacaaccttgatcattgtaaccttatcagctttcactccttcattctgcattaacttgaacagtgccaaaatatctttaaatctattgcactggctatatccacagatcagcgaattccaggatacaacatccttaactaccatctcatcaaaaacagatcttgcataacaaagattaccacaggcagcatatagatgaatcaacgaattgctaacaaagatatctgaaagaagaccaagttttgttatatggttgtgcatctgttccccttcattgagagcattgattctagcacaggcctttagtatgaatggaaatgtcaggttgtctggcaccattcctcctccttgtgccttcttgtagaaagcaatggcatctgccggtgcatcactttgagcaagccctctaattaggatattccaaagaaaagtggttggtgcttcaatctgatcaaacactttatgagcaaaaaccaaatctggttggagaatggcataggatctgagaaccttagacattgcataatggcaattgtacagcccagaaacgatgtaataggcatgaagcctttttatggcttccatccttacaatgttgaaaaatgactgaattgttccataaacaatgagctagttaaggatgag

SEQ ID NO: 40452 - DNA, 11961 bp, Oryza sativa
  unsure (1)..(11961): unsure at all n locations
ttcatggaaaataaaaaggtcaaagaatgcaatgaacccaaccttaatatgaaagatctttaatcacagttggtataacatagggaggtaattctaagattgcaacggaaaactcccgactcaattgagagagtttctttccaatatttagtccttatcccaggaattctactgagtcccatcaaccaaagcaagcccaggaaccttaacagaattcctctgatcgactagttttcgtactatttcagcatcactaaacctacgaagctcagtaagcatattggatagaaccacaaaatcaccaccaaattctctttctaaggctaatatcttcttcattgtcctctctcccatctcaacttctccatacttactgcaacaacccaacagcgtcctccagacagttgcattgacttccacaggaaaatctcttattatctgctcagcttcacgcaaacgtccagccctacctagcatgtctatgatacacccaaaatgcttgacatctggatttatgttgtattcataaatcatgcttttgaaaaatgcaactccttgctctaccagccctccatggctacaagcatggaggacactcaagaaggttattctgttaggtctgattccagctcttctcatatcggcaaacagttcgactgccttaactgacaacccatgcattgcaaaacctgaaattattgatgtccatgacaccaagttccttctgtccagcatttcatcaaacacccttagcgaattctgaatagacccaatcttggcatacaagtctatgagtgaattgccaacccgaacatcccacacaagaccctccttctcacaatagccatgcaatgcttccccgataagaatctttccaacattagatagtgcaggaacaactgccaacacagttatctcgcttggactaatgccttctgccatcatgcggcggaaaagagcaactgcctcgacagggcgacaagcacgcgtatacccatctatcatcccgctccacgaaacaacattcctacaaggcatccgctcaaagagcagcctcgcatactcaacctcgccccatccagcaaagcctgttatcaccacattccaagaaaccgcgttcttcaccggcatttcctcgaacgccatccgtgaatccgccaggcacccgcacaagatatacacattgacaagggcagtatgcacgtaggtctggaactcgaaccccttccgtacgacaagcccatggagctgcatgcaacaccgcggccaccccaggccagcgcaggccttgagggcaaacgtgaaggcgtacgtgtcgtcggccgcgtgccaccgcgcgtgcctgaagagctgcagggcatcctgcgggtgagggccatgcgagtaggccttgaggagggcgtgccacggcgtgggacgccggtcgaacacctggtgggcaatgagctgggagtggatctgcaggagctggcgcctcctgtcctggtgctccaggaggagcgccactaggcggcgggcggcgatcgcatcgacgggtgggcttgtgcgccccaagaagcgaggtgacagcccagccatggacggctaggacgcgtggttacctactacctagtcttcctcccaaaccccaaaaccctagcacaatacccctcttatactctagtagttgtcacttgctagtgcaatcgatgtggaaggtgaagcaagcaacaatggagaattggagattggagaggaagtccatcgtttttgctcaccttgggttgcacttgcacttgcgctcggatcggcagcgtaaatgcgacggggaagacgaagcaaacgccaaggcgggaatgcagtttacgctttgcttacactcgtggcgtaacagccagacgtaaaaggcggaaacgcgtcgcgcacacacacgaatcgcgaagttcgcgacccgattcctctccgcccgccatgctgcggagtctcctcgcgagagcaatcccgcgatcctccgccgccgccgccaccacccgcggattcaccgatccgcggagctttcctctactctttcgcgaaggttcgcgtctctccacttcgcagggcggcatcggcaatggcggcggcggcggcggcggcggcaatggcggtgatggcgaggaggatgaccccttctcgttcgcggacctccagaagctgccgccggacgtcgcgcgtgacgtggaggccgtcgtcggcgcggccgaggggttccatgcggacgccgcgcgggccaggggcctcctggagcggtgcggcgccacggcgtccgagccggtcgtggtggccgtgctggaccgcctccgcaacagctgcgccgcggcgcacgccgcgttccggtgggcctcggcgcagccagggtacgcgccagggcggcacgcgtgccactccatgctcgccatcctcgcgaagcaccgccgcttcgacgacgcacgcgccctgctcgaccaaatgcgccgctcgtcgcttgcgtctccggccgcggtgatgcttctcatccggcgctactgcgctgcacgggacgtcgccggcgccgtcgcggcgttccgtgcgctcccgaaccttggtttccggcctggcgtcgcagagttccatggcctcctgaccgcgctttgccggtacaagaacgtccaggatgcggagcacctgcttctgtccagcgagaaggagttccctttcgagaccaagagttttaacgttgtgctcaatggctggtgcaacatggtccgcagtgtgcgggaggcgaagaggttttggaatgccatggaaattaagggtattaagagggacgtggtatcatatgggagtatgatttcgtgcttctcgaaagccggaagtttggacactgtcatgaagctctttaaccgcatgaaggaggctggtgttataccagacaggaaaatctacaatgcagttgtctacgctctcgccaagggacagtgtgtgaatgaggcaaaggctcttgtccggagcatggaggagaagggggttgccccagacacggccactttcaactccctcattagacctctttgcaaggctcgtcaggttcaggaggcaaggaaaatgcttgatgacatgttagggagagggctgtcaccttcagtgagaacatttcatgcgttactcgatgtggctagaagccccattgaggtgtttgatctgttggataagatgaaagaattgcagtgtgacccagagatggacactttcattatgttgatcaggaaattctgccggtggaggcaacatgacagtgtggagaagctctggagtgcaatgcctgcaaatgggctaagccctgataggagtgcgtatattgtattgatacacggtttattccttaatgggagactggaggagtcagcaaagtattacgaagagatgaaagccaagggatttccacctgagaagaagactgaagaaatgatacaggcttggctttcaggcagagagcttgccaaggcttcagcttcagtgggttcaaggggtggttctgtgtctctcagatcaaatcctcgaaagtgattggatgatgattgcccttaaaaagtgatttatgaaaagatatgaagtaggggaggaagattcgctttgttcttcatgaagaactgctagaaacattgaagaaatcatttctttcccaggctaaagagaacagaagagaagctgaatgccgtatgttttcctagtcattgtggtctctcttgatatggttgtaattactaaatgcatgatttgctgaaacacttcacaagtaagcatgtctggtttgctgtatccctttatttgtaccttctagcttgtcctgacttacatgccgaattgtcagtgcaaatagtagagcagtttccatcatattcatgatccaaatcgtttcatatggatcaatgttatttcatatggagtatttgttttcaatgttagcatgccagggtgaactggcatattctgaaacaaccatgtaatagtttttactgttctcaacattgtgtagaacctacaatgttcatttgtatgatatattttcttcttgatgatgcagctctaaatcgcaccttttctgatggtactattttagtgccgtgaatatgaagaatcttcctatgatagcacattggatttgaagctgggatggattaccactagcctggtactaatcattacattattaaatcattacaaggtgagagcatacctgaactccatattaatccaatctgtctactttgtggcctaaaataatgccaacttgtaagttgcttcaaccacactgatgataatatatggtattggtcaaacaccttatccttgtacacctgaagacctatgtatcacattctgtaggatatactcatgctgcctgcaagtggcttattctgccatatatatcttcccccaccctgagctctttgatatgctctctagatgacggcattatctctcaaccagatgcaagttgctttaaaattttactatctgtagagacgatgacatattaacagatacatttctggggaaaagagaagggctcactttctgtgtgcaactcgcagtcatggttgccgtgattctgttcagtgtctttttcatggtatctatctatagttgcaagctagtgtcgctaactcaaatgagtcatgatgcgactgacatagtgcatgcctacgtcttactttaatcaattgatgcatggtcgcattccgtttgcctatgcaatggatgttgccattccatcaatatctgaaacccctgtaccacaatttggataaagaaccaaaccttttgtttttttaaaaaaaaaaataagtgaaaagatgaaaatataaaatacttaggataaaacatttaaaaccatcaagcatatatttcagaattcagactaatgaaggataaaatcatatatgtttcgcttaggatatgagaacaaaaggagatgttttgcagattaccaaatgcatatactgaacaaatgaattacatactgcaagcatctaccaccacatttgcagaatcatgcttgccagatttctaatcattttcgttctagtaaatctaataattttctagccatcactcctatttccgccctttatctacagcaacctttttcttgctccatccatctcagaatggtggcaggattgtctgccacatcttcatctgcggcgagctgatggactgcaagtagccgccgtcgtgccctggcgccgccggattcaccatctgcatctgcatgtgctgcaggttcatcatgtacggcggctgcagctcgtcgaagttgaggccggtgaaccagtcgttgtcctccttcaccgtcacgaacccattcctcggcggcgccacgtcgccgaagccgccgccgccgcagccaccgtgccgcaggccggcggaggcgttgtcgatgtcggagtcgtgcgtctggaagctgtcggacatggtgtcagccgccgccgcgtccatgacctcgccgttctgatggtggtggttgcgcggcgccgccgccgccacggaggccacgtcctgctgctccagcttcaccttctcccagttgttcttcttgttgtacagccggcacagcacccactcgtccagctgcagaggaacaaaacacggcgagatcgacatcagcatcaatcagttcaacatcatcaccaatcgaatgcgtcggagtacgcgtcgtcacgacgcctaccttctgtgagcccttcttgccgcccggggcgcggtcggcgtcggcgaggcggtactcgtgcatgatccagtccgtcttgacccccctcggcgccttcccggagtagaacacgagcgccttcttgatccccaccgtcctcgcgctccccttgggcgccaccggcttgtcggctcccgtcgccttccagtaccctctccccgctgcgcggttcggcctcgacccgttcgggtacttccggtccctcggcgtgaagaagtaccactctttcctcccgaacaacgccttctctgcgcacacacaaaaccacacaaacatcagacacaaaaccaaaccaatggatgaacagatcgacggagagtaccaagaaaagaagaggcgtacgtaccagggagatcccaggggtcgagcttgtagaggtcgacctcggcgatgattgggacggggagcggctgccgggcaaccttgcggcagaggtagtgcaccacgagctcctcgtcggtcgggtggaaacggaagcccggcggcaggttcagctccgcctccgcgtccctcctcccgctgcccccaaccgccgccgccatttccatccttctcctctcgtgaaaatgttggtgatgacacaccaccaccaccaacgctgctgctgctgctgctgctgctgctgcctttgttgatgctgcgcttccgtggcgaccaagtcggttcgtggcctcggacacgaggtcgcggctatatatgggggtggctcctccggaacgtgggctgcaggtgggcccggccctgtcccctcctggacctcgccggatgaggatgtgcgctcgcggctactacgacgaaggttctcgcgcgtagaaaatagcttgacctctctcaaagggcgaaagcctcatggaaacagaagagtcaaaagacagacaagctagcgagcgagagatagatcttccgcgaagaaaaaatattgtaatctcgcgccggctcatggcttgtggatggctgtgcgtgcagtgcagcatcgccaagacaacaacaactcgatgtttttgactgtttttgcgcacacacacatatctgcccccgattgtttcgtggactccggcgtcgtaatcgcccggcgtgcgtgcttaagctttcacctgctgcaccacgtgcgaattttgctctgcttctttctctgcatcggttgcgccttgcatgcagtcagtcagtcaccagtcgttgtgtaggcaggcggtgcccaggaaattcctgcctgcgttgtcgacgcatatggaattcggtttttaggatgtggatttggtagtttctctagaactattcatttcatttgcctgtcaattggagtattggacggcgtcttggcttggatttttctttcacttgcaggggcctacgctaagaggaaaactcgcgcgcacgaaatgaaaggaaagcaattgagncggacacttgggggggncccggnatcacttcgatcggtctgtctctgaaacgatgcattcaaagttgccaattaccggatgctttcaatcccccggcgctgcctaacgtgatatccaagaatctgacagctttaacacaaggagcttaatgcaagccggccgcgtgttccctttactaatctccgtagcattcatggttctatgtgtccctgtcaggctgtcacatactagtagcatcactgatcgctctaactgattccacagggaggctgtactgcccaactgtagcttccatatcgatccatctaccgatcgacacacgaggatatgcttcgaatatcactcagcaaattcagaagggtatcgtttccattcgcctccaaactatggaccgttcatacttgcatggcaccaccacgatttctcactttttatcacagaatcacttcgcttcgcagccaacgagagagagtaggtgcatctcctctaaccctctcgccgtcagtaaaattaaaaaggaaaaaaatattttttatgctgccattctgcacgtggctggctggacatcgatgatgcctatccatccagatgcagtgaaccagccgctgcctgggtcgggtgtgggtgcgatgcgagccgcaacgtacggcgaaggtggcgaacaaatccacaggtggttggtacgccatagtgccatgttttcgtcctagaatacaagcgtttagagttttctacgggtgtaaagaaaaattaaattaaattacagataattaagataagtgacctgataaaaatttaaattagagatgattatagttggttaagttgagaacctgaggtagtagtgatagtaatggagaagttctacattatattaaattttaaacgcagaaaatactatcttttttaggccggaagaaatagcactatggacacaacgtaagatggctaagacctagtttagttccccaaactttttttttccaaaaacattatatcgaatctttgaaaatatgttagagggaaacgttgagaggaatcttttgagcctaactaatcccacttatggctaattatagattaattaggctcaaaagattcgtctcgcggtttccaggcgagttatgaaattagtttttttattcgtgtccggaaacctcctccgttatccggtcaaatatccgatgtgacacctacaaattttctttctatggctatgtttagttcctgaaattggagagaagtttggggaaagttgatagtttggaaaaaaaagttagaagtttatatgagtaggaaagttttggatgtgatgtgatatgatgtaaagttgagagtttgggggaagtttggtgtgaactaaacaggacctaaacaagccctaaatatgctgcgtcatgtcgacagccgatttatttttccattcctccggtggtagactatggtatatggtatgaaaaatcagcccaaaaagggacggacggcggctgcgatgagagcgatggccggcttgttttgtctgcttccctggggaaaaaattagcactactgcaggtctctggttggagctttaattgaaaagtttagttgtgttaccacacaactggaatgatcactggaaaactttattggcatgacacgacagtgtgtgaagaggctaatttacggttggtggcaagacgattagttgtcttctggttagctgaatttacagtgacagaatcatgcaaaagggatttacatcccaaacaagcgtgagccaaaagtagtaatattttagggtagctggcatcagttaaccctagtggtgcacaaggcagaaacttcttgatcaagtattgttttcttcaacatcaaaaggaattattgatttgttaatcgaggtggatgaaggcataaacccacatgcatgtctaccgcttgaccccgtacaagattttaatcctcccttttctagtcggccactaacgttggaatggagcttaatatacacaggctagctaggtgggccctgggcagtgcctccaactggcagttaattagcagcaacgttcatctttctagttaagatgcactattgaattcctcaggagagttaattcacacagaaaaaatatgaacattaataaaaaagaaacccactaaagaaaaaatataaattactcccttaaactatcaaggtcgatcaaattaccccctaaactcaaataccatatatttttaaccacgaacttctaaccggataaattatcccccctagaactgttttgggtggttttaaccaagagcttgcacacatggcgtcaacgtggcaatacagtcaacaaaaataataaagtcaattataggtcccatctgtcattttctttcttctctccctctctctccaatatcctctctttcctctctctccgctctctcctcaatgggaatggtggcgtcggccagcgaagaaggcagggctcagcatgagggaggcagccgaatgcgagggtgggatgtggacggcggccggacttgcttcgaggtggggaacttcagctagtggtagcggcggcagtctcgagcgtgagctcggtaaccatgccaacgccgtagccacgtcctttctccaccgccaccatcaatctctccgatgggagcaaggcgacgcaaagaggggcaacacctacgtcggcaatgccttctcgagcgaggtgggtggaggccagcggagctcgcccgggtggccggtgactgaagcggagctcacctaggctgccggtggtggaagcggagctcgccccgtcgccctcaaaggcgtcgatgtcgcccgaatatgcgccatcaccgtctattgcactgccctccgacccgccacctgccgcctcgcgcgtcgcctgccgcctctatcaccgctcgcaactatgcccacatgggctcgagcccttcctgctgcctcctgctagggggttatttgtttggtttgcataattagggggcaaagaatgtctggttttgtggtttaggggtgtaattcagtcgacagcaatagtccagggggtaattcgtactttttccttcgactattggttactactccctccgtcccccccaaaaaaaaaatcaaatactagagtttgaattttgtcccacaaaaaaccaacttctaccattctatacctacccttagcacgtaaaacaagaagttttaccccttcaataccctttacctactcatcactcttactttttttttcaatgattaagggcattttagtcattctccatctccaccaattccaccttgggatgctatgaatgtaatttttgtgggacggagggagtatgtgtaaaggccagggagctaatcaacatattaattacttcaagtaaatttcaatcaacctatgtttgatagttttttttaatacagggaacagggattatattacttaactaaagtatcgtcacaaacaagttgtgagataaacctatgttttgttgttaaagctgcataacatatactatgatatcctttcaaaaaaaaacatatactatgaccagtggtacgtaatcttagatataatggttcaaagtatcatataacattaggtatacatgttgagtatatttttacttaaacttttaaaatacaacatatatgatttttttttatttcttgactgaggctattggtttaactcttggctagttaaaaataataataattcagatatgataaatttaattttgatttaaataagggtggggttttatatatgaaacatttaatacatgtgattctctgtcattttaatcataaaatataaggtattactttatttttgaaatacctctcgatcgttgtactatctacaataagtgtacaataagtgatttctcaactttagagtttacatcaatttaagagcaattttacggtacttgagaaggtaccatgaggtgccactttttctattgtacatttggtacctagatactatgaggtactaaattttacactaaattttttgtacctcctcaataactataaaattactctcaatttaaagtttaatatcttcatagatgaagagactaatccaatcccattggttgagccacggcttataagtcgagaaaagcaaacgatgtaacaaaaaataataattttatggtaagaatgctctgatttttggcgatccaaaagccaaagctcaaaaaaagaaaaagaaaaacaatgggaaaaagcctaagatcaacagtataattagattgtgtacttgccattctagctttgttataagtcaaatatttatatctatgtctttgatcattaacttgttaaattcatgtagttcaataacatgaataacgtaaatcttatgatgttgaactatatgagttcttagaaattaataataaacatagaaaattaatttgactaataataaaattagaaagttaagtaatgtgaaagggcatgagtagaatttgattctcgatcaacaatttaaaagttctgacgagtaacatcactgtggtcaacgagatcggctaatgtggtcactgggtcagataggcatatccacggaagatatccatggtgctgtgtctaggccggaataatcgatcatgacgcaagagcggacgcaacgagcgacgtcgatcgatcgatatccgaggatttaactctcttaatcgcgaaggtgtcaccacagccatgcatgcacgcatgcattgaccggaccaaaccccggcccggccgtgacaggtccgacctaccggctggctggctacaaccgtccgtgcgattattgccgagtcatt

SEQ ID NO: 40453 - DNA, 1721 bp, Oryza sativa
cacccccgcccccgctccctgcattcttccccgtcttcggtcccagtcagtaaatcgggtggacgggtgagcagagcccaacaccgttcggatggacagcaactgcgaagcgtcgattaggacagttgtaggcagcacaccgcgacaagaggacactggccaggtgcggtgtgccgtgagaaggtggcgaagaggcaataccagctagagacggtagcaaagagacggcgttgtctcgaggcggcatactgagaccgaagagggagatagacgtgagaagagatgtgagtggcggctgggcaaggatttgggaaaactagggttttgcttatatagtccttcattaaattggccagatgggtcttagaatatgctatatcttttgacatgtacttctttcgtttcaagttataagacgttttaactatggtcaaaatcaaattgtttcagttttgactaagtttatagataaatatagtaatatttataatactaaattagtttcatcaaatcaataattgaatatgtcgataatatgggcccgggggtatgcggagtacgggggagttaccttcccgtccagccacgtggccctacagcctggccctccccccacatctcggaatacgcagaagcagccagggagtctcggggtgccacgtcacacccctcgggccctcgcgctgcctcgccccgaggccctcgcccggctgccacgtggcgaggggagcgaacagggcggagactcaggctgaaccgccatcaatgcgtggggccccaaccgtctctcaccgatattaatgcggtaagggcggccgtgcggggctgcccaattaacccacgtcaatcgggcgtgaccagactgtgactggcctgtcaccggtcacatttgatcggacgggcggctgtgcccccatgttccatcctgtacccaacggagtgggggcgggtatgccctatcctatcgaagcgtcattcagagctccctccatgtgagaaggaccgccacaagtcttcgttcatttaagagggagtgacggggctgtcccccgtgtcaggcggcgggcggcgctggggtccactcgaggacggacgactgcttagcttccaggcgaaggcacagatcgtggtccggtctgagtagagtgggtccccctcccgtgaaagagtgggtagaggcggcgcatgtgggatccccttgaactataaaaggaggatcgagagtgctctccagggggattttgggtaacactcaatgataagttccacacacaggagtagggtattacgctccatagcggcccgaacctgtataatcttggcgcccgtgtgtgatctcgaaacactccaggcggatacacgatctcaacaagcgagcctttcccccggccgaactcacaaaagagggatctctcgatcacccgctagagaggatcactcctcgacagaatatattttcataataaatttgtcttgagttaaaaatgttactatttttctctacaaacttatttaaaattaaagcaatttgattttgatcaaagtcaaaatatcttgtaacctgaaacggagggagtaactcataactccagagcctcgtgggtcacctcaccagtaggtcaatttttatccccgctcgacaccgctcgcccgcgggtgagatcccccctcgcggcggcctcacagggtgggtccccggtcccaacaagaaaattgtcatt

SEQ ID NO: 40454 - DNA, 2270 bp, Oryza sativa
  unsure (1)..(2270): unsure at all n locations
ctgcagcccttatcaaagttaggtaaggtagaattggtaaaacgcatttcaaataacaagggaatcgcaaggatacttgagcaagaccgagattatttcagggcatacacatcacacacctttggaaacatcagagagcacaaatggggccaccccagacccctcaatcgcatatagttataaatgatttaagattccacaggtgataatttcagttagtttaaaatccttctatggctgtacaatacaggaaaactcaacactcaacgaaaatgtgtcaaaacactaatctggcccttaagcggcaagctacaggcaaagcatctggctagcttatctaaaactgaaccgaaaaactctgcaagaatgggttgtcaaactgggctcacaaagtgtcagccctgcatcatgttgcacgtctgacatgcctatctacaaacagcatgactatgctgcaaatttacagtgaattacaattgattggtatatttcggagtacaattactgtatttaaagtggttccatagacccactctttagtctctccattcgtgcttgcaggccagataacgctctctcgtccatgggtggaataatattttgtgtttgtgggtcagcatccaatcgtgttcccccatggagtgtattaccattcatgctcggcaatggacgagcctgaactccatcaaaattggcaccaacagcagcagcttgaatgcttttcatccgttccctaagggcatccaacgtccctgctggcatagaaagaacaattcatacaatcagattataaagcttagaagtgcagcttaacagcaagtatgacagaaggcagacctgaagattggtatctgtcggtctgtaggttagtagtttgtaacctattatcaatctccccttgacctctgaaggggtgtgtgtcaccaccagcatcatcttcattacaatcagttttgttatttatcgattttgtgtgaaccggtgaaggtgcaaattttggagagggtataggtgcaattggcggaggtgtggataatggaaggctggagggagttcttccagcagcagcattcttctccacctgcatgagccaaaaacgataatagccaatcagttaaaaacaccaaaactagcttaaacacctccaggattgaaatagcaaacctgagctagcccatctctgatataggttctaaatgcttcacttgcattctgaagctgagcaaatatatcaacctgaaaatagttcttgtttcaggaattaaaatagaaaaggtagcttatgcgacatacattataataactggctgaaataaacaaactcataaccaataacaaacaaaaaaaaatcaaaactcttaacacaagaacacaaaaagaatcaacaactagggttcatagaacttttggattcacttgatccaccaggaccaggtgaaagatgaacaaattgtacaggacctggcaattactttatataacatcatgttgcactttcacgatgaataatataccttggggtacagttgggttatccggtagagttcataaagaccaattgtacatgtttgtttgtcaccaattttcttgaatacagcagcaagctcttgctacccataatcaaaagaaagacaaaatagaacatcaattgctgtacaaatttgcaagcagtaatttacaaatgttatgttagttaagaatcagtaatactaccttcaactgtgcgtcagttgaatgagttgatgggtttggattattggaccctgcatcaccccagtgagtttggcccatagttccagatggagtcagcattctagctgccgcaagggtctagaacacaatagtatcaattaaaaaaaggatgtccatgacagtttgttgtggaacaacaaaaggatgtattttttttacctgaagattaagatcaatgtatgccaaaatgattggctgaggttcagcatctataggaaccattgaaaggtgacctttgattgctgtaccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40455 - DNA, 1794 bp, Oryza sativa
attgagatttataaactcattacctcactatcattgactggtttgtccgtggacttcccaccagcatacttcttgtctacataaacagctctgatgaattcccttatcctgtctggattgctaaaacaaaacatagcggaataattataaagaaatgtactagaagtttccacggcacatgggaatgaaaacaaactcacctattgtcaggcaacctcattcgttgccaatcccaatcttttaggtagatatcacgtgctcgctgcacccatgacctccatgtaagcatatgaccaggtcactctaaagtctaaagaggacaaaacaaagtaattcccggaattacctggttccctccctgttcaagagaccgcacttcttgagtagtgaatttagccattgacactgacttgacacggtgggtaaactcccggctgttttaacacataaaaaaaagagattactactcctatcaaataccaacagtatagcaacaatgtatattagattaatgcagtggtaagacgtgggtcagtggtccaatccgattaagtacttctctgccaaattcattcacttctttctttatttttgaaaattattttttaaaccagtcaaaccctaacaacacgtgtttcaagaatgaaagacagattcatcaccaccttttttctcatagccgcaataataatggaaactaagtaacggggtcctcccacaaaaactatggaatgggttaacattatgatgggccaacccatcctaggataatcgaaatccttgagctaaacatgccacggagtcgcaaataatgaaatagaaaattccatatatggagtgacattagctgaataaacaactgtgaatctgtgatattagattgtgaactatttgtaagaaatggaccataaataatgctttatatttccccatgccatacattcttagcatcagataccacaacacacatcttcttgcaagtatcattgctcaatagataagtgaacacaaattttcttgcatgagcaaaagctgaatagaccttcattaactctaaactagaacgaagaaggaaatcagctgaggaccagaaattggcatgtacgacaagataaatggaacaaaatacttactgtattccactgcatgacaagcatatgaaggtccagaaattggtacatacatattgtggcccctgcaacaaaacaattatgtgcttcagttaacataataaatacaatgacatctgagttcacttagaagtgcaactaaaagaaaacatggtgctgaaccgctggtcatattttgtgaaccattgcaaaaatagggcacaaacaattgttaaacaatttcagaggcacttgggagtattaccacactgttgcggaggcacttgctgacatgtactccctccgtccccaaataaatcaacttctatgtttgaattttgtcccaaaataaaccaatttctatcttcttacctaccaccagttcgcaaatcaagaaattttatcctttaaatacccctcacctacccatccatcaatacaactttcctattaattagggacattttggtattttgccttcctccttaatttcatcttggaatgctagggtttgaaattttgtgggatggagggagtagagtattaaaagttcagcggctcatatttcagccaacttagcgactagatatcaaatacaaacaactgtgcatgaagtaatgaaattcacgagccaataaaactcaggagccaagaactaccttccctattgattaaccaatcatat

SEQ ID NO: 40456 - DNA, 4262 bp, Oryza sativa
acacggctcgagtggtgccccgttcctcacctcctttctctatattttcccttcttgcccctctcacctcggcatggtgaggcggagcaggcgacggatgcaaggtagaaccagaggtgtcatggcggtcggagttagcagtgggcgcggtggggcagaatcgaaggcattgcggtggtcggagccggaggtgggcgcgggagtcgcggtggtcagagctggcggcgggcgcgatggggcggatatggaggcgtcgcggttgggcggagccgtccggcggcaggagcggtggggtagagtcgacggcgccgtggtggggcggagttagcagcatcgtagtggaatggaactggagacggcgcaaagcggagagatctgatcgccggagtggtggacggcagcggcacgaggtggggaagtcagcgatggcgacgggcagagggagagcgacgagcgagaggtaggtgagagagagacgggcggcgaagaaaaaaagaggggagaagtggatgatcagtggatgggctgagaaaatagctaggggtaggggaggaaaaacatacatgtggcttcgtgggctaggataggaccgttgtgggctagattatctctaccttgttgcctcagatttggtagggctggttggagtacttttcattgggtgccttagcccatatgacccacatgaggatattgctaggagtggcttacatggtaagtgccctaaattttaaaaagcattttttttcaaaggaggatttaccaaagcatttagtcacagcaaatcagtactagtagtagtaagcacgatcggattgcgcaaatctctgagtttttcactgaaactcgaaacgaaaccaggtttcgctgccgaacccgaacggcagctcgatcggcgtccgtgccactgcccccgacatagagaacagaggggcagaatgaatgctcgtctgcctcagcgagtcggttgttcactcgtcaggacgacgtgaacatgcgctggtagtcccaacttgggcgtgccagttgctgaggacgtcttatcgtcttccccaactggatcacacggatttctctgcacaaaaacacaatccagttcgaaccaaccaaccagcagccctgcccctgcttctcttctttctcttgcccatggccgctgctgctgccttcttctgcgccctgctgttcatctccgtgcagcacggcgttctcggtggctacacgaggaatgatttccctgctgatttcgtctttggagccgccacctcggcgtaccaggtaacggctatgattctatctcaactgaatttttgctttgctcggttggttttctgcgagctttgagtttttttcgctgtgccttttgttgtgcatgcggcagtatgagggcgctgccgcagaggatggcaggggcgctagcatctgggacacgttcactcatgcaggtcagtcgtttttgctccctggaagctgaagtgctgaacacagtcacacgcgcgggcgtgggacactgttgttgttcatcatcttttcatggctgcttcatgctcatacacaaatacacaatcgagctaaccaggatcacgtaccattctaaaagcaaatgctgaaaaataaacttcaacgaaaaaaccccaaaatcaacttcaaatttaaggatgaaaattcaaattttggctgataagcataaataaatagtggcactaaaactgaatagtgacagtattttcatatgtgcaatcagggaaaatgaaggacaaaagtacaggcgatgttgcctcagatgggtaccacaaatacaaggtacacgatttaatttcttaggtggagtagaagctaggtttgacttcggaagattgcccttttatatattttccttgtcttgcttacatgtgaatgagtctcgccattgtagcaaaatgttgtgtttttgcaatatttttcctgaagaaggaactaaacataggaacaaggttcctcgagttccactttgaatgtttcacctttttcttctttctggtagaacttaaggttgtgtttagttcacaccaaatttggaaatttggttaaaattggaacgatgtgacagaaaatttagaagtttgtgtgtgtaggaaagttttgatgtgatggaaaagttggaagtttgaagaaaaattttacaactaaacacagcctaagttgagaactttggcttgtaataattttgcttgcctgattttttagggtgatgtcaagctcatgactgaaactggcctagaggcatataggttttccatctcctggtcaaggcttatcccaagtacagccatttctactcaaaatttaactcttgttaacaaagaagtagttccttgttgcttagttgtgatatgcaggtggaaggggagctgtcaaccaacaggggctcaagtactacaataacattatagatgagctaacaaaacgaggtaatttttgcaaattctttttcaggttacttatattacagagcattacatgttgtattgataaaacataattgtgtttaaacaatgaactatattagcaagcacaaaaaagaaagaagaagaaaaaagaggttgctcgagcaaaacctgcactaggacgaacttcgtttccttgacagttttatggatggattcagtcagccgcactccttccttttgaaaagtgacgctttgcgtcttcggcattaaattgtgaagcgttgccctgccataatgtgatgtgtttccactttccaatgccaataaaaagtagcccgtctaatggtatttaacatccataaaacatccaaataaaatgcgtcccaagtagaaatatcacaagtactgccacgacctgggccggtgctccagcttgcttggtgaacactgacttactaaagaccggaatcgaccaatgtgacattgactatctcatgaatattgattgctcggctttcttcaggaattcaagtccatgtcatgctttaccatctggatctcccgcaagctttggaagatgagtatgctggatggttaagccctagaattgtgtaagattcaggaaccatctatatatatatatgactatactggtagtgattatacttgaagcttacaactagttggagtagatcaattctggactgctgatcagtaacaatggcacaatgcagggaggattttactgcttatgcggatgtgtgcttcagggaatttggtgatagagtttcgcactggactattttggctgaacctaatgtcgctgcacttggaggttatgacacaggagaattcgctccaggacgttgctctgatccttttggagtgaccaaatgtacagtggggaattccagtgtggaaccatatgtagcagctcacaatatgatactaacacatgcagctgttgttagactgtacagagaaaaatatcaagtaagtaataatgtgcttaaaattatcggtagtgtgtatttctaaccgcacttatattctccgcaatcaataccaaggctcagttccattcttcaactccaaacttcaacttcctcgtttttcgttagcatgcttttcaaattgttaaattgtgcattattggccaatcttctggtaagccaatcctagaagttaagggagaatctaggatttgttagggttagtgcgttatttttttttaaaaaaaatctatatagaagttgttaaaaaaccatataaatccattttttaaatttataatagtcaatacttaattaatcatgtgctaacgaggtttctcgttttgcgtgccataaaaatccatcttcaaaactggagatcgaacggggcctaagacactaagcaagtatgctatcaatacgatttttagtgaggtcagatatttgcctctagtgtgagcttttcaaagggccgcatttgtgagagtatgtgtgtgttttaagtcattaagtgcaatcctaaaaaagttgaaaggatttattttattattcctcttattttcttattttcttcctattattcctcttatctaaatttctcaaagtgttttgcaactttctttcatgtagactctgcaaaaggggattgttggtataaacgttctttccttgtggagttatccattaacagactccactgcggatctgcaagcagctcaaagatacaaggatttcacgtacggatggtatgatcgatgttgtaactctttatcttcacactgaactagcggactgcacaattttacacgaagctagattttctctcttttttttcccaagt

SEQ ID NO: 40457 - DNA, 3928 bp, Oryza sativa
tgccatctggcttgatcttagtgtggtttacctgttgcagagaaacagaaattggaatacaatgctaagccaaacctgaataggtacaataacgaaacacaattgcaataaacaatgaggtgcaaaaccatgtctatccatgagattttactgatgatatggccattatctaatcggttcctaatagctcagtcatagtatgccgaaagaacctagtaggtaacatttcacgcacatcaatatgaaaaaatataaagaagcacgagcaaaacttgcagatatagtacaaaaaggttcaacgaacattgcagaaaagaacagaaggtcatttggaatcgagccgacatgtgctcatcatagatcaggtcaggcaattgttagaaacagagagcatgacaagtaaattcagttatatctttcatgctgaacatacactatccagatgtagtcaagagtcgtttgcgtactaaaagtctgagagaccgagacatcatacttctgaccacataatatgggttgatcttaactggtcttactaatacccatgaacccaccaggaaaaaaaatatcagcaagatatgatcgcatgacatatatactggtaaaatatgcaattgtggatatttcctcaatataagaattgcacagtccctaatgatcgtataggctaaaagactacttttcgttcatagacaatctatcgatttcaatacacaacagcaaaataattcctcacctcaccgcccttcccagcactgctattccgatcgttccccccaccattcagcatgggtctcggcgcaccagctccggtaccatggccgctgccgccaccgctgttgtaaccattaccaggggcgcccatcatcgggcggggagtacgggggccggccacgcccacgcccacgccaccaggtcgaaacgccccgccgccgttgaacccggcgtgctggacagggaaggccccgaactggttggggttcggcgggaaacctcccccggggaagaagggggcctgcggctgcggctggtgatggtgctgctggagcgcggcggcggcgaggaagccgaggctctggagctgctgcgcctggccgaagagctgcatcgcgaggaaagggttggccgccgccgcggcggccatggggttggcggcggcgaggttggggacgggcggagggttgaagcccgggtgcatggggaggggaggcggggcggggtcgccggggcgcgggcggtggggttggccggcgttggggcggggagggtggaaggggcgcatggtggcgtcggggaggggttgggaggaggaagcggggtggggattttaggtagggttttaggacaaccccaaccagggcagggtaggaccgtaggagacgagcttttgttccttcctggcttcctctgctcgtacggtctggtggttcagcttcaggcacgctttcatcaccgatttttctctttttttcatcaatattttcccttttttttaagaagacactcactatacatgtacactcacccctaaaaaacgcacgcacgtaaatcctacccctataagcatcttcgaaaactggaccggcactgcgactacaatttttttttgggtgaagtttgcttcccttgtctagttttttttttttttgaaatttgtttgcattctctactgcaacattttggattggatccgaaattacatggtcaaatatagagaacatgcagatagcttttcaaagatgaagtcgtctatggcctctatagagcaactctaacatgtcatcgatacctccaatttcgtgcatttgctttcttacgctggcacagataccctgaattttattttatttattggctatatcaatctactttattttattttgttttattttcttaaactcgtgtaaagattatctcttatatatttttagatcatagaatttattccggtcattgcttcaaagaagctatgaccaattattatagagaatttattccggtcattgcaagtgccaacgagaggacactatcccgaaatgcagatccccgatcccatgaacgcaggaaagatttgctcctgcggacctggaagccaggaatcatgtgcagcaagtgcaatgaaatgattgtgaatcgcaaacggaacccagttccaacgtacaaatcacgtcagtttttcttcctggacataacatctcacaacagattagccaactgatgaacaatggctctgataggatccggagggctatttaatagtattaaacgtatattactgaacccatttaggagtattaaacgtagattactgacaaaacccattccataacccctaaactattttgcgagacgaatctaacgaggtatattaatccatgatttgctacagtgatgctacagtaatcagctgctaattagagattaatatacatcattagattcgtctcgcaaaatagccaggggttatggaatcgattttatcggtaatctacgtttaatactcctaaatagcaagattccggagggctatttaatagcccggaggatacaaacaaggccaatgacaagttttagttatatataaacagtttcaacgtagtaccaagaaaagcaatatactactacttctcaataaataacacctcgcaacaatccgtccattcggtgaaccaacacattttcacaagttcatgctgaagaaccaaagaatgcaaatgatctagtcatttgatgggtatgcgtctacgaccttttttaatgacaattgggtttaacaaggacaccccaataaggtcaaatgacagccaggtgagaacaaacccgcaggtttcaccagggtcccagacagggtaacagcaatgaaaaagggcagcttgcttcaggcaaaaaagaactccagcccgcctgtttggtattctgaacactcctttctcatatacaggaaaccagagagtatgaaatccgagatatatatattcacttcaatgtgcagatttgacacaaatatacttcgatgcgtgtggtacacccgactaccccatggtccatttaggttccacgcagttgcaaactgcttcgcttatctgtccaccactatcagcattcattcgaatggatttctgggcggaaatgacccttgtgcggagttcctgttacaggaggtcatttagaaactaagccctaatgctaactacaataacttgttagaaaggagcttacagcatgagggagtcttgtacttgtgttgccatgtatgataaccctcctgaaacaacaacagaatccgatattgtattagcattaagagtagagtatgcttgtgttcttgtgcgtgaggatcatggagatataaaggatcagataccctgtggcccagaggaaatataaggcatgttagaattatgaggtatccatgactcagtcaagttggaataatctgtattgacatggggatttggcaacgtttcttgcagcgaggtcagatccatgaactgaaaaggacagaaagaaatagtgaataaagaaacaacaaaagaaaaatagaagtttgcagcatggaaccaactaagctattgttaacatgtctaaaaacaaagatcgcaaataaatgtctctagagtattagataattggtcctagttgtttattccaaatgtcttaaaatatgattatatccattaaaaaaaagctagaatccatattataattatcatgaccacaaaccacatcatagtataattaatacacaccatgttactggcttcaacatcagactcaaatgccatgtcaaatggatttgttgattttgcaggctgagatggcacgatgtcctgaaacaaaattcaaaagaacagttaaaaagcaaaacaaaccatttagaaaactgacataataaggctccaggtagcgccccacggggctgcaggaa

SEQ ID NO: 40458 - DNA, 2017 bp, Oryza sativa
gaatacagactataacaagattaacaagcaaaataactaaaaggcttacatgcaaaattacaagaccattctgtctgtgtgcattaataatctcagcaatccatacagataaaaaaaaatccagtctagcatcatctttctaacaggttccaaatttcataaattgtccattcagcaatgagccaacaatatcatggtaaactagataccaggaataaaaaggataaaactatctgtcataagttgggaagtaacagaaaaaatgtatatgcttgttctcaatcaaaatcaaactgttgtagaacaaatcaggaaagcttgcagagcaaagaaccttgaatcattgataaaacataccagttgctgttgaagtggtccacgaaatgatggcccagccatgtcaccaggagagacattgaaaccaggggttatatccccaggggttagtctttcaggttcactgctaggcaaatcctgtaaaatgattcaatatgacaaatctagcctttatataatctcagagttattaaatcaaacatgctcacctgtggacctctggcttcagcatgtggaacactaggcacattgaagtgattaggtgctacttgagagatagtgttaaatgtgaatgagtcgttgggtgtgttcccagtagatgcaccaaaggcattccaaggctggaaaatagtcaaggagaaatagtccatagtaaacatttgcaagcagagcaaatctctaacaggtcatattccaactggtgaaatacctgtgaggtttctttggagacaggggtcttcacctcttcagcatttaaactccactgatccatcataagcgggtaactttgtggaatcaaagcatttggtggcgaagttggcaacattgactgattagttcctttagcaagactctcacttggagggaatgcagctattgcggtggctacctgagcttgcacgtttgaaatggaagtcggagatacgtgttgaggtgtatcgaggaagaaagcccatccttcgtcagcaaccaatggggctgcctgttgactttgctgaacactagtcgtaggtggcagttgttggtcaaagccagcaaataaatctattgactgaggggtagaggaaattgatggttcggctggttgactttgctgaacactagttgtaggtggcagttgttggtcaaagccagcaaataaatctattgacggaggggtagaggaaattgaaggttcctgcaaaggcgacagactcaagagatcatgatggacaggatgagatgtagagggtgcttcggcttgaacaggtggtgaagatgccacggctttctgaaccacaacgtcatgcagagtttctttaggaacagaatggctgcctacatcaactgctctatggggaactgatggagcctgttggttaaagccagcaaaaagatctattggtgctgcagaattgaccggatgttgcattgactgatcaaagaagtcctgatttgtggaagtcgttggctgtgttgaaaccggcggctttgctacagagaccatgtgaacccttccatgttgcacagattccctggtgggagcagtttggctgactgaagagtttatattgctctgtgaggcatacaattgtgctgaatgagccatggggggcgcaacagactgacgatttacagcagaattcactggcttttctgtaggtgcatcaggtaaggcacctgaatcaactgacttattagatgctgagctaccatcaaatgatccaaaacttcctgaagaacctgttctctgcacatagaaagatggtatatttatttcaaaccactctacctcagaagttggttttaagtcaatgagcattagctggaaacatataacatgaatggggagaacattaacctgtgatcgtcggactccattaaaatcaatttgagaagttgcattcggatgccgatgggatggaggattttcagaagacacattccttgaatggtggatagaaggactgctgtaccctgt

SEQ ID NO: 40459 - DNA, 1924 bp, Oryza sativa
ctgcaccccagctcaccgttgaacttagaggataaacaactactcttgtttgtaggatactgcacccattggtatttggagattacccacaagtaatgaagaaagctatcggttctcgtcttccatccttcagcaaagtccaaactgaactagtcaagggtactctagatttcattggagtaaatcactacttttctctctatgtgagcgatctccctttggcaaaaggagttcgagacttcattgctgatcgatcagtaagctgcagaggttggccagttttctatttaattatgcacataaatttgtagcctaggagtgtgtagcttgattcctttatagggacggcccatgaagatgaaggtagacaaaagaaaataaatcaaaacaaaatgataatgcacgtcatatcttttatgatgtgatgatagattatctttttcatatatgctgaataactttgtaaagtcatccaatgatgattctgaagatgattctacaagttattagatgtactgtatagcttatcatttgtttctcggtgttttcttatgcagcttctaaaacggatccatcgtcggggcaggtaagttaatttggtcatcagtaaggttattgagatacattgttgccttttgactttaggttaaggtttattgcaaggggtaaggtttatgataaacaggaaaggtggtaggttaaggtttattgcaaggggtaaggtttattgcacaaacaatggtggcgtcacattctaggagaagatgctacataggatttttctttttgtgacgtggaaaagatatagaagtatgccgtctgttgattaagtctaatatacggcttaatgctatatatatatatttttaaaagagggcaaaaactttgcctcgtatatatggatagaatagggtgaaaaaaatacagattgatatttacatggcttcatcaaaacgaggccagagattaatgctatataattattatacatgtcatctatagggtgaaataattgattatacagatctattatagaaaactaaacatcattgtatcggttgtatatatatgtcatctaaatctgacatgaaaaaaattagacagtaacggtctaaaaccactatttatgctcttatccattattcttttaaagataaagcgagggacaaaaataaagtaaattcgaatatcattactaagacactcttggaattatgtggttcgtcctgttggcagtgactcatcactcatatatctcctctctttattggctgcagcaagccccaacgcggtctatgggtgatccacacggattacaactaatgctacagcacctgaaagagtcctatggtgacttgccaatttatgtccaggagaatggaaagtacagtttctgtttcccgtagagtaatcagaacgagcagcacatactgtttctcacttagttttatggagtcaattcatcctagtagatcacctgctaattaagaatctcttgactaatgaataattcgctgtgagcaagtttgctgccttcaaggttaaagctcgatctccttcctgttttttcagggaaggcatctagcaatgacagtctcgacgacactgacagggtggattacataaagggctacatagagggcgtcctgaatgcgaccaggtgatccaaaactcagagcccaaaaccacatgaaaattaaaatttcagacgccggatggttcagctcaaatgctcaatccaccatcttgattcttgaataagacctattgtctgatgatacatgttctgattgattttgctttgctgtgcgtgcatatgcaggaacggggttaatgcgagaggctacttcgctgggttcttcgtggacatgttcgagctcttgtccggataccagacgcgatacggcctataccgcgtggattt

SEQ ID NO: 40460 - DNA, 3524 bp, Oryza sativa
attcctgcagccactttaggtgtatagatttactaaaagaggaaaagaaaaaaaaacccgatcgctggccgcgattgatcgcgcgttagccttctcgaagatcatgcgtgttatggtatagaatccgaagatacaaaacattagtactccattcgttttaggttataatgcgttttgaatttggtcaaaatcaaactgttttaagtttaaccaaatttgtagaaaaatgtactaacattttcaacccaagacaaatttattatgaaaatatattcaaatattgatttgttaaaactaatttagtattataagtatgattatatttgtctataaacttagttaaatttgaaatagtttgactttgaccaaagtcaaaatatcttataacctgaaatggaggaagtagtattactcattatctaaatattgtattgggtgagtctaatttgagctagttctcagttaaagaatgatgtttttttctactagttcatagcaaataaacccttcactcaatcttaagttgagaaatagcttaagaacgagttgaacttggctgatatggctggttgcaaatccatatcggatgaaatgggctgaatgagctactaacacacgcggagggcgcaatttttgacaagcgatgttgaggtgggtgggtttttttaaaaacaaaataggttatgggcataatcttaaaataaggataataattatggtggtttatacaatttttcgttgtttttattctatccatgctcatccatctaatcaaataagaaactggattatactgtccattcaaccaaacaaaaaattaaccaccataccttatccctaaaaatataaatagctatagcccatccattcttgactacaaatcaaatacatcttaagtctatttaataaaaaaataaataataattatataattttttatcaaattgtatggcaaagatgtcatatattgcatacttttttttaataaggaaagggtcaaattcattacttgtgtgcttcagttcacataatagatacaatgactttcaatatcacttagaagcccaactaaaataagagaaaatttcgtatatatccctgaaactttgtctaattccttctatgtcactgaattttgctaattcccttgtatacatttgaattttaatttagatccttccataccatttccaatagttgaccaattcttatgaaaaaaaatccattgtaccttatggtatgaaaaatatataaatttttggagtatagaaatttgttgtatgagacttttatatccatgagtttctaatgtgaaatattatttataaaaaaattattttcagatatgacataaaagatttatatttatttttaatatttaaaattgtatatgtagcttattttctatagtagtacaacatatttgaatctatttatacgctacagtaaaataatttgataacaaataaattaatattattttttatgtcatatctgtaaataaattttatgataaataatatctcgcacaacaaactcacatatataagagtcttatataacaaatttttaccctccaacaatatattctataattttatatgtttgagttacaccaaaggacaaaatggtttttttatagaaatttaacggtcaactaacgaaaaaaatatgataaaaaatctaaactaaaactagagaatgagtaaaattcatggatacaagggtacaaggagaattttctcaaaataaaacatggtgctgaaatgctgaatgacaagcgttaattagtacgatgattcttcaattaattacacagctctagtgtgtaaaaggaactacgaaacgaaaaactattgtgtcagaactcagaagttaagttgtaatcgctatcatccaatcaataggtaatagagacagaatccctactccagttgtcatcactgtatcagaaacgaacgtgcagccgtatcatcatccaaccaacagctgaagcctaaacacacaaccgaaccaaaatttcactcacaccagagacaaagatttaacaaatttgctcaactaccgatcgaatgagtctgcagtacagtaatattcttcaacttggatcattgacatatagatctgttggttataagctcatatatcaacagcttaaaactagaggattagtattgtaaaggacgtgtttccctaccgaacactgccatccagcagaccaatttgcaacgatccaggaacgaaatgagccaccaatcaaagcttagtaattcggctgtaaaccggcctgtccctcctgtgcacagcaagtgcttggagcacgaccagcttgcgcaatgctcgtttacctgagaaacgctcaggagtttttcggctaactccaaaaggtagtgggctagatgatttggattcgaaatctcaccccttctaattatttgatattagattcttccctaatatttacgttcttttttcaatgctcgtttacctcggtgagacgcccgtgccatcgccgcaaatcggtgagacgtccgtgccaccgcctcgccatcgctgcaatcgcgctggaccaaccatcgtctagcaccaactaggcaactaccaactgatagtattatggacgtcttaatattgtcttcccgggctggatcacaaacatctctgatctctctgcagaaacacaatcgtcgctcgaatctgcttctcattctttttttcttgctgatcatcatgggcgctgctgctgctgctggcttcttcttcgtcctgctgttcctctctgttcaaggtggtgctgttggctacacgagaagcgattttcctcgggatttcgtctttggagccgccacctcggcatatcaggtgacgaactgaagatttgtctgaaccgaatttcccttacccggttttctgaacagtgcgtgcctttgttgtgcgtgtgcagtatgacggcgctgctgcagaggatggcaggagccctactatctgggacacgttcgcacatgaaggtcagtttttttttttgggttgctgttgtgcaacttgtgctattcatcatctgttcatgctcatagtcatatactccatccattccataaaaaataatcctagtatgaaatgtgatacattataatattatttatctgaatttagatttttaaagagtgtaaatttgatcttcgtttagataaaaattgagaatttaccttcttgacccatacgtggttgaccttcgatggccacatgtcattggtgacagatagagccagtggtactaataagtgaatagtgacaatatttttattggcaaaatttgctacaggacaccgaaagattgcggcctttgctgtgagacacccgaagatcgtgtatttgctcatggacactacaaaaaagtggtaactagctgcaggacacttctcccattattttattatttctggtcaaaacggacagagagagctgtgtaagtaccaaaatgccctggacacgtactggtcttcctctctctctcttcttttctt

SEQ ID NO: 40461 - DNA, 4029 bp, Oryza sativa
aatttctcagagagaaactagcagcacgtcatatttgcaaataaaaaataatttgttaataaaaattttatatacgtgttcttaacgatttaaaagcaaagattaaaaaataaactacgataaaaaaaacccaaatcaacttatttttcgccaacgcaaaaacaactccaaatttagggcccatttgaatcataagaatgcaaaaatagatgaataggaaaaatgcatgattctaataggaatgtaagtgcaaaacagataattacaaaatacagaaaaaacacaggaaggaccatttgattggaccgcaagaaaaacgtaggaattggatgagagagatagactcaaagataaattttcaaaaggttggagctcttactaaattttctctaaaatctctataggattatccgttccataggaatttcaaacgataacataaaattcaatcatttgtttcaaaggtctttatagaaaattttactatagaatcgaaatcctccaaaattttccccgcaaaaaaaaaagaaatcctccaaaattcccatgtctttcctctaaatcaaaggagcctttaaggttgaaaattttaaaatttagctgataagcataagtataaacaaaaagatgaggccatcaggccgctattggcttgtccacatattgtctctctatgtgtttcatgtcttacagacatgtgaacgcgcctcactattgtagcaaattcatgtatcttcaaagttctattcctgacaaccgactaaagatagaaacatggttccttaagttccatccctaatgcttcaccaaatcgaaatgagaattatcatcttagttttttctcctttccttcatcaaaacataaggcctaatttagttcccaaaaatttttctcaaaaacatcacatcaaatccttgaacaccctaatggagctttaaatatagataaaaaactaattgcacagttcacacgaaaattgtgagatgaatcttttgagcctaatctatgattagtcataagtattacggtaacccacatatgctaatgacggattaattaggtttaataaattcgtctcgcggtttccaggcgagctatgaaattagttttttcattcgtgtccaaaaaccccttctgacttctagtcaaacatccgatgtgacacccaaaaattttcttttcgtgaactaaacaatgcctaagttgaaaacttcggcttgtaagaactttacatgccttcctttttcagggtgatgtcaagctcatggctgaaactggcctagaggcttacaagttttccatctcctggtcaaggcttatcccaagtatagctatttctactcaaaactaaattcttgttaataaagttactactagtgtaatatgtatacttaatatgcagatgggaggggagctgtcaaccaagaagggctaaagtactacaataatgttattgatgagctagcaaaacgaggtaaatcttgcgaatcccttttacaaactataaatattgcaaagcgaaaaagaactgaaagaactttcatggatgttgattgctctgctttcttcaggaattcaaccccatatcatgctttgccatctagatctcccacaagctctggaagacgagtacgatggatggctaagccctagaattgtgtaagattcaataaccatctatatgaagtacaaaaatagtaggagtatggtgatagcttccataggatgagctctagactgctgatcagtagcaatggcacaatgcagggatgatttcactgcttatgcagatgtgtgcttcagggagtttggggacagggttttgcattggactactttggctgaacctaatatcgctgcacttggaggttacgacacaggagtattatctccaggacattgctctgatccttttggattgaccgaatgtacagtggggaactccaccgtggaaccatatataacagctcataatatgatactaacacatgcggctgttgttagactgtacagagaaaaatatcaagtgagtaatcatgtgcttaagaataccagtagtgtattttttgaatgtatttatattctctagggacagtactaagcattgcataggtctgatagaagttaaacagattatgttcaaagatgtagtgtatgattttttttttacaaaaataactacatgcatgtccagattcccttcttattttcttgctgttactcctcttatgtgaattcctcgaagtgctctgaaactgtctttcatgtaagctctacaaaaggggattgttggtataaacatgttttccttatggagttatccattaacaaactccattgcggatttgcaagcagctcaaagatacaaggatttctcgtacggatggtatgatcaatgttgcaactcttttatcttcacactgaaactagcggactgcacaattttgcacaaagctagattttatagaagtttacgactcttgcttccattttcatatataaatgcctgtatttttatacaattgtattgataaagcaacactattataatataaacccaccaaaatcaatcggtgcacatctttctctttttttcccagttaacgtagcaatttttagaaatgaacctagtggttccttttagctccctctttgtaatggataatagatatttgacatagacaggaatatatataagctcaccgttgaacttacgctgtgttcttatcccaggtttcacaacttatctccctcgttttccgtgcgcatgattttcaaactgttaaacggtgcgttttttaaaaaaaaaattttctatacgaaagttgcttaaaaaatcatattgatctatttttgaaaaaagaatagctaatacttaattaatcacgcgctaatgaattgttccgttttccgtgcgcactgttctggttgggaacaggctccagcgaacacagcattagaggataaacaactcttcttgtttgcaggatactgcacccattggtatttggagattacccacaagtaatgaagaaaactatcgattctcgtcttccatccttcagccaagtccaaactgaactaatcaagggtgctatagatttcattggaataaaccactactattcagcctacgtgaactatcgccctttggtagaaggtgttcgagactacgttgctgatcgatcagtaagcgctagaggttagccaattttctgattttctgttaatatgaacataattttttagctcttttttagataatagaagcttgttcctcgaaaaaaaagataatagaagctttattcataaatttgtagctctaggagtgagtagtttgattcattcatataaggacggtgtatgaagacgtatgtagacaaaaagaaaatcacagaaaatgataatgcatgacatatttctatgacaagaataaaaatacattttcatatcccgagttacttcctccgtttcacaatgcaagtcattctagcatttcccacattcatattaatggtaatgaatctagctagatatatatgtttagattcattaacatcaatatgaatgtagaaaatgttagaatgacttacattgtgaaacggagggagtactttactaagtcatccaatgatgatcctgaaaatgattctacaaattttcagatgggtagttttaccatcattgagaagatacgtgaggtaccatattttttaagtataaaatttggtatcttcatgtactaagtatatctcgaggtaacaaaaattttagtacaaatttaggtatcttaagttactttcttaatgatgataaaattttctttttcataatcacttttactagagtaaaagtattctgtagcttatcagttctatatgtttatgttatgcagtttataaaacggatccaccaacggagaaggtaagttaattttgtcatctctgatttttcttttgagataataagcattgttgattttcgacctttgtaaaaacttcctaaaaatgtgataggatcttagccta

SEQ ID NO: 40462 - DNA, 2257 bp, Oryza sativa
gcctagcttagttggtcgatggtgtggatgtatgcctggatcacccaagttatcccgtccttatcgaagcgaatttggatgcctattttcttcttaatacaaagccacctaattctcatagggttatcccatttcttatattaaaaactgaattgtgatagacacgtaatgttttgcattaagtgatgcaatcaataaagcgtataaaagaaataaagtaaactcgaagatcattgtcataatttttttttggtgcggcgataatttcataattgaaatactcttggatatacgtacctcatcctgttggcagtgacacatatatctcatctctttattgagtgcagtatgaacctacggagtatccaaatgatccaaaaggattgcaactagcgttggagtacctgagagagtcctatggggatttcccattttacatcgaggagaatggtaagtacagtttccaagtagagtattcagaacaggaagtacaatatgttggaaatttggtcataattcggcatattttaatccaaaataataagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaaatgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggttt

SEQ ID NO: 40463 - DNA, 1102 bp, Oryza sativa
gacttccaggaaacagcgccacctccaagtgtgaacacatatccacttgtggcttttatctcatcagcatcagatatccagtttgagtcactatacccttctagtacttttggatacccggtattgtgaattccatagctcatagtaccctttagatagcgcattactctttccagagcctaccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagcatacacatttgtcagcttcgttcacaacaaagcctgcagatgtaagcgtggtgtcaaacttctcatgacattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcgagtagtactcgaatcgtggtcaagcgagcaactagtgagtatgtgtcgaagaagtcctcgccttccttttgggtataacccttggccacaagccttgccttgtacttttcgattgtaccatcaagcctaagctttttcttgaaaacccatttgcatcctacgggcttgcacccatatggacgctcaacgacttcccaagtaccattagacataatcggggtgcagg

SEQ ID NO: 40464 - DNA, 712 bp, Oryza sativa
cccgcagcttcatgagcccacggatgatcttctcgttcctctcctcctccctccggctccccatcccccaccgtgagagaaagaaatcaaaatccccccgaaaatttcaccccacaaatcgcagcgaaaactgagagccttcgctggctcggcccccgaaatcggtgaaccctagctcgattggggcctcgcggggctgcgattcgggcgctggttggggggggattggaggttgggtgggctagggtttactggagaggaggaggaggagtgggcaaaaatgggaatggctgcggcgacggcgagtctctggagagaggaggaatgggagaaggaaaggcgacgcgaaaaaaaaaagaaaagaaaaaaaaaaggcgtttgggattagtggctgcctggaagccgacgggtcgggtgttttttttttccttctttttttggggattaactttggagttttttaacggcaagcttttggttgttgctttcctcgtcgtcggcgtcggcgtcgagtcgagttggatggagttggacgcgtcgcgacgtggatggatggtggattgatttgctgcgattgagtaacggtctgatgccgcattttcctctgcccttctctcttcttactgtactcattattttttctcaagaatctgcctcgttgtgcatgtcggattgtcggctgtgactgtctctgtgaccgcacctctacgtt

SEQ ID NO: 40465 - DNA, 850 bp, Oryza sativa
taaaggattttgaaacgatgtgatatattataatactataatgtgttatatttatctaaaattctttatattatggaacggaggcaagagggagtaccatctaggagtacaggtcatatcgggtaaattgcatctgcaagggctggatggccggagacccgatagcccattccccatttcccttatccggaaacagcctttgctttccccctccctaaaaccccccgcagcggcgcagcgccacctctcctcctcagccgaagcgtcggggccatggccatggcgatggcgtcgccgcccgcttgcccattcctcctctcgctctcggccggcgccaccgccatttccaccgtgtccgccgcctacggttccgtttccgccccgcgcgcgcctctcttcctcctcgcctccccgcgtcccgtcccgcctcgccgacccctcgccgcgggctcctcatctcccaaggccgcggcacccgccgccgtcgagatccccgaggagtacgtggacgatgttgatgcggtgaacattgcgcaggacgtcacccaggtgcatggccgcttccccatccacgcatatgctccatttttttgctttaacatgggaatgggtttccatctaaaacagtacagtgaaattggttaaggtcactaggatcatctcgtttagcttccagtattgtggtggttgagtctgtgaggtactggaattccatggtaaattttggtatttttctgtaagctcgcaatgggcatgggggataaatgataattggcttagatctcattttttgttctggctaggacaaactcacaatgggcatgaagtataattggttagatctcatttt

SEQ ID NO: 40466 - DNA, 760 bp, Oryza sativa
  unsure (1)..(760): unsure at all n locations
nnnnnnnnnnnnnnnnnnnnnnnnnnnnnnnnnnnnnnnnnnnntattctaagatcaactaagcatgtcgacagattaaaccaagaacaccaaagatggactgaacaaattgtttcaagcctcactccttattgccaagccaaccggcttatcatctacagagctttcttggcccatgtccaagaagccgcaaacgaagcttgagcgatgcaagcaagcaagcatatgcattatgcatccactcacttaccctctccatcccttcccgcgccgacggcgtctgcggcaatgtcattgcccacggctatcaacctctccttctcctcctccgcagtcgccgaggcggccggcgcatcagacttctgcgacccggttaacctcgcgagtagcacgaaggacatgccacccagcacgttgtttatgcaccggagagcaacgacggacaccttgaacaccgacggcggcgcggcgttggcgagcaggtactcgacgccgttcagcgtctggtaccgcaggttgctgctgacccccatgtggatcgcccaggtagcggcgttgagcagcgtgggcggcgccttgttcggggtctcgaacgccgggtccatgcgtttccgcagcgagatgaggccgttggagatcgcggtgccggcgagccccgcggcgaaccccacggcggcgaacgtggcgcccttggatagcagcgtcgcgacgcgggagcccaaggagtaggcgccggcctcgaacatgtggctggggagcc

SEQ ID NO: 40467 - DNA, 2606 bp, Oryza sativa
cgcgtgccgcccacccggcgaggaagatgccgaggatgccgccgctgctgcccccggaatccgcggcgtcgccagatccgccgccgccgccgtaggagcgcggcggcgggggcagcctgccacctggcccagacggaccagacggggacggggatcggaggcggaggaggagggcggacgacgacgaggagagcggggagaaggagaggctaccggcgcggggcggggagaggcgcggggaggagtcgaggtgcgtgggcgccgtggcagggaggaacttggcggcggtgaacgccatggaggccatggcgatcgggaggggagggcgccgcgcaggcttggcggcggcggcggggaggagagtgagatgggctttcgatgggggaagaagggttttggtggttggttggtgtagtgcaggctgtgctgtgcaggagtggtagtgaaaggtgtttggtgggggtgggtggccattttgtactgtacaacatgcgatgcgcttgcaacagaacgacggctgcacctggacgcgacgcgagagcgacgagacctactccttctgattggaaaaaatcgacgcatatgattctcgaactgcttgaatgcaaaattggaattttgccgtttcaaaattgaagtacggtgatttcttctgagattgtctctgattccaactatggctcaaagccagattgctagttatggctgtgtttcggaggtatgggttgggaaaacgacgtaattcctctgttgcatcaatatgaatatagtaaatgctagaatgatttgcattgtgaaacggaggaagtaatagtttagcaaataattaattatgtattatctaaaaaaatgaaaaatggattagtatgattttcttaaagcaaaattcatatagaaaatttctaaaaaagacactctgtttagcaatttgggaaccgtgcgtgcgaaaagaagttgagaacttgcaaaaaggaacacagcataattagaatgtttcacagtttcactgtttcaggctgtcgcgttttttttttgtcaagtttaggtagagttgtcaagcactctggcataacatgcgaaagtcagttatctagcaggaattgtcagaacacacgcgaaaacatttctgcattctttcagggataacattcattcagggagaagaaggatgctcttgcggctgtcaatagaaattagccactgcttcagagatcaatctgttgacatggctatgttgtcgcaaacaggaaacggaaaaccttaagaccagtatatagcagttacagagcacataccataaaggaaactgctcatcacatcagatggagataaagagaatgttaccggttacattttcataacagagcacctctttgggaatatacaacttatccaggaggccagttcatctgacgtccccctagaagatgaatatggaggtgatatacagactgacctacataacacagaaaaagtcagtccaactatcttaataagaaaggcctcaccgtctcaatgggatcaagcttatgctcacatccgttaggcccatcattgatgacaatcctgaatccatcatcaaggttctcctgctttgcaatggtcttagcagcgtaaagaagatggcccataacctcaacgtgtctttcttctgcctatgacaattgaaataggtgccagttgtagtatcattcagcaaaataatgtggctactcaaggatcatgatttgttgaaatgtgatatcatgattcttataaattattttaccacaatcaacgtgtacacggcaagtcggcaagatatattaacatggtagatgagcggatgacctgcgtggcagtgcccggcctcttagcgagttggtagagttttatagttactaatccgtagtatgttacggacatgaggatgaaaaaaaagtaaaatgttgtgttagatccaagaagcctaaggtataatattgaacttaaggtacaaagctacagagagagagagagagagagagagagagagattattatccattagtaaaaagaggcaatagtctactattttcaagcatctaccactctgccataacactcattctagtgaactgggtacatagctcactgtgaacttcacatatgaagaattcaagatggaatcaactaaatagaacccattacgatgtttaaaagataagatgaaactaagtacctttgagagcctagacaatccatctttaaccttgggaattattataatatgtactggagcttggggtgatatgtctctgaatgcaagggtctgcactgataagattcaaaacgtgacctattagcagctcattttcattcacaatcatgttcaagcaaacaacaaacgaattagttagtacatagcagtgattactaattaatgcagataccaaagttagttatcacggggaccgagccagaaaactagaacagttcttttcatgaacactgaatggagagaggataattaaccttccatatcaatattagctgtgaatgtgaacaaagaattcgaccacggcacaaaattctttcaggtgactagtgagataaatataaatgaaataacatgtacatctcgaacc

SEQ ID NO: 40468 - DNA, 6178 bp, Oryza sativa
ccgcaaaattttgtcaaaactgcaaggaagagaaataggtgtctgaatgaaaggtcaaaggtcatccatggaaatccacatttcatgaaggggataaaatagtaaacacaaccagaacaactgtggtaaagccttctcaaagaaaatagatgaaaattaatattcagcaaacgctgactagtaggcagattttagaaatgtaagaagcttgacctgctatgttatatagtagtagttatcgcagaacaattctctacaattagatatcatgcaagaataaaaaatgcatgttcatataaatatcacttgatgtgcaggaactcaacttctagtctacatgggttgttgtattaatattttgtacttttgctaccagatgctgatgcaatcaagcattgctcaattgttatgtggctctgttctaataaatgagcttctgttgaagaattactctctccgtatataattggtggccacagctgcactgcagcatgagggaccatttgaataagcccagtacagcattctacatttctcagatatctcaagatctcgattcattctagaaccaggtgaagttagttactattagctatccaacataattcaaatctaaccagcaacccagacatccaaggaaaatgcaggcccctaactctgagcaagaatattttgcgctgatctagccctgatcttcagatgtttcttcccaggatgtttatagctatgcaaacgcaccaaaatccattattattactgcacttaacccccacaagcagtgcttaacctcccccattatgaagaggatcggtttctgcagtgtccgcccataaacatggatgcttacaaccgaaaaaaaaaactaagcaccggtttgatagtttgatctccttagcgaatcaactcctcccacataatcaatctaaagggttattcaaattatataacgatcagaactgcattaacctaataactcatgctcgagctacatttttgtacaaattttacagcccccggtaccgaaactgcacaatagaatctgttcatccaacatccaatatcttccgtgcgcttactagaacaaatttctcgcagaactggtcaagtgaacaagacatcatgatgcgcatagatgagagagagagatacagagagactgacatggttggtccgtcggaggggccggcggcgagtgcggcctccttttcgccggccgtccgagaagattgggacaaatgagacgcgagaactgcgaggcggccgccgcttccgctcgccggcggcggcagctgcggcggcggtcgactggcactggcccggctcatcccttccccgacttcctcgcccaatcgctgacttactgctgcctccatcaccgtcacgctcgcacctcagcttttcaacagatttcccgcttactaaaggtcaaaacgtattttccagctttacgctatgttgccagtgtaaacgtacacgtgaaagacgcctgcacagactgctctgtaccgcattacaaccgctcttcttaaaacgatgctcccaacatactccctaatgtttgacgccgttaacttttttaaaaaattttgaccattcgtcttatttaaaaaatttaagtaattattaattctttttctatcatttgatttatttttaaatatatttttatgtatacatatagttttacacatttcacaaaagttttaagacgaacggtcaaacatgtttaaaaaagtcaactgtatcaaacatttaagaaatgagggagtattttactagtgctctttactagttcacttattttggaacggaggaaatatacaataagcatttaattactactagcttattgcatttaattactactagcttatttcagatcgaagaagtatatataacaagcatttgattgctggtgttaatccgaactcttatgattctcaagcccacaacatatgagaagacccgagctgccaagggagcaagtcctatcaaagcatcaatctatcatcatctggataatgtgagaatgacatatacggatgtttttttttgttttcttctatagattctgatttgaatgggatgagattcgtgctgtgaaaattacaaaaagagagaaacaaatcgcatcctagattccaagagtaaaagatgtttcaccaacagatgctgctgcgggaactgttgctcgaaatggcatctgacgaacaccgggttcaggatgtgatgcagtgagtacagcaggggcattcaggataagtatgtttcagcaactgatagcagatgatgttggagacagacagcgacatatgaagttaaccaccatttttcgcactaacataaattagccaaaataattatttctgacaaggatagatatctcaacaatcagatcatagtccagctagttctatccagaaattgaattttacagtaatgttacaacccttcatcttagtgaagtatttgggcttaaagattgcatcctccttgcagttctatggaagagcagccgatgtcaccaccaagtataagaaagctctgagaacctagatgtgtccagcaaatttacatactcctagctaggaaagtagcaaggcctcagaaagatagcagtgctaccagaacacatactaggctcctgctaatctacacaatacaaatcactaagctagacataagccaagaagaagctaggaaatgattctaaaccccaggaggcaaaacttacaagcaagagcacttcaaaaactataaaataaaatactgcgggcatgatcagaaatctgcggagcttgttctcctgagttgatacttgggttctggtacaggcacagcgcaaattaattcatccaactcctgaagatagcatgagaggggaaaacaagtcaatgctgtgtatggataagtaacccaatatggcatcatcagaatacaaaaatatatggtgtaaaatatatggaacaggacagtgtttggctgatagtaggattaagcacaaaattagcataatatatagtactagctaaattgatatccagtggcaagtgctaaaactttgaattatcattaaaggagtactactgccaattttcttgccacatcagatgcactgaaacaatgtggtaccagaaaaatatgaaatataaatagacatgagattaatacttctagctttccagggacatgattcagtccgttggatccttgctaatcttcctatagtacgaaggatgcttaaaagacgcatggccatccagggttaatgggatcaaaataacttagaaaatatcttttattgctaacactgctttgtttgaggagctaaccaattagtcagagggatgcaatatgttagaaccagagatgcaatatgttagaaccagagtccacaacagtattctgcaagcagaattcttcaaatgccataggtaagaagttactttattggacagtcatccaaaagttgacatgcagaagacaattcctacacacaaacaatgaccatgacgaagacctcttgattgtaacttgatacactacctatgaagtagtacagctcatcataccagatgataatattgctgttgattagactgcgatgtatttctatgttttccatcacaagattactcctagtataatgctgccccattttattatcgacttagagtgaataatagtataaggtagtcttttcgaagatatttaaggaaaaatacaagatacccccaatatccaccagaaaattagtttcctcccttcaggcacaaataagatactggctcaaataaatgcttgacgggacatgcctaataattagatcaactaatagaatgaacagtatatggctcactcctacagtcctacctaaaaacagtcacctcaagtggtggaagcaaatacttaagattatattattattatagagctgtgaaaacattgaaaaatcataaggtgtagtaaggccataaaagggtcttagtgatgtatgacaagtacatatcaacaaggtagcttgacaatatgaaatagtaaaaactagacataagagacagtacaagtgatagtatttatttcctgtcacttaccaaatagtctgactcctattcagaggcagaaagtgaagacaaattagggaagaattaattggttaatttataggacaagcatgcaccggggaaaaatacttgataggggaaatttgcaacattctgatataattgcagtggaaaagacagtaccttttgcctctttagcctcacattctcctcttctaaacgagaaaccttgttttcaagttcattagtgtaggcctgtcacaaatgaaatgtaattatgcaatcatgtgggtaatacacaaactcacaggtcacatgaagaaactaaatttaaagtaacagtggccttcttaatcatcatatgcagcaagaacaatgctaattaaaaatttgccacaaatagaaaggtgtaaaacacatattgcacctgcttcctggctcttgaacgggcagctgactccctgttcttgatcatcctcttctgccttctctccatcaacttatctgccacatcccctgacatgcctcgcttccttccaggcgtctgcgaatcggacattccgccgatcattcctgaagaagtctggccatcagagtaggatggctccagaatagcaccggggccaacattaagtggctgagggaccaatcgattcggaaaataagcaccctgcacaccttgctgcccatggtgatgagcatcagtagatgcaatctgctgcttatactgctctatccagtgtgatccaggtgccagatccacagtcccggttgctgtaacacctcttccaaccggatccacattgcctacatcactaagctccttgagagatccttgggtgacaaccccagctttgaccaggaaatcctcgagcgtcacctccccaagcgtcggctgcctctctcgccgccgtcgacctccgccgccgccgccgcccgtttcggcattcctcttcggagcagcctggatccccttccacacctcgtccaccgtcttcttgctgagctcaggcggcatcgtgatgctcccctgccgcaggaggcccgagcccggctgatgctgctggctactggtggtggcaccggcaccgtcggcgatggccaggccgtcagggaacacgctccggagcagctcgtcgaggttcatgctgtgcagcggctcgcccagctggctctgcacctcgtcgagggtgaggctgtacatggatccctgcctccccagactccgcatccgccctcctccgcgccgcgcgacgcccccgcctccggccttcgacgccattgtctggctccccatgatcgagacgagatttctgctgctacgaggtaaagaatggataccttcacaattgaattcgatccagccgcgttcagccccggcaggcagaccgacctgcttgtccccggtcgccgcggtgcaggcgaggaggtcggtcaggccaggccgcgcgcacaagggaggagcgcggcgtcggtaagggagaggaggccgtgcacaccgtgcgtccgttggccgcgggctgcggcccttctcgccggcggccggcgcggggcgaggagccgaggagacgatgtgcctgcggctcgcgctgccgtttctgtgtgtgtgtgtctctcagtcgctcttgcagattggaagttgggaccagggaggagtgtagtagtaggtgcgggaagagagaaatagatatggagatggaagcgggggatgcgaagtgggggcacgttggctattcatcattttctcgtgtcctttactgaaaataaaatttggttcaaacctttttctttttttatttgcctttttctatctaggaagactgatattagaaaactaaaaagagccactagaactatcattcgaataatatccttgtaaaattaagaaaacacggtgttaaatgcttgtctataaacttctgattacttaatatactgcagtgggaggctcctgctgttttccataaaaaaaatccaaaatgcccttttttatggttatattaattaatgtgaaaattctataaatttcacttttcaaaaataggcatatttttatgattattcgatgtaattattataaagttgaaaatggatttaaaacaatatccaaaaaa

SEQ ID NO: 40469 - DNA, 10990 bp, Oryza sativa
atgcatcctactaatagagatagcaatctagcatcgaggccaagttgtttatctagtttaactttttgagcctcttgtcgctgtaaatttatctggcaacttcaaaactgcactattatgtccagaatttgttttggaaatttaaattatgttcaaattatatgttgcaaaattaagtcaatatttttttttagaaaacacattataaacgcaaacgcttacatacacacgcataggggttgacaaaataagaccgaaccgaagaaccgaaccgaaaagaccgagaccgagaaattcggtctcagccctcaaaagaccaaatttttttcggacaattcggttattggcttcagttaactaaattaaccgagaaaaccgaattgtggcccaataggcctaggaggcccaataagcccagtaaattgctaaaccctagaagtcaccgctcctagtcatgagtcacgcgacgccctcaacccatccatcgcgccacctccgcctccgatccccatccatcgcgccgcctccgcccatcgcgccgcatcgcctccgcgggcatccatcgtgccgccgccgcctctagccagcccacctacgccatggccccgatgagcgccgcctccagccaacccgcctccgctgcaaccccgacgagcaccgccgaccgtcttggcgccgcctccagccaggctccgccgcggcccggacgggtgccgccatccgcctcggcgccgcctccagccgagctccgccacggccccaacaggtgccgccgtccgccttggcgccgcctccagccagcccgcctccgccacggccccgacaagcaccacctccagctgggctccgccgtggcctcgccactagcccttgtcgccgagccaccgaacgtctccagcgaatcggtctgaccgagaccgagatcgaatttgccggtcctgagtttcttggatgaaattccgtcctgatttttcaaaaaccgaaatgaacgaatgaacgaagaccgggaccgaatttttcagtcagaccgaacgcccacccctacacacgcacactcgctcctgtcaactcacaccctactatataagcaccttcgagagactggaccgatatattttaaaattgacgatgtacattattatcggcggatacgtcgcttcctactgaaataataattactccctccgtccataatatagcgatcgaaccggatgaaatgaagagagtagctgtaaatgtgagcattcacatcatgtgggtagaaaattcgaccatgtgtctccatttgtaggcttcaatttttttttggcaggccgcttccatttttgttaagatatttggacggcagataatgtgtatactggtaaccagttctaatcgtttggttagtttagtgctcgaactcaaaccttgtcatcaagaattcggacttggggaagccggcaagtaaggttatactattaatttttggatgcactgttccattaacaagaggaaagtgaaagcgatgtgctactactacatccaacaaattaaagcaattataatgcggcgtgatgatataaatgatggcaaccatctacacaataactctttaagttttaaatttaaatatatttaaagctttgcttgtcactctctgcaggcgccttgcctccttttcatatgtttccttgaagcaatctcgccgcgtgtaacttttctcatcaaaagataagcagcttgatcatgctgatctccttaataaaacagagcctttcttcaaggacgccaggccggcctgatcctaccacctgattattttttaaaaaatttggatgtatcactgtatcatcgcgcacaatgattatattattgcgttaagttctcacatccaacacaaacaatgatggttaagtccaacgcgtgttcgtgtggcagctgtgtcgagtgtttaaaaaacaaaaaatcttcatgcaccttgcctgatgcctgctagtcccgtgatctctacgtgatttgtgacacgcttatagcatcaaggatcgcacaacaaattggcgtgtagcgcgatagcgtcgtccatcggcgagattttgtcggttcgagacctgatctcgtgtgagctaagattaccacgatttcatatcacggcgacgcaaacatgcaatatactgcaaactgcgtcccctcgatgcaaccgcgctagtgccggtttatgtgttccaactgacgcttcccatgttgccggtcgctgtcaacggcgttgttccgctggtgcatggtcggtccgatccgatcgcaaaaccgagtgcgccattcgcagacaaagccggccgggatcatctcccctctttggctccggtcgtggcttcgtcgtgggcgtccaaatgggggcgagtcgttgtgtcggctgctgccactggccaggctaaggcgcgcgagcggtcacttgcgcggcgcgcgtaggatggaatgattgccgcgacgtcacccggccgcacttgcgcttgcgcttgcgcccggtggtgcgtcgaggtgaaaggtgggtgaattggtggtggccctgtcgcgctcgcgtcgtccgtccgatcgacctgaggaggtgtggcaactgggcattggcaaatggcaataccacggcgcgagaccgaacgccgccggcgcgcgtacgcctcgttgcgttgaggtggtttggtacttggtgggggcgattgggcagccagtacgagtggcgctcggctctgcggttgattggcccccaggttgtgaaatatggctggaactgattagctatgtgccttttggtacggcgctgccttttacaaaaaaaaatgctcaagtttatagaaataacatcatatgataatagtagaaataacgtctaagatagctaaatgacaagtttatagaatttgtttttttatcgatcattggaaaaggctctaaatgtggtttatgataattcaaatagtatatagattgataatacaaaagtaaaaaaatagatggtgtgacttaatgagagaaaaaatgagataaataatttggactataaattaatcataaaaaaattagaagaggtggatgatgtgatttaatgagagaagataaaaaacattaactaagtttggaattcgttactaaaccccaatactaggtataacccacccccgaactaccaaactgtgtcaactttcatcccaagacagaatggctcagtgactccagtttcgtttgatgtgacgctttgactctggccaattgtatttaatcagcataagacccatgtgagcctaacatgtcagcaaccaactatttccttctttctctctcctctctcccctctcttccccatcctcaccagggggaggcaagccgtggatgacatggacaggggcgatgaccggcatccagtaggagaaggaggaaatggcaaagcgaggaggtggtgtcgttgtggcggtggcgggagggagatgagggaggtggcggtgctacaacagctaatcggtgaggtgcaggagctctagaacctctaaggtgctcacttcgttccccctccctaggcaagcaagcaacaagtcaacaaccatctctcctcttcccccattctctaactctcttgttcgtcatcagcctgcgatttcctcgctacgcttctccttcgcgtacttggtcaggcaccgacactaccacctgctgcccgtccgcgaacgcgcgcctcagtctgcccaccttccacacgggatgacactgctgccgatttccaaacctccttcgccaccacctcggcaatgattcgcacttcctcccgacgctggcgagtagcagacattagccgacgaggcctacaaccctgactgtctaccacccaccatcaccacctcctccctggcgcatctccgtctcgccgactctaccaccaccgccgtcgacgatgacgatgatgaaagggataaaagaggggaaagagggggcgacaagtgggtctcactgtattttttaattattaatcgaacacttactgataggtgggtctcatgtttttttttactttaagtgccatatcaaccccacgtaggcgtcatgtcagtcgaaactgtcgttcaaaccaccttggaatcttatttgcactggttttgggagttgagggacacatcatatctgttattgtggttcatgacgaatttcggactcggtgacaattttgagggacctaatgtgaacttattcctcccgggaaaaaaacgagcccaataggcgtgttacttggtccaggacaggcacgcgtatgaagcctgcagtaggcgggccaactaaacatataatagtcctcttaacgttcaggcccaatagctggagcaattggagaccagtttagggtaacaaggaattttctcgattaatgttatcgagaatatagagcggtattctcaaaaaaaaaagagaaaagaatatagagcggtaagcaggtgaatcacggtaaaaaaaacgtaattgtaggaccaaaccatccctaactttaataggaaaaaaatgactttgctagtttcaaccctctttgaaacatttcagtacaggatttacaaaaccgtacgattaccacacggttataatggttacaataattatcatgcacggttactttttcagtttttaaaatcacgatatgtctcgtggttatcgcgcggttttcacggtaaccaccttatcacggagtgcgatatccacgtcgaaaacggtagggaaacctgaccacgacacgtcgagacatgttcttttcctttccgcgcgcggcaacgcggctgtataaatactcacctacgcagctacgtccgcatatttgcctctgccacacacgtacgcgcaaacgtgtcatcgtgcgacacagacgcttggcccccgcggagacgcatgacggcaagagtcgcaatgcgctaagcaaacctctccttgtgcagtggagtcccatacagccgcgcgcgagtggtggtgcgcacctgcatggaggcaccactccacttcacggcgcgcaggtacccagcattttccgagaccttgaccgtaaaaacgcccgtcgcccccacacgcctggccacggcggcgtcacgccaagtgtcgtggcgctcggggtggaagctatagtgcccagacctttgcctcccttctcagatcactaggagtactccagatcagtctcagtagtcagtacagtcctcctccttgcttccctatataggcaggttcacttcaccggtgacacccactacccttgtctgttgtctttgttgccaaggaggaaagcaaacaggggccttgcaggagctatcaacaaaagccatggtctccatgaggaagaagaagaaggcctttgctgttgcagctgcaaccaccttgctttcccctcctcggtcctcctcctcctcctcctccacggcgtcctcctgcattgtgccgccgcgcactgagagcggcaagaagaagagtaagcacaggaagagggccaaggatggcaccggcggtgacgacgacgacgccgccgttgctgctgcgccgaggaagggatcctccatctacaagggcgtggcaaggtctgcgttttcgattcctttttcttgctctgatgatcagttcgcagttgtttgcgtgatctttgcttggtttctgatgaatgcgtcgtttgttgtgtgttgctggtgtgtaggcacaggggttcagggaagtacgaggcgcacctgtgggacaagcaaggctggaacccaaaccagacaaggaagagaggcaggcaaggtgagaaatacaaattctacgagcctcgggtctactatgttttctgcagctaatgggacaagttgattgccattttgtttttctttgttctctctttctttggttattgttaggtcattttgtattcctgctagcttatgtgctgatcttttttaatttgtgttgcaaatgcggtgtttccttctgcctcggaattcgtgtggtgatcgatgctcatccatgtctgatgtctcatcgcctccattagtctatctgggtgagtcaagatcctcttcacatcgtgggaaaagttcacaaactttttcttcgctatgattcacaaattatcactagcgtgtatggctccgaattccattgccgtcctagtaccatgcacatattctttcttcagaataactttgaatccgcagctactttgttctttctttcttggaaaagagagtaattctttctttcttggaaaagagagtaaagaagaaacacttttgggtaaagtggaaaagtactgcattttgcctgtccccatgcatgcgtcaagatacattttttacaacttcaacagaatcatcaagatcatgctctcactcgctaccagtacatttttttttatgtagaacatgctgaaaatacacggattaagccattagcattgtttctttgcaggagcttatgacacagaggaggctgcagctcgcacttatgatcttgcggcactcaagatctggggctcagaccatgtcctaaacttcccggtaaagttcagagtgtttcagcacctgtcatttcccagtagcactaattcgccgttactaattaaggaggagatgatgttaacttgttaagctcccatttgtgataaatgcagattgacacgtacaggaaggagcttgagaggatgcagcgaatgacaagggaggagtacctggctactctgaggcgcaagagcagtggcttctccaggggtgtctccaagtacaggggagtggcaaagtaagcatacattgtcatgcaatatcactgtactgtccaatcaagcactagctaagcattgtcctttgcatagcccagtagtactagtacctcttttccgtccaaaacccatttcttggttctccaaatggcatactgtgatactggcaaatctggcatgagaatacggtgtgctactagtactgtgaaaattgaaatgccaaaaaccgggttgaagttcttttgccttggctaagctctactagtaggagtagtctcaacatttgactgcaatgcccatgtttgtcaccgcaggcatcaccacaacggccggtgggaggccaggataggccgagctgtaggcaagaaatacctctacctgggaacattcggtaacgcgttcttggttttgttcaccggctacattctgttcctgacgccatgaaaactgcagtttgttaacaatggacaaccaatgcacatgtatcagtaccaccacatatgttcgtgtcgtatgttattcgctttcgtgattgttaatttgtcgtgtcatgcatgcaatgctgcctttctctttggcacaatgtgatgcttgaagaatgctactgctgcagtgctgcgtactgcacggctactgttacaaaggcccacagaatgtgccccctgaaagatggatgtttcttttgctctgtacgtgcagatacccaggaggaggcagccacggcctacgacctggcggcgatacagctccgcggccgcagcgcggtcaccaacttcgacgccagctgctacacctacacggaccacctgccgccgccgccgccgccgcagccaccgtccgtctgcaagaccgagccggagctggagccgccgcagccggcggcgcctccaggctcggagtcacttctccggcccaagatggagccctgcgacgactgggagccgccggcgatttgcccgtcgctccgtgacgcggacgacgcggaccacgccatcgccgagatcctgccggcgctctgcatggaccgcgccgacttcgaggccaggtaccctgcccgccgcgcccgcgacgccgccgccgacggctggtcgacgtcgtcggacgacgtcgccgccgcctccgtcgacgatgacgtgctgcgtagcctgccagacgacgtgggcttcgtcgacgacgtcgagagcctcttcctggacgcgcccggcccggccgccgccgccgccgccgccgcgatgccagacgacgtggaacgcgcggtgcagcgcgcgccttctgccgcgtctcgtcgggccaacgccgcggcggtctcctacgcgatcagctcgttggcgtccgggcgctggtggtattgacatcacgtactgacgtacgtgtcggtgtcacgccatgtcgcgcatgcatgcactgtgtttgcacagcttcgcaaagttggtgaaactgcagctagccagctatagttagggtgttgcgttttggtgggtatgatgtgaagtgaagtggagtagcttgagcttgacaagcgtggtccaatttttggcgagtaattgcgggcgatatgctagccaggagtatctgcgtggctgctcgatctcattgtagtacgtgaaagtggaagaaacaggagaaggctcacacttttgggtgtaactccactgtggtagcgagctggttttggtacttgcaccctgtcggattcgggtataattaagctgccgcttgtccgagttgaatgttggcgtgacaagttgacaactccacgtaagagtgtgacaatcatgttggccattcacaatacatctacatggcatttggcctcaattgtccagctaagcagattgtatacgtggagaagaaaagaaggtgaggcccatatattcaccagctccgcgcgtcctcatttggctccgagagcctcgtcagaaaaacagcttttttaatcgtatttgcacatgagaaagcatgacacagagagagaagggggagaagctgacccaaaaaagtaaatttttgtggtggggcccacatgagaaacagtttggtggggtccacctaaagacacgcgtccacgccgcattgtggagaggggagcttcacgctgtttcttcgtacgtggctgtttaggctcctcagaaaaacacgacgcagtgctaatgcctttaggacttaggaccctttgcggcagtagtggtaaacagaagtcatgggtgatcattggtccgatgcttcaggcgaaaccaattcccgggcgaaaccaattccaggagtgtgatagggacagaaaaacggtttacaaaattatcatgtgcggtaatattatcggtttttaaaattactatgatatacctcgcagtaatcacatgatttcacagtaaacacaaagttactgcggtaacagcattattttcgcgtttctaaaactactgtatatctcgtagtaaccgattttcacgagaaagaaactcacggttaccgtgataaccgttaaactttgagtgatgataaactcatctaaaatatatagtttggtgtaccttgttcagtaaccgttaaatcgtagggtaacggtaaatatctaaagcagtttggttaaccctactagtagctactattactgcaacaagctagctacgtgtacatacgtgtcgcgtgtgagcagaatgtatagtattggttaggagtacttagtagtagttggtacagccgtatttggctactccaagctcttgttgatttgacaggagtgtatagttacgattccatcaatgcatgttggtggtgagtgttgcaccgacgaacatgcgtgacattaaaatcttgtcgcctgcagtgcaggctacaaaatgaacctgtctagagagatgcggcaggctgcaggctgatcgctgacgtctgtaccggaggaacagtagtgagtagtctctctcgtgtggatgttgagcagcgctctggagataaaaggagttctaaactttttcttgaaacttttaatttttctatcacatcaaaatttttttacacatataaacttttaacttttccatcacatcgtttcaattttaaccaaacttttaattttactgtgaactaaagacaccccttgggttatatctaaagccttccgttgtaagcaaggtctatatatgaaaaaggagcaaaatttggtcgtgttggggtcttgggggtggctagtcgctctcttaagatagctgcattgctaagcttcctccagctatatattgaaacattctgtttttggcgaacgtacgtgcgggaggagttcagccaacctgcatgcatgtatgtatgtatacctggttcgcgctaaataaattaattcttactcgtcgaataaacgtatatacgtataaagaaaagtaagatatcgatgcttcaccataaaggagctttgtgttgaagctaggcctctagaaaacagaatggtcttaaattctgtcaaactaaaattaatggtctgtctgaaagtggtggaatttcacttagaaaagtcctgttttaggcattactcaaattttataggaattaaataaattaatttctagagtctgtacatataaactgtgtgtataagcttaaaaaaggaaaccgcatggtgcacgcgcggtgggcatgcacatgaaataaattttgaataaaaactatatgctcttaaaccacatactaaataaatgtttataattaaaaatgagcatacgcatttttgaaagaaaaaaaatgagcattcatatcataaaaagaaaaccaacaaacagatgagaagtcaaacaagttcaacccaactgacctgttgggctgggccgggtcaaacctgtcaacctacaccatccaccagcccaaagcgaatcctatcccatcattccttcctggctcggggagaaatgccgcccagaatatcgatcgcatcgaatccagtcaacttgctcggtgtgatcccacggcggcagccgcaagccgaagcatcggacggacagaaacgactgcatccgtccacgcgtgcggctcgtgacgacggtggtggggctcgcgttctctcccccagctatattatctcacacgactcgtgccacaccgcaccgcaccgcacccgcaagcgcaagcccagccgcctcgtcgtgttcgcgttcgtcgcgcggctccgacctccaaagccgccgctacccttcccgtcttcgtcgtcgccgcgcacgcagatcgcgaaccagcccgcgcgccgcgcagcagcgccgcgga

SEQ ID NO: 40470 - DNA, 3370 bp, Oryza sativa
tgcgccccgtcgtttcatggatcgaacagcacgctatggggatgtgggtgtttagatctcccggatctcgtaccttgggctcatcaatttccgcttagttctgtgtgctgtcaagtgagcatgggcgcgtggggatcggcgcgaagtctgcggtgatctgtgttgctagctgagacttacctgtgctgctgaatttttgttttggagcagtagggagagatggggctcacgttcacgaagctgttcagccgcctcttcgcgaagaaagagatgaggattctcatggtcgggctcgatgcagccggtaagaccaccatcctctacaagctcaagcttggcgagatcgtcacgaccatccccaccatcggtaagcactctgttcatgtccttgttcttcttaatgagctgtcttagctgtaggaaggtactatgctgcacgtttatgtacaggaacgaacttttaattacatggagtgatggagtgagcactagttctgtttgtagaaacaaacttgaatttaaactctacatggagtgagcactagttctgttatgtagaaacaaacttgaatttaaactctagtaaggaggaatagttagcacgagcttgttcgtattataatcacatagcaaactttgatgttaaggtattggatatcactttggctacaaataaatttactacttgaaactttggttagaactaagccaagcatatgctactacacttctgtagctcttaatggaaacatctgtaattctctatacttgtgattattcttaatgatacatatgtatgcatctgttcatatggactccttttattgggtcattatgataatgtatttgtatttttgccatgtggcttcattgcattatagttttaataaatgaaactaccttattctggaaattttcaggatttaatgttgaaaccgtggaatacaagaacatcagcttcactgtttgggatgtcggtggccaggacaaggtaatagagtcagcttatagttagaaatcataactaccatttgttggctgttcctagcccttggggtaaaccggaattgaacttcttttatgcattgatgttgtcgtgctaagctgctaatgctgtcatgaactttcccaacttaattcttttattgatctataaatcaaaacagatcaggcccctgtggaggcactatttccagaacacacagggactcatctttgttgtggacagcaatgatagggagcgtgttgttgaggccagagacgagcttcacaggatgctgaacgaggtaatgatttttgttgtagacttgtagatatttggttgttccatagtgttcccagtctgcatatattgaatctatttacgaagcgcttattcgacattattgcagctacaaaattggaaaaaagtaagttgcttgtttggttcacaaaaatcttaggattttccatgaccttgtatgaaaatgctaagatagtagttgaaatgctatgaatcagtagtcatttttgttcaacctatttgtctgttgatttatttaaaacttactgttagaaataccagttccctaaattatcataaaccaattaattccatgttaataatgagagacccttctgtgtcgcaggatgagctgcgtgatgctgtgctgcttgtatttgcaaacaaacaagatcttcctaatgccatgaatgcagctgaaatcactgacaagcttggtttgcattccctgcgccagaggcactggtaaggaactccatatgaacaattcaaaagttatttaccttctaattgcttggtcagagttatgcagctctgctattctgcaaattatcagggtttacatattggacatgctgaaaacaacacaactagatctgtttgcaagagtatagtgcattttttaatgggttaattggatccatgccattacaacttcttcgattttgaaaaacaccattactattcgtctatttggagacatgtatgtgacacactctagatgtttttgatggtttatttagtcttgtggttggggttgaatgttacaaatgctatttgcatctgcattatggtttacacatctattgtgacactggttaccttttgaaatttatgaaatatgcatcatgtcattaaaatatttgtttcctggtgtcgcaggtacattcagagcacttgtgctacatctggtgaagggttgtatgagggtcttgactggctttccaacaacattgccagcaaggtatgttggcctattctaatgtcttagtctctgcttttgttgaaggcctattctggcctgaactttggcgtttaacttagggatagaagaaagctgaaccatgttactcgagcactgcctttatatacctcaataaaatcgctccgagtacttggccttaaaccttaagcatctgcagctgatgacatgcattttcattatttttgtgcaggcttgagcgttttggcagctggatatctgaacaattcactagtgccggtttacatattatataacatatacaccctaccacacatagtgtgggtgcctgtgaaggaaaaaactcctttgtggaggctagtaccagattgttccttttcgtgggcactataagtgcttatattttgtttggttttacaacatttactgtgctgtccatatgtacccgtttgttctgagatggtctagtaaattgatatgctttgtcacggacttggtgtgagcattgtattttagtttttctatgatctagtgccagtgtagatattattttcctcagcttcaaacttccgtttttggttgtcgacatcgttgttgcgtcacggatgcttgcggtgaggaaagtgatgaggtatatggttttctgactgcatatgcccattggtaattgtgacattgatacgccattgctgggttgccacaaaccaacaggcccgattgcccactgggtgcgaggtttctgtgagacagaatcacaataagatgacatcagtcaagaataatttgtaggtcatgtagtatgggtatatacactatatacgttgagtacaggaaacacgcattcattgggatgttgtaggccttgtgcaaaatcttacgaaacaaatgccaaattgaatatctgtgtgtcaagtggtattcagtactaccagttttctgtattgagtaatgactggcaaagataaaaggttgcctcagatcattacatgtctttgcttgacggaaagacaagcaaaagctaattcaaagcatcacctcttctgtttaagaaaggcagtcacgtcttatgcaagtcattcattcaagcaaatactaatgaatttgttacaccacgctttggggtgttgtacaaagtcgtcacggca

SEQ ID NO: 40471 - DNA, 2315 bp, Oryza sativa
ttcctgcagcccccatgtgtggtatactccatgagtttttggcctggaaagcatattaccaatgtaaaagatatttctcttttccaataataaagctatatgttctgaatcaagtaacagcatggacaaaatctaatgatgaacatgtattgatattcattttaccaagaaaaaaacaggatattcgttgaaagaaactggaggaggccaaatgactcaagaagaggtctacttacatatacatattttggggatcaatttcattaaatagattgatgtagaagcgcaacccatctggactgacatccctgcaaaggatacctgacaaagaagttggtattagtttatctttttatatatagtgttcatggcttgaattttttttgaatgggtaaccatctaataccaatgctttctgcatttagaagatgctccttcgctaaagcaggtgcaatcccaagtgtaaatgcagcatcgctggggcttattcccttctgaagggcatcctccttttgtgcaagtgatgagattctcgcaaatacctatgcatatcggcaaataatcagcatgtgcttctgcttaaaacgataatagtagcgttcaatctgaaggtaacagtgggcaggtgcccaccaacaaattaaatgaaatggaagataactaaacaattggaaggtccagagatatttagccacactctttgtgtgactgctaacttgggattgttatgtcgtgtgatgtgtggactgtttgacttgaatttatgatgaaatttaggcctattcttgccagtgcttacctcatcatcactatgcgtcttggtctggatcaccttcactccactgtcaaatttcctgagcatgactgggctgctcattacaaatcaacatctataagcaaaacatagaaccataattaatggctggcaacaaaccagctgaaaatactaaaaaacacattacaacatggggtacatacacgtcaaatttctcccaaagggaacaggcttgcagaagatcctctggtgagatcaactctacacaaaatataaggaaaaaaaacaatatcagaacatgtaacaaaggaattccatacagatacttagcagaaaagcacagacctgtccctcttgcacggttgtagagacaatagacatcaactagtgccatcataccacctgctttctctagtggtgttctaatatagtcagccaactgataatgaatacaaaaggttgaaaatagccttagtaagactgctctaaccgggaggactcagaagaagataaaaactcttcaaaacagtgacgagttatagaggcaaggacatttttggtgttcctgtcaattgtgtatgaaacagaacttgagtgtaaaatctgtggtctgtagttgaaataaaagaaaaccctctgaatgattcccaaatttgacccaactaatgtgtaagcactaagcagcgtgaaacaattcaggcatgaggcaaagaaatgaacagaaagtactgttcaatagaagtagaggctcttggttgatggaggaaaaggacacacaatttatcctgaagatcctatggcgataaaacctctcaagttgaagatttggtctagctggcatgatattatacaaagttcatgcattgccatcagcatcacaattgagcttcacagacagtgaaaactacttcacaatgaatgcagcaagaacacgagcaaagcatgtattacctggcgtgacagctgctggtggtacagagcaccagcggtttctttcgtcacaggggacacgattccaacactcaatagccaatcctgcatgtcttgcttagatcccatctcttcatcattggaattggattgggctgatgagttcgtcaatagcttttgcctcattttctccgctaactccatcatttccttagctttgctctaattacaagattgcagcaaaacacacacaaaaaaaaaaagctgcgttgtaaaaacatatttgttccaataccatatgactgcgttacaagaactaaatgtggaaattttacattttagctgcgttgtggagcatggtgttccagtaatccagtcaattacgattgcatcacaagaactaaatgtggacatggtatcaagtactacttggcaagagcagcagagaggaacgaaccatgagggcgttgagatcctggaaggcatcctgcagattctgccccgcgctctcccacgcctcctgctccatccgcaggatcccggacaccccaaccacgggcatcctgatggcgagatcctcctccgcgggggccccctgcgccgccgagga

SEQ ID NO: 40472 - DNA, 3022 bp, Oryza sativa
gggggcagggagatttggaggcggacgcgcgggtggtgcgacgaggaggacgaggaggaggaggagaagatggagcggagggggttgtggccgtgcttgcggtggggcgggtaggcgtggacgacggcggcgagcgggagggcgcgcgcggagcgggagggctcgtggaggaagatgaggcggtgggaggtgaggacgaggaggcgggcgcggagggggccgaggcgggggctctcctcgggctccacgtccccctgcgcgacgaggtggcgctcgacctcccccgcggtcagcaccggccgccccgccgccgtcacgtccgcggccgggagccagtcggccgccgcggcggacatggtgatgactactgctgctgctgctgctggtggtgacccgggtgagctcgcgttgggtttttgcgtatttgggcccggattgcaatcgcacacggccgccgccggagccggacgagtcagtactcagtaccaggcagcaaggttcacaatttggataaaaaccggtcgaatttcgtgcgcttcgacatggctcagaattaagtttcgattaaaattttaaaggttaaacaatatatttggtcaaaattcagttaaaatttatcaaaaaccgtgatgtcaatgaggctcgaaatttagtggtcaaccggtaatgtaaaccctgagtcagtacacggcctgacgtcagcccgaaccgcgaagggcaacccctaaggctggattctaagttcactatcctaactttatcttcctccgttttctgcgcgcacgtttcttaaacggttaaacggtatatcttttataaaaaaatattttaaaaaaaatcatattaatacatttttcatttttatttagctagtacttttattaatcatgtcttaataagacatgcatacgtcattttgtgtgccaaaagctcttggattgtgcaaattccatatttccgccctaactcgaacacaaaaccatcttctcccttgatcttaatgtgtagcaacttatggtaaaattaaaatcatcttaaaactatgaatttggacatatcttgtctagattcacagtgctacatattgagacgaatgtagtatttatcttttgatatatttagagctccaaattttaaaaaccagtaaccaataaatacaacccattcagaatgaaatagaaaaacgaacatgtcaagaaatcacaagtccagacaaaaaaaacgtaaaaatataattttggtgcgctgcaaaaggttgtcctagtatctcgtgataatactatgattttatcaagtcgaaacgataccaatcctatctagtatcctactttttataatatctcgaccctcctattcatttctacacgattatatgaaatcttaagtattatctcgattctatgatccctaattccctatgatcctacaaaatattattcaaaataacgtggattgataataatataaataaatatgctcaagtttacatcgaaaccaattaaatttatcaaaatcattattatatgctttaatttatataatatattataattgctttgtaacttaacgtaagtctgacgtatcggaatacaaatcttaatacaagatcctaatagaagcctaaaaatctatagtaagtgaaataggaaaaccgaaatctagtgatgagctcgtattgatttgcgcaataccagcggggcaacaaagcgagagagagttaatatagcacaacaacacgaataagcatgcagacattggattctgcagataaagagtactccctccatactcatattagaagtcgtttaggacataattgtgcatactaaggagtgattaagtagagatattttttcatgtctgcccctaataaatagggatgtggatgcattctgtacgataagcaatcatagctcaaatggctagtgcagagatcactttctttttgcttgcaataactacgcatacgtgatgacgagcgcaacggacggcgagcgcagagccatacacgaccccgcgggcgaacgacgacatgtattgtgaaaacggaccaaaggccttagaacgacatctaatatgagtatggagggagtatacgattttcagttccgtcacatttctttattattcatagctcggctaccatgttcatatgcgttctgctgctgcctctgcacaacacatgaaccagagttcaatgtgtctaggcgagacaaagattccagcttttgtcaccgagaaatttcttgagcgatttggttggccaacgcgagagatcgattcactgcggagcaatcagcacgggatccttctttcccttgagaaagtccgagtaccaacgagcggagcgcctcgctcgccgcggccgcgcgccgtcgtcgaaatccacacggtacaggccggatcgcgactggtagccttccaggagctcgtacacgtccacaaatgaccaaacgaagtagcctctcacatcaaccccgttcctgcacaaagcagagatcaatcagaacagcatgaggcctcatgtttacgattatcagctaaaatctaaatttttaactttaaatttaaagttaaatttgggattatttttattgtatattatttttcagccttcgtttttacaccgttaagaacacatatataaaagttttattcgaggaataagccaaatgatggggctggaagatggattgaagtgaaactcatgtagtttgacacactgatactgatgtttggagatcacctgattgcatccaggacacctccaatgtagcccttgatgtaatccaccctatcagggtcgtcgagactgtcatttgtagatcccttccctgaagaaaaagaaaacaggcaagtgagaaagagtattgtgttggaaatctagtcataattcgccatattttagtccaaagtaacaagataataaacatgatatttacaataggatttgatccagtgatagtggtgaatgtaatcaacatgcgcatgcttaacgttaaataagcatcaacaatcacat

SEQ ID NO: 40473 - DNA, 1442 bp, Oryza sativa
gcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgatgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctaggcattgggccaaggactgtcctgagcgcaaagacaggaagtctgccaacatgatcattagcgagggcggaggaacatcggggtacggtaaaatattacctacagttctctctgtttttcattcacttgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaagattatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctat

SEQ ID NO: 40474 - DNA, 1469 bp, Oryza sativa
aaggatcctgatccattggatatgtctgaggaagctaaggccgagagatggtttaggagggcagcacagataaaggacatctccgagctcgccaacatccctgacgaggacttcccggagataatgccgatgaggaagggcgtgaacaggttcgtcgtcagcaagaggaagacaccactggagaggagattaacatcacctcagtacagaagaaacctgcctatcgtaagttctgaaccgaacgaagacgctaactaaaaaaaaaaggtgtggttacgaaatttccagtgcaacagcgaggagttaaaacaccaagggcattctttacagcagttttgtgataataagccagcacaagacggttctctgtattgtaaaatttttgttctgaaccttccatttattttgtacttccagggaatccatgttgtatatgaaaccttcgatactgaaactctgcatgacactgttgaactattacttttctgcggcttcaaatgtccaatctttcaatgaaattgttctttgggctctaacgttgcatattcctgtggaagatgtttttttatttccgaaaattattcgccatttttttcagttttcttaatcacgtcatttattcaatttgacttagcccggcatcgatgaagtttgtcaaaagaaaaacgaaaggagaaaaaagaaaaaaactccagagccgacccagtaagccgtgggcctttgtatcgagagaagcagtactaggtttcctctggaacggcccattattccagaaggcccatctgcgaggtcatcaaaaccctacccgagcggccacacccatttccctactcccaccccccgccgccgccgccaccaccgcagctgcgccgcttcaaggtaaatctcccattcttctccccctcgctcgcccttcctctgcgtcctcgtagattcgtccgtgcggaagcagttcgtgcggtgattttgcctgttcttccgttggatttgcgagttctggttggtttctgatccaaggctaagcaaccagttctttagttttgccgttctatattgggatgtgttcgtccgtatcccgtgcttgagtagttagtacatgttttgttgttcctgtgatctgcatgtgtgtccatggttcaagcgctaggaattcttctccgaagcgtaaatgatttgcttgctgtacgcgatctctcttgcacaggcacttggtcaccatgctagctgaagtcgtgtggtggcctaatcttattgctgtgcaagatggacatgggtgcacagtttgcagcagtgacttctttgtgtctctgctgttagtagttacccaacaatcaatcagtctttggcttgaagggtaaatgcctgactggtgatctggttcatgctggacacagccttttcttgttgcttttatacttttagtgttaactgaatcagagcacaagtactgaggcacgggctgcaggaat

SEQ ID NO: 40475 - DNA, 15372 bp, Oryza sativa
  unsure (1)..(15372): unsure at all n locations
gagcggaagcggaaaacatctaataccatgaaaaactgagtcaacacgataattgttttaatcacaaccatgagtacataggcatgtacatccttatttacaatcgacctgtagaaacaaaatcgagaatcaaataaaaccggtaatagataagattataaaaccatatctctaatcgtgatctattcatttatatacgtatttctttctgaggtgttggattcttttagaccggtataggttggatttgaaccaagattgaggaataattacatgaaaaattattaatatcaaagtatgtcatttaggggaatatcaaagcatgttttagtttgatatactccctccatctatacttttaatagtcatatttctaaatctgaaaaatttatttttgataggcatatttcaatccaacaacctattatcttaatgattttctcagatttaatgcatgactctccatttttccacacaagattggttacatgggcatcgagaaatatatatatatatatatatatatatatatattaatgaatcgcttgtttacgaggaattactagtagcatgtttaaattgatgataagtagaattacttatccttggtctatatgctaagatgaaatatgattatcaaaactagatagagggagtattaggaaaatgcgcatttggtcgaacagaattactattattagagcaagtacaatagcaaactattagccagctacaaatatattttaataagataaaagatgagagagaagagcaacgggctatagatccgtagccagttgcagcacggactccaagacgcaatgtgtgtatgacaggtgggaccatatactaatagtatagtaagtaattattgtatgaattagctattaggggtgtgtttgaggagaaggagattggggagattgggaagatacgtaaaacgaggtgagccattagcgcatgattaattgagtattaaatattttaaatttcaaaaatggattaatatgacttttaaagcaactttcctatagaaaatttttgcaaaatacgcaccgtttagtagtttgggaagcgtgcgcgcggaaaacgatgtgctttctcaccctatatcacacaaacgaatgcagcctagattgacaatagatgaattggagctagtagtgggctatactattatcggcatgttgtgaggaaaggcgtattttcgtgaatcccgtgtttattcagggggtaacgcagagcaaaacagacgccacgcgtcatgtggtgattggtcctggctacgtgtcccgtttccgtcccagttaacttgtgtacgcgaatgaatgagaaaatttgagtctaatttagcaggcagaactaagagagcacggcggcggcggcggcgatggcgcggtggccgtggaggtggagggtgctgctgccgctgcttctccttcactcctcccccgtcttcgcgcaaggtactgcgacccccgctttctctctctctctctctctttcttgcgcggcggcgcttcctcttggccccgccacccccagccccaaatggcaaatactgcaagtgaatcatccatcatacagataagatgaacgcgagactcgtcatctcattccaccacagcagtgttctgcatccatctgcgataccattggatcgtttctaacacaagatatttggatcttagagccacccttggatcctaaatttaacgggaccactgcatcctaaatttgctatttaacatattgatttcatggatcagcaatgccctaagtttcttttcactccaattagcactacgtctacacaaaatggatgtttcctttatgcctcctggtagactaagtatcatttttcccctcattttttcagaaggccaagataatgatccctctactttgttcaaacgagcctcagaaatgatgaacctaaggaaatatgatggatcacttggtctgctaaatgctgtgttggaggttgacccaaatcactcagaagcttacaggcagcgtgcatctgtgcttcgtcacaagtgcaggtaaaaaatttgtgtgtccgttactttagtttataatccattcatgtttgattcacatattttcctcagttcaaagttacttaccagaaaaataattacttgccaccgccagaaagctaaactcccattttctcttgccccaaaaatgtctaaagacttgtaccattaaagaaccgttaagctaatatgcctacttataacattgtcagttttacacgtatgtgtcacctttccgtatcccttacttgtttcaatgtgttttttctgaagtctaggtacaaggaagcggagggtgactatagcaaatacctggagctaaaacctgggagttcttctgtggaaaaggaattatctcaactgcttcaggctcaaaatgcattagagtctgcttatggccaatttgaatctcatgacttctcaaaagtcctggagtacatcaacaaaattgtgcttgttttttctccaaactgcttaaaggtatatttcagaggatagtaggaatcatggacagctaaatatttcatctaattttgtctcagtaagctgcagtactaaagattgatttttcaggcgaagcttctcaaggctaaagcattgctagcacttgaagactactcaagtgttatctcagaaacaggatttattctgaaggaagatgaagataacctggatgccttgttgcttcgtggccgagcatattactacctcgctgatcatgatgttgcatccaggtaaagcgtatctggtattttaggtttggacaagtgcatgcttgtttgtgcctgcacacacaaatgcagtactagataaatgtgctagctttaaatatttgtacagtgatgacaatattaattgtttaggcactaccagaaaggccttcgtctagaccctgaacattcagaactgaagaaagcatattttgggttgaaaaatcttctgaagaagactaagagtgtgagtatgatttctttgtatcaacaaattaggggcttactgcatcatagtaataggatcaaacggtgtgcatgcaggctgaagataatgctgccaagggtaagctacgtgtgtctgctgaggactacaaggcagccctagcaatggatccagatcatacttcttacaatgtacatctttatcttgggctatgtaaggttctggttaaactcggaagaggcaaggaggctatcagtagctgtacagaagcactcaacatagatggagaacttgttgatgcattaacacaggttacattacttgcttggcatgtacagaaatacacatttttctaatttagagttcgtattattcgatgttgaaatttccgtgaaaaaaagaagggaatttcagtctgattgccctgccattaatgttgaatcttggactccttccgcacactgatgccacattattgagcaagttgtgagcatgcagacatgcagtcgcattagcctgtcctgctaattctgtattttaaaccacaagacttgggaaagctgcaactgttattcagaaaccacaaaaaatgtaattcagtatgcacaatcaatgtgttctgattttgtgagtgaataagtgatgcaaaaaaaaagtaatgtatatttgtttggtagtgttgcaccaggaaactaagttatgcaccagacaatgcaattgaattagttgttatagccagatctcactagtctgttacttcatctgcttgttgtatgttaccttctactggttgcagagaggtgaagctaagcttcttacagaagactgggaaggagcggttcaggatctaaaagaagcttcccagaaatctccccaggcaagttttatgtggacctatctcttttttcccctaccctcctaggcaaatgttagggataagtgtgctcatatatcagcatatcttcttttttgtcgtttgaaaacattcatattgctatttgagttcccatcaaataatctgcttatgtggctacgcggtgtgttgatctcattttcttttagatttgggaacacaatatttttagtgtaattgtgctgcaatcaaattatcatgaaacatagttccaaatggatgaaacatctagttttagtcgattggatagacaatatgcgaaaacaattatttgttttttacggtagtcatctgatgatacttttactccccgtgatgtatttctatttgctgcccttctgccagcaatctttgttatccggtttttgcagcgtgggatcgtaggttgcatatatttctctagcacctatgcatgcaatggatgagttgataaaactagatttgcacattactattgttagtactactaataataaagtggggcaccgaagaggaactttatgccaatgtatttatgaataagcaacaggatctcatcaagatcttaaactagcggaaaaggtgagggcggtcagagtatcgaacatgtgtgagccccgcttgacggctgccccttccagcacagttctcaaataatattgatagttacacaaattgcttctcagctatattacaaataggaagttaacttgttgcttccatgtttctttaacatcaggaattgaatccaaaggtcatgtgcttttaatggaatgctttattagatttatctatctagcagacttggtctctgccccttttctgtatttttttggtacaaatgtaacaacggtttgcactgttcatgctcaggacatgggaatccgagaagcactaatgagagctgaaaagcagcttaagttaagcaaaagaaaagattggtataagatccttggcatttcaaagacggcatcagctgcagatattaagcgtgcctacaagaagttggcactgcagtggcatccagataaaaatgtagataaccgagaagaagcagaaaacatgtttcgagaaattgctgcagcttatgaggtatgaataaacaaaattgaaccgtactaagtatttaatgttctatgagatgacattttctattaatatggttaatttaaaatactcatgcattccaagtttctagccctggtgttgtactatgaataagaactagctgaagtgcatttcatccacaaaatatatcatgctagacaccgcgtgtgtccgagagaaaaaagtgtcccaataacataaattctggtcacccatatttagcgataggcatgtttgttttgaatcagatcgacatgctgcagatgccacgcgtgtcttttaacaatgcgcaatcggcaatttgcaggttcttggggatgaagataaacgtgtaagatacgaccgaggagaggatcttgatgagatgaatatgggaggaggaggtggtggtttcaatccttttgggggaggtggtcagcaatacacattccattacgatggtggattctatggaggaggaggattccccgggggcggctttcctggaggatttcagttcaactttggatagaaagttactgtctgtggagttggagtttgtatgtttgtttgttttaggaacgctgataagcttaacaacaggtattgattgtaggcagtcaggccgaccgaccgatcgatcaagatgagaatcgtatacaagtgttgtttaagcaccatcaaattttccttaagttgtatccttccttgggattttctgacgcatatgatccaatcgaaataaactgagccttactgtggagctagctgtttcactttcactagccaaggatttgcgccgaaaccataaaaaccgaaggtccattccatgtattgtgatcggagtcggcacgcaacagaaaaactaacccaaaaaaaaaacttagatcctctgaagaaacatactgaaccactcgctggaccgtctagccatcagtcaaccatgagcgtcatgtctaacaatctccatgttaactgtaacatctggctagctaactttctctgttttatattgtataagaagctttctaaagtcaaacatttttttaaacttagatcaaatctatatagaaaacataataacattttaacataaaacaaatataatatcaaattatatttaataaaattaattaggtgttttaaatgttgctaagcttttctataaaaattattaaacttaagaaaaattgacttaaaaaaagtcaaaatgtcgtatgatatgaaagggagagaggaggtttaaagtgatttggaagtcaagcatgcaactcctcctgagaaatttttatttgatgatcgatcgatgtttgaacaaagtctgaaaatgaatgctcctaatttgggggcctacggctgcaggaggccagggccatgagggagtaggcgagctgcgcagtatggcgctgcacctcttccctcaccatctgtcgcatcacctgcaacatgacacgcgatgccgatgatgatctgctgctgccgtcttggatctcagaagcagctgccagtgccctgggcggcggcggtgccacctcaacctcagcagcagcagcagcggcgccgggcagggaaaggctaaggctcagggtcagcgacggtagtgtctcctgggcctgggcctggatgatggcgggcggcgtgaccggccgatctgcaggctcgtcgtcgtcgttgagcacgacgatgcagtcaggtggaatattaattggatcgggcagcagatcagggtccttggatttgaatttggcttggcggcggaggcacctccggaggttggagttccagtggttcttgacggagttgtcggtgcggccggggaggaggcgggcgatggtggcccacttgttcccgtggcgggcatgggcggcggcgaggagggcatcctcttgcggggtgaaggggcggtgctgcacggccgggctcagctggttgcaccaccgcagccggcacgacttgccggagcgccccgggatggcgccgctgatgatgctccaccggtgggggccatgctgcgccaccagcctcgtcagcagcgcgtcctcttccgccctccacgaccccttcttccttgtcttgctacacatccccatttaccttcacttcaattccctagctagctcccctcgctcgtcgacaatgcaagcgcgctatatatcgcacttcattacctactgcctgcaacgtccgggcaaaattaaagcaagcaaaagtaataagtccattagcaagtaattaaagtatgacgcacgtatgcatacgtgtatgggcgtctggacgatgcgtaggtgcggccatgtcgcctagctagctagctaactcgtatatcgcacgcacgcatgcatgcaccgatcgatcgatgctgtcttgttcctaccaaaacgtacactacgcttactcgatcgatcacgtagtattcgttgattctttcttggtcgctcgatcgttttgggttaattgcaaattgagattatattggtcctagctagcgagacagataacgactacacgtcgatcgtacgcaggtgcgacgccacagggatactgaaaaaggaaaaagtacgtactattggatgcatgcgcttcaaagggagatagagatagctacgtcgaggtggcgagctagattacaagaacacggacggacgatcgatgtgccacgcccgtttgtgagaaaagctaatttaaccagcaggggaaaacggcatgcatgcacatcgaccatgcatgcctaaattacaaacagtaccagaggtaatatataattttctttcattctttaatttataccagcttaattgccgatcgaattcaccaccgggaagttatttgtcaaaatctctttgatgaatggccaatatatacgctatatatagaaacatctttattttttctaactgctaagagaagacccgtatgtaaaaataaggaggtgcccgcttttgtcatccaacgctacagagataaagagagaggggtcgactgatatatgtctattgagttggttttcccttcttttattgtcacatagacgatgtagaccaagaaacaaatcttatagttggagatggacttattcccggctgaaaacacactggcccagcaggccatcgtcttcgctaggccgggccatcctcttctcgcggcccagcaacccagctcccctcctcctccactccactccggcccggcagcgcacgtacaccagctgctcgtgcaaatgcgcaccagcgccgcccgacctcatccggcgccagatcgccccgccgccaaaccaatctttcctcgcggcggcgtttggtcggcgttatgtagggtaggtcccgccggcagcgaggagtagcgggcgcgatgcgtcaccgttctcttgctgctgctgcttctgcttctgcgccgccaccacaaatgccgccctcgttccacttccattggcgccaccatgctgctcgtcgcctctcctccaccaccgcctgcctccatccacctccactgcaacctcctcgagcgtcggcgtcggcgtcggcgtcgctcctcctccagctacaggaccacatcgccagcggccacctctcccgcgctcaccacctgttcgatcaaatccccagcccggacgttcgcacctacaacgacctcatccgagcctactcctcctcctcaccgaccgccgctgcggatggcctccacctataccgccgtatgctccgccaccgcgtcgcccctaacaactacaccttccccttcgccctcaaggcctgctctgcgctggccgaccaccactgcggccgcgccatccaccgccacgccatccacgcgggcctccaggccgaccttttcgtctccaccgccctcctcgacatgtacgtcaagtgcgcttgcctacccgacgccgcccacatcttcgccaccatgcccgccagggatctcgtcgcctggaacgccatgcttgccggctacgcgcaccatggcatgtaccaccacgcggttgctcacctcctcagcatgcagatgcagatgcatcggctcaggcccaacgcctccaccctcgtggcgctccttccgctccttgcccagcagggggcgctcgcccagggcaccagcgtccacgcctactgcattcgtgcctgcctccaccccaaccgcaacagcaagagcaagctgacggacggggtgctcctcggcaccgcgctcctggatatgtacgcaaagtgcgggagcctgctctatgctcgcagggtgttcgatgccatgcctgccaggaacgaggtcacctggagcgcacttatcggaggctttgtgctgtgcagcagaatgacccaggccttccttctgttcaaggccatgctagcccagggcctctgctttctttctcccacttccattgccagtgctctcagggcctgcgcctccctcgaccatctccgtatgggtgaacagctgcatgctttgcttgctaaatctggtgtccacgccgacttgactgcagggaactcacttctctcgatgtacgccaaggctggcttgattgaccaggcaatagctttgtttgatgagatggccgtcaaggacactgtctcctacagtgcgcttgtatcagggtatgtgcagaatggcagggcagaggaggcgttccttgtcttcaagaagatgcaggcatgcaatgtagaaccagatgctgcaacaatggtctcgctcatcccagcttgctcacacctggcggctttgcagcatggaaggtgcagtcatggttctgtcataatccgtggactcgcatcagagacttctatatgcaacgcgttaatagatatgtacgcaaagtgtgggcggatcgatctctccaggcaggttttcaacatgatgccatctcgggatattgtgtcatggaatactatgattgcaggatatggaatccatggactagggaaagaagccactgcattgttcttagagatgaataatctaggttttccaccagatggtgtcacattcatctgcttactttcggcttgcagccattctggacttgtgattgaagggaagcactggtttcatgtgatgggacacgggtatggtctaactcccaggatggagcactatatctgcatggttgatcttttgtcaagaggtggtttcctcgatgaagcctacgaatttatccagagcatgccactgagagcagatgttcgtgtgtgggtagccttgcttggagcttgccgggtttataagaacattgatttaggaaagaaggtgtcaaggatgatccaggagctagggcccgagggcaccggcaactttgttttgctgtccaacatatacagcgctgctgggagattcgatgaggcggcggaggttcggataatacagaaggtacagggttttaagaagagtccaggctgcagttggattgagataaacggctccctacatgcatttgttgggggagaccaatctcatccacaatcacctgaaatatatcgagagctggataacattctagtaggtattaagaaactgggttaccagcccgataccagttttgttttgcaagatctggaggaagaggaaaaggagaaggcactcatctgtcatagtgaaaagctagctatagcctatggtatcctgagtcttagtgaagataagaccatttttgttactaagaatctccgcgtttgtggggactgtcatactgtaatcaagcacataagcttagtgaagcgcagggctatcattgtacgagatgctaataggtttcatcatttcaagaatgggcaatgcagctgtggagatttttggtgacaacacaacgcgtggttcagctactgagctacggattacaatccgaatcttgattttgaattttatagttcgattcaatgattaatttttatggattatcttcaccactttcgttgctttggctctcttttcatgacctgctgaagaaaaatataaaacactacaaaatatttttaaaaaactttaaaattcaaaagcgctttggataatgaatattgttatatttcatgaccctaatcaaccatgtagaaaaaattgacaaatgcaatcaaactttctttattttttttttaaaaaagaaaggtcatagaccagccttatattgaaagccacagtggcaagggtttaggtttctggggttaacagctttatagaacacaaaagcaaaagatctcatggcataggaaggaatagatgacaagcaagcatttaactgtatagctctgccaacatgagataagttcccacattccaagtatctaatctttcctcaaggggtgttcggatctagggagtaaactttagagtttagtccctgtcatatcggatgaatttggagtattaaacatagactacttataaaactaattacataaatgagagctaattcgtgtgacaaattttttaagcctaattaatttataattagcgtatgtttactgtaacatcacataggctaatcatggattaattagactcaatagatttgtctcgcgaattagttcagggttattgaatgggttttatcaatagtctacgtttaatatttataattagtgtccaaacatccgatgtaataggggctaaaaagtcatctaaacagggcctcaagtttctgccataggaatacaaacaaacaaggcatctatttgtagctaaagaactccattgccaaatatttgatttggttgaactggcacatttaccaaaatttcatatcacctaggatattcagtcttacgaaaacttcgacagcataatcaccgaatattgtgcagtgcatatgaactattatatttatgatgtcgtattaccaaannnnnnnnnnnnnnnnnnnnnnnnnnngcaaggctcttaaccttgtggtcgtgggttcgagccccacggtgggcgattatattattaatttttgtgcctcaaatttcctaataaaaatcactccagtcgcatataaaaatttgcaaatccgcctcaaaacccttatatccttttccacctcgaatccctaataaaaatcactccacaactccagtcgcatataaaaatttgcaaatccgcctcaaaacccttatatccttttccacctcgaatccctaataaaaatcactccacaatcacagataattcttttttttacaaatctacctcaaattcctgatctcctttcccgcctcgaaatttaaaaatccgcctcaaatctctaatctccttttccacctcaaatccctaataaaaatcactccacaatcatgtataaaaatttacaaaaccgcaaatccacctcaaatccatgattttcttgcatatcattctgtgagcataatctcctgcattattaatttgggattatgtgtgttctatgtttccgatggacgattgattatagatgttgagtttgtgacaattactcgagtagattaaatattagaaggttgataagtttttgttttttctggcaaaggttgattgtaggtgaaaatgttctggaaaaatcataaacttaaggggctgtttggatgcccacctcaatttaccacagtttttataccaaaggtgtggcaagatgcaaattatgtggctcaaaatttgatggccacacttgtggcaaactttagctaagaaaagagtctatgactagtgggaccaaaagagtagaaaggaccaaaagagtagaaagtgtggcatgccaaagttatagaaacaaaccaaacactagccacatttcgttaaactaacatacctcaagtatggtaaaatgtgacactaaccaaacaggcccttagccacagaaagggctaagctgctgttgccttgaggagcccttgtcgaagaagcagaaagcaaaggatcagccagcattcaactgggctttgaacaaaactgcggggcaggtttgttctgctagattttgtttctttactgtaacattgacaaaccttgcttaagcatttattctgattacaagtattgaacttgaatcatgctttggagtttggagcatttgattgaactccatccgcatattctgcccacctggctagctgctttgctcatgtattggatgggaatttccagttttgacgttcgtgggacatgatttttctcaatcacatactgtacagctgtttggttgcacacttgtactgttgggttgaactgaacatagcaatttgtgccaaaatttatgtccttcctgggtttagttgcctggcttaaagcaggctaacacccctactactacctttttctcctttttttttttatttttagcatcccgggatggctaccacgtaatttcttttacaacatgctccctggttgggcagttggaaccggtagcatgcggttcaagtttggtacctcccaccccatgtgtctggtctccccctacatgcatgccacgcatgcactagcaattttgcaaagggtagctttatctatatgtattttcaaattcattatatatagggagaaaaaaagacaaaattctaaaagatttatattgaaaaactatctaaattttatctttttaacgactaaaatacaatgaatttgagattaagattttacacataagtgtgatgctattttaagtacttgtacaatttttcctagattttttttgataaagtttgttactccctctgtttcaggttataagatgtgttgactttaatcaaagtcaaactgttttatagacaaatatagtaatatttacattaccaaattagctttattaaattaatattaaataatttttataataaatttatcttgggtcaaaaatattattatttttatccaaaaacttggtcaaacttaaaatcaaagtcaaaacatcttataatctgaaacggagggatttgttcgttcgggttgggtacccacctcctccgcacgaaaaacggaacgatccattagcacgtgattaattaagtattagcaaaaaaaattttcaaaaatggaaccgttctccctcttcttttttccatctatgtataaggtcaatataattttttaagcaacttttgtatacaatctttttgccaaaaacacaccatttagtagtttgaaaaagcgtgcgcgcagaatacaatggagaggggttgagaacacagagcaaagagtatagcgaactacaacatccaaaacatcaatagccaatttaatagtaaattcatataatagttatttactatactattaatatctaatatctagtcccgcattccatacgctcgttacgtcttatagtccgtgctgcagctggctacagattcatagcccactgcccttctctctccctttttatatctttaaaatattaaattcatataatagttatttactatactattaatatctaatatctagtcccgcattccatacgctcattacgtcttatagtccgtgctgcagctggctacagattcatagcccactgcccttctctctccctttttatctctttaaaatatatttatagctcatagcccactgctctcctctctccctttttatctctttaaaatatatttactgcccttctctctccctttttatctctttaaaatatatttatagctcatagcccactgctctcctctctccctttttatctctttaaaatatatttatagctggcttatagcctgctattgtacctgctctaatggagtacacgaaaaagctggtgtgcgtctagttacccaataggcacggcatactaaaccatatcagcagcacacgtgtttcaggagtttgatagacaacttattactaagctacaggtgataattatcgcattttgaattacgggacaacggagacacatgaactacatatttttatctaaccttcattaaatttgtaagacaaaacataataactacggagtataaatttaaatttctacggtgcaaaaaaaaaataggcatagcgcagcacagccggactagaaaggagtttggcacaagggacacgttgatttgttggatgttgagaaccacttgtagaggcaagcaccatgaaacttatgcctgcacgtcttgcaagccagccggggaaggctgtggttgctcgtgtgcagaatgctgtaacagattgggcattcctccaccccctcaaactccttgtcaaaattgcttttccaagtgtggatcgcctctgctattgcgccgttctgtacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40476 - DNA, 3565 bp, Oryza sativa
atccaaataatatatggtgtcttatttgttgaaatgccccaaaattgggggaggtctaatgcgcgaaatgtatgtatcgccgtgtgaacacgtatggcacgccgacaacatgtgtgtcggaaagctcatgcatgtgcgtagggaatccacatgcctttttctttttcaacctttttcaccaccataccatcccataacaaaatgtgaaaaaaacgaaaaggaaaaaaaggagataatattagagagaggaatggagcaacaacagaattgagaagacataagcatgcaattgatatactaaaatgcatgaatgttgagatggatgcatgcatgtctttctctcaacaaaataagtaaatgtatatccacatgaacaaactgagacactgagaactaattaggtaaaaaaaaacctgagaaacgttgagaactaattacagcagcggtacggcgcgtgtgcctaaattatgtaagtatcctgctgaaggcaaaggaggtaaacttaatttggtttcaccagtgcagctagctatcttcgtccatgccaccaccttgacctgcacacgtacgcaccagatcaattacattacaagctagctagagaagtagagatggatgattgctcactctctcgcgcgcaaagataaagtagataccagcggtactcccagcgcggatggagatggaagatcgtcttggaggatgtggcagtggcagtgttacggaaggcgcagcaagcgcaggagtagaagaggatgagaagcaggaggaggacgacgttgaggatggtgacgttgtgccagtggcgacgcagctgctccagcacgccggccttgcacgagtcgcacccgtagcacagcacgccgggggcgttgctccaccggtagcagtcgggctgctgctgctgctgctgggcatcgtcatagtaggtgcacgcggtgggcggcttgcagcaaccggactgcacgggcgtgaggtcattgcggaggtagtcgaggggcgtccaggcggcgagggtgtcgcaggccctggcagccagcacgcaggccagcgccggcctccagtaccgctccgcccgcacgtggcgctgcagccacgacgagtagtcggcgaggcggaactcacggtagggcctgccggccacctgcgtgccgccccctcccgcggtgacggccagcccgaagacggtgatcccgagcagggccagcacgaggagcagcatggcggcgaggtacagccacagcgccgaggggacgtggtagcaggcgcctaggaagccagccagcgagacgaggagggtcacgaacccgatggccagcagcggcgcctgcagcgcggacccgcacggcgatgacccgccgtgagcctgcagccagagccccgcgccgatgatggggacggacgccacaagcgtcaccaggttcaccaatcccaccaccctgttgctcaggtgctgctgctctcctcccgccgctgcccgccggctatacatgctcaccgatcgatcaaatctaacaatgtagtacgtgcttgcaaattcagctagctataatataattaacatatatagctcccatctgatccagcctcctcttcttgtgtgctccggcctccatatatcgacatcgacctacctagctacttgcgcctctgcaacctactatagcgctctgctttaatttgcttttgcttttttactttctttatctactttgctttacttaacgatgatctggaaccgtctctacttaacttttgcgcatccccaaacctctttttttttcttctactggagtaaactatttcaaatctgttttttgcgcgcgcctgctcttcactactactgagatctatctatctcgtatattcgatatggtttaactaagaacaagcatatataacctgcaagatctaccgagacatgaaaagtgagatttttttttgaagtgaagtggattataaactctcgaatagtcgagagatatcccctcgttgcttacattacactcaaagagttaacaaaaaaataattctttttgagaagatgtattagcatctgatatatcactccacaaatatgcatcttaaattcaacttctacgtgtcgcaacaaaaaattaaattaaactacaactagttaacacatattcacaggcatattgttttttcggtgtgacatgtaaagtgaattttaagttgcatgtttgtggagtgatatatcacatgttaatacattttcttatttttttaactatttaagtggcatgcaaataatgatggaacatccccttgagagtttagaatagttcccttttttttgttttctcatttctcgcaagtagggttaaacttttcggtttagtcgatttgatcggatgtcaccgaaataccgaaattttgaataattttagttgaatttggacaaatattaccaaaattcatgaaaaaaaataaaaaaattgaaatattttggccgaaataatatcgtatcagaggggtccgaaatgaccgaaatctcagaaatttcagtccgaaatttccaagcctgctcgcaggtcattcaaatagctatgatatttttttaaaaaaaatagcaaaatgaattaatatatgtgatatatttctctatggacatatggatttaagctaagttcaaattcgacctatacaagtctaaattgtagaaaaacacgtctaaattctcttgtatcgttaacggtttttgttacatcattaacagttgatcgacacaaaaatttaatgagaattcaaaaacatattaatagatagcttcttggatgatttatggacttgtggcctcatggagatgcgattgacagtgtaaaagctaatgagaatgcaagaaagaatggccatgcatgaaaaggtagcgggccaacaaagcttgttggagtccaacttttgcggtatggactgtaggatatctctctctctcacacacacactaccttttgggctagctgtctttattccaggccaatgtaatgtagggcaggacatctttcgtttctttgttaaatttacatatatcggccatcaatgtgcgggtacaataagctgactaggcgggctccaaaaatgtttctgagagcaggtacaataagctgactagacggactccaaaaatgtgccacatcatcatattcctatgtggaggggagagaaacgatgagagagaagcgagcgagcgacaaatctatcgcccggcgatagctctctttcccacgcgctatcgcttgcttgcagcctacctgggcgataaaaaacacgatttgtggaccccactaaccgcggccgatcccttccccaccgtagccgatcaagatcccctttcccctccacccagcgcccgcccgatctccgcccttcccgcgcgatcccgggcgattgcgctcgatctcccgcgcgatcccgggtgatggcgctcgatctcccgcgccgcgcgccatttctttccctcccacacgcaccatctcttcccctctcgagcgcgaagatctcttcccctcctgacacaaatccaccgaaaaaaaatccccatcta

SEQ ID NO: 40477 - DNA, 13922 bp, Oryza sativa
gggatctttatctaaaattatttttagtcccttgctgtaaatcaatctctccccacaataaccctaaaccctaaagtgaggatatatttgcgactacccacaagtgaggatatagagcatatactacaggttaacgagtctcgtggctttccaagtatgctaaggagtatagattgcatgcactggaggtgggagagttgtcctagagcttggaggggccaattcacccgtggtgactacaaagtcccaacaattatccttgaagtggttgcttcacatgacctttggatttggcacgctttctttggtgtcgctggttctaacaacgacatcaatgtgctgaatcagtcccctctattccttgaacaagttagaggggaggctcctcgggttcatttttttgttaacgggaatgagtataacaatgggtattaccttgctgatggtatatacccagattgggctagcttcatgaaatctatatcacttccacaaacagagaagcataaattgtttgctgaacgtcaagaaggggcaagaaaagatgtggagcaggcttttggagtgttacaagcccgtttcaacattgtgcgctgtccagtgaagaagtggaaacggaagagtgttgggaaaatcatgctagcttgtgtgattctccccaatatgattgttgaagatgagagagaggatgcgatatgtgacattgacctcaatagaattcctaggacatcaatagtcctgcctcctgaagtaacttctggtgataatccatgttttactgatgtgctacgtagaaaatctgctattcgtgcttgttctgtgcatacccaactgataactgatttaattgagcatatttggcgtcggtttggacataggcaacaggcataaacatggtagggtaataagcatgtggtttctttgccttttctttgccgtgtgtagattatatcaattaacccttgtgtctaatttatttcaggaacatgctctgctcagtatgtccaaatcatggtgctgcacttctcaaaggtagcttatatgaactaaatttagtactaggccagattacttacagacacattctaatgattctcttttctttcttgtgatgatttacttgaactaaatgtactcctagttcagactactaatagccacagttcagtatttctcttttctttcttatgatgcagtagcatggtgttttgttattgcttttacctgctaaactcacttttaatttacttgttatgcatctgggcatactgcacactgttacgaaatggtcaatgaaattctcaatttttatgacagtgcaactatttctttgtaagatataccaactgcagaaaaatgcatgtactgattactccttttagtgaggtttcactgaaaagagatttcattgtttcatttattcatcaagtgacaaactactcaggatattatatgtgtttttcttctcccattaggttgatgatagctcaggcaatggtaatatgatgcaatgatcctgctatcaagggtctatcttcgatgaagaaatcagtctatcttcgatgaataaatcattctcacttgttggacagcatatttatatgtacttttgcttaatgccctattgttgatgtgacttttggatctgtaaaccgttatgtttattttgctttatcctctattaccttgtcagttctttggaactacagatatctttcattaccatgtccttttgttaagacttgtgttcggactggcatgatattatcgattaatctatggtatttgagttattgttatgtagtaatactgtcttgtaattgttatactatagagattttggttgatatggtatgtgaatatgctattggcacaactggctacaaagatgcaattcactcttgatcacacacattgatatgtgcatgatataatttactatttgattatgaggtgtagccagccaacagactatctattgtactagtagctgttgagattatgggcagcatataatgatttaatttattccataaataaatcatgacattacagatgaaaactagcatgaacgcatcattagatctacacatgtaaactacgcagaataacatgaacagatcaaatatgcgcagcatattgaacacgtaccgaggtgacgaaaagaccggctgcttggtcgaaacttttcacaggtgtctacgaaggcacgaaacacgcgagcgaagaggaaggcgagccgtcgcgaacgaacagggagcagtcgcgcgaagcgcttcccaaaaaccttattgtcgccttctcccggtgcaggacgtcaaaggcagaggttccggagacctgctctcctgatcgctggtgcacgccggcgagcgggatggagtagtctacgagcgacggcgcagtacagagtaggaggcaaaccctagattgattttcgcattttttgcgtgaagacggtgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagtagctggctttagcaaatagctattagtcagcaactggctatactattagccttgctctcagggcggtgccgatgcaggctttggtttgccatagtacgagtattgtgctactggttgctactgcagcgttctagtagtagtccatactggagtacgctgcagaggcaggcgtgacagtaagggaagggaatgagagatcctatcatcaaccgcaggagcagtaacacataatgtatcactagtaccttgtaccttgcagacacttgagaatgaaatactactggaggtgggttagctttacggttggttatttaatttagtttggaacttgatgggatgggatctcactctgctttaatcgcactcgcatcccactgctttgctttctcctgatgcatgatctctttccctctcccctgcaggctgcagctcacagcttgcattgtactagtacactgtactactctactccattggactccaatagcactatcacactcgcatttcatctgattgatacagtacttattcactggagtagtatttcccagccaaagttctctatcagtgcccttaagttatagcattagctaatttgggtgttggtgcctggctagaaggagctactctaggtaattaagatgatggctcctctctgctgctgcctcctgcgcgcgcggcggctcctcttcttcttcttcttcttcttcttcttcttcttcgccgtcgccgtcgtcttgttctcctccgtctccgtcgcccagatacctggtgagtctaataatctctatattttattttatggagttgtgggtcagtgagtgagatggtacgtaatgcgtgggcagggttccagagcatcgactgcgggggctccggcaactacaccgacgaggtcgggctggagtggacgggcgacgaggcgtacgtgggcgggggcgcaggcacgacggcgagcatctcgtccatctcggggcaggggcggcggccttacaggacggtgcggtatttcccagcggacgggcgcaagtactgctacagggtgagcgtgaaggccaggacgaggtacctggtgcgtgcgagcttcctgtacggcaacttcgacggcagcagggtgttcccggagttcgacctgtacgtgggcgcctcgcggtggtccaccatcgtcatctacgacgagtccaaggtggtaacgagggagatggtggcgctggctcagtccggaccctccctctccgtttgcttcgccaacgccaccaccggccaccccttcatctccaccctcgagctccgccctctcaacgcctccctctaccacaccgccttcgaggccgccttcttcctctccctcgccgcccgcatcaacttcggcgcccccaccgccgatcccgtccgctaccccgacgacccctacgaccgcgtctgggagtccgacatggcgcgcaggccaaacttcctcgtcgacgccgcgcccggcaccatccgcgtcgccaccgacaaccccgtcttcgtggcctccggcgagcgcccgccgcagaaggtgatgcagaccgcggtggtgggcacgctgggcgcgctcacctacagactggacctcaacggcttcccgggcagcgggtgggcctgctcgtatctggcggagatcgaggacgacgcggccgccacggcgcgaaggttcaagctctacatcccggggctggccgaggtgagcaagccgacggtggacatcggagagaacgcgccggggaagtaccgggtgtaccagccgggctacgacaacatctcgctgccgttcgtgctccccttcgccttccgcaagacggacgactccgccaggggccccatcctcaatgccatggagatctacagctatatccccatactccctgcctcgcccgacgccgtcgccatggacgccctggcggcgcgctaccagcagcagcagcacagctgggcgcgggagggcggcgacccgtgtgttcccgcaccctggtcctggctcacttgcacctcatccagagtcatcgccatgtacgtacgtcgtcactctttcaattattcccgggcgtttccttccttggagtagtaacgtagtacggaacgggtgcagaaatctttcaggaaacaacttgacaggcgccattccaccggagctagcggcgctcccatgcttacaggagatgtacgtaacacaagcgactgactcgctcttaattccattaattaagctgatcgatgagctctcttctctgacgaatttgcagccggcttgacaacaacatgctgacaggcccaattccggacctcagtgcttgtacaaacctgacagtcatgtgagtaactcaattcaccacttgcacgcacttgcaccaggcttatttctgttttcctttttctatagtatatactccttatgtccatattataaactaacaatattgtcgaattgaaattttcttttgcagacacttagagaacaatcaactggagggcggtgtgccgtcatacctaagcggtctgcccaagctcagcgagctgtgagtcttttatatactgtatgtactactatatatcctagtctaggaacatatataatagtaccatataagtgagagatttgttaagaaaatgcatgctgataattaaattataagagaatcggcatggtatgtataaaatgcaggtacctagagaacaacaggctgtctggagtcattcccagggctctgctaagtagaaccattgttttcaagtgagtgatatatatgatgtatgcctataataataatgaaataaaatgaatggtgaaattaattactccaatatatgcgcgcggcatatgtacgtatgtttgcaggtactcagggaacaagcatgtccgagtggggaagcaagaggaggaggagcggaatgtgataattgggatatgtgcgctgatgggaataggcttgttgcttgcagctgccctgtgctatgcctataatgttagtgttagcgggaggaaacaattacaaggtgctagtgcgggtgggaacagcaagagcaagagcatagtcgtgtccgcggagcagaagaagaaggcaacaccagtagcaggaggaggaggaggagaaatagacaacatgatggcggctatggcagcgcggggtccgttggagttcgaggtgagggagctggaggaggcgaccagcaagttcgcgaggaagatcgggtcgggcgggttcggggtggtgtactacgggaggctgggagacgggagggagatcgcggtgaaggtggcgagcagcaacgagtcgatccaagggaagaagcagctggccaacgaggtggcgcttctgtccaggatacaccaccgcaacctggtggcgttcctgggctactgctgggagcgcgacagcagcagctacatgctggtgtacgagtacatgcacaacggcagcctcaaggagcagctgcagatgatgagcatcagctggctccggcggctgcaggtggcggaggacgcggccaaggggatcgagtacctgcactgcggctgcacgccggccatcatccaccgggacatcaagaccagcaacatcctcctggacgcccacatgagggccaaggtgtccgacctgggactctccaagtccaacaaggccaccaactccaccaccaataccatcaccacccacgtgcgcggcaccctcggctacctggacccgcactactacgtctcccagcagctcacccacaagagcgacctctacagcttcggcatcatcctgctcgagctcatctccggccgcccgcccatcctgctcacgcccggcgccggtgccatggccagcctcgggccctgggccaagtcgcactacgagagcggcgacatcgaggccatcgtggacccgtcgctgcgcggccgctaccgcgacgtgcactcggtgtggaaggtggccgagacggcggtgcggtgcatcgacgccgatccccgggggcgcccgtccatgcccgaggtggtcaaggacatccaggaggccatcgcgctggagatgccgtcctcggagtcggagaggcccgccgccagcttcttctctccgggggcgggggcagccggtgcgcgctcctcggcgacggtgcggtcgcacgacctcgtcatggacaacctcatgtacgactccagcttctgcgattccctcaacctgccccgcacgcccagatagagacatgctcgatcgtctctactcctatttttctgtttaattacttcatcacgcgtaaattacgcggctggtattatctttttataggaggctggtattgtttttcacgcttacatttgctatatcatatttatttctatctacagatattctcttaaattgagctatcattgcaaatattattgtttttcaaacatgatatattaactatgaaatgcagagagatgagaaagaataaacaccatggataaaaataaaatattaatttttaacctgccccgcacatccagatagagaaactcatctttactcctagttttatgtttactttattatattaactagcatcattatattttctctcatataataagcatatgtattttcttaatttattatttaaatatattaaaatgacaagttttaaattttgtactaactttaccaaaatactaatgtgtaatattcatactgtgttttatatacgtgatagttattaattatttttaatatcaaattttagttatttctaaattatattcctatatggactatagactcgtcttccaatatttcttattttttattctgaatttttgttacttgtaaattgtatttctatataaactctaagctcttcttccaatattatttatttctaactctgaattttcattatttctaattgtatttctacgtggaatctaaactcatctttcaatactcttgttttttaatttcaaacttcagttacttctaaatagtatttctatatggactctaaaatctacttttaatttttttcccaaaattttagttcattctaaaatcctatatggattctatatttgtgaacttttgaggtcacaactacgatattttcatgttatggagaccgttggtaccaggggtatatgcgaaattaaagtaaaagagacgtatgcaagggtttatacaggttcgggccccttatctgatatgtaatagccctactcctgttggtcgtagccgatgttgctttatattcatcagaatcacacaagtacaatatttgggataacctatctagttgtcgtcgacttggcgacatagataaccaacacgtagtcgacgacagggtagtctttctcctcgagtacgaactcattgagatcagatatggcgctatatccatcttgtcggcctccgcaggcaccattaggtctatctaggcttatctctgatgtcgatgtttgacggcgtgtgttggtgtctattctgacttgtgtgtcgatcggtctgtccctcctcctcctagaaggtcttgtatttatactcatagatgttctcttgttcaagtagaattagggagaccaatatggatacaatacgagtaatccttgtcgttttcatatagaactctactcgtccttcattatccgaaactctttctatatttgagatatgattccatataagacttgtgtatggtgggtcctgccgagcttagtgggtatgtggtatccataaccatgacaatactcttcttctaatatttcttatttttttaattctgaatttctattatttcttaattgtatttctatatggacttgatacccttcttctaatattctatattttttaattccgaatttccgaatttccgaatttctgttatttctaaatggactctgaccaaattttaatttttctatttttaaattcggaatttctattatttctaaattgtataccggcatggacactagtctctttttcaatattccttaatttatttctagactgtaagagcaaatgtggaggtttttttatttattactttaataagttgttaatagaagatttctactggtagtagtattcctactgtactagagaagtatgcaatcaataatgtacagtataactctgttgacttttgaatgactagcaaagttagtactaactaagtacactaatataaaaaaaagacacacatatgcgcgcggtcagtagtcagagttttgggcttagaatgaaggaacggagtgaatggtggatgggcctttattgggccgtagcaggcagaaggaaagggaggcccagctaagggccgaatgggtcaattcacaagcacgcgggcgggcggggggagggatggattagggtttccttccttccctgtcgtccccgccgctccactcccactcccactgacccgagacgccgccatttccgcctcttcttctcttaaacaaaaagccaacccctcccgcccccgcccccgcccccgcccgctaaaccctaaaccccaaatcgctctctccatttcccgccgcctcccctctcgcgatccatatccatccatttctcttggctctccgcccgatcaatcgatccgcccccagatcgcggccgccggtagctagctgcagctgcagatggatatggattcttcctcctccccggtggacaaggtggatcccgacgagtgcaacggctctaaggcttgcgctgactgccacactaccaagactccgctatggcgaggcggacccggaggacccaaggtgaatatcccattcttcttcttcttcctcttcttcttcttcttcttcttcttcttcttcttcttcttcttcttcttcttcgtttggtttctgtgtagtcgtatgttgttttgatctgatccgagatccgatccatgatcccttcttccagtcgctgtgcaacgcatgcgggatccggtatcggaagaggcggcgggcggcgctcggcctggactcttccgccaccgccaccgccaccgacggagcggagcagcagaagaagactaaggccaagaaggaaaaggcacaggaggaggaggtcaccatggagctccacacggtgggcttccgcagcaaggacgctgctgtgttcaagcagcgccggcggatgcgccgcaggaaatgccttggcgaggaggagagggccgccatcctgctcatggcactctcctcgggcgtcatctacgcctgaacctccaaccgaatcaacctctggcgccatggcaggaagaagaagcagcgattccttcccctctctttttttccctccccccggcgctatggcagtcaccgaagctagctaataatcaatcttgtcttgtggtgtagtagctcttgttgttcttgccttaagctgtaacgacgtctgtaatgcgactctttgtctgtgtctctgtactagtactagtagtagtagtttaccgcctaacattcaagtttggtttctctgcaatgtaacaagagaagaagaagaagaagaagaagaagaaaaaaagagctaaagctggagcttgagcttgagctttggttattgatcaatcatccatcctgtctgttcgtgctggtactgctacttctcggttggttgtgcccctgttactgtgactctatagatgatgatgtgcctgcctgtatttcctcctttgatgcgttggtcaagtcacagaggtcaaagggaaaagccagagccattactactacttgtgttctcatttggcgtatataaagtactagtctacatgatcaggtgttactactatctctacttatagaaagcaactgtgactgatggaggagtcattggccctcttcttttctccaacaaaagttggattaagggctctttgaatcaaaggattgagaaaacgtaggaacaggaaaaatataggattttgataggaatgtaagtgtaaaacagaggattgcaaaacgcatgaaaaacacatacgagaaacctaatacgcgcgccggcaacacgcactcccggcccaccgacgcgtgcgcgatttttcttttttctcgctaacatctatcgtcgttttctttttttcttttttgctttttacgcagtttgatgccgtatgggtaggagaaaaaatcataattagttttactagtgaatagtttcctatttttactagtaatttttaattctgaacttaaaattttttaaatttggacttgaaagttttcaaatctcgaggtgaaagtttttaaatctggatttgaaagttttcaaatcttgagtttaaaatttttcaaatctcaagttgaaagttttcaaaattttcaaatctaaacttgaaagtttttgaatctcgagttgaaagttttcaaatctcaagttaaaaattttcaaatttcaagatgtaagttttcaaaattttcaaatctggacttgaaagtttttgaatctcgagttgaaagttttcgaatctgagttgaaagttttcaaaatttgactttaaaaatttaaatctttaagtcgaaagttttcaaatctaactgaaaattttttcaatctattagtaaaaaaatcttcactttttttttctaattactgtcattagcgttaactaaggggttagttacgcgcgcgcggaagtgcgcgtcgccggcgcgtgcgcacgagctagcttcccccaaacacaggaatgaccgtttgattgaaccgtagaaaaaacgtaggaattggatgagagagatagactcaaaggaaacataccaagaggttgaagctcttgctaaatttcctccaaaatctctataggatttgtccattccataggaatttcaaaggattagatatgattcaatcctttgtttcaaagggcttcataggaaattttccattaggattgaaatcctccaaaattcctatgtttttcctccaaatcaaaaaggccctaaattttggatactcgtggcacgcttttcaaactgctaaacagtacgttttgtataaaaactttctatataaaagttgctctaaaatatcatattaatatatttttcaagtttgtaataattaaaactcaattaatcacacggtactaccacctcgttttacgtgaaacacttaatcttcattttcatcttcaggagattcaaacaccaccattgtgcatcgtcaaggaaaccacagatctttggacccattgtcgaccaaaaatccatcattaaatctttagattttactccttccctcccaaaataacttaacctagaatgggatgtgatccatcttaaaacaacgaatttggacaagcgatcattagatatgcatcgtgattcatgcgctaaggtgcttcttttcctactctgacagcctcttcttctccgataccgataaaagcttaaatttcgacagagtacctatgaattaaggtcctggatgggggttggagggggaaggcaaaagaggaggaagtcatcggacttagagggataaccatgggaggtacctacgaattaggggttctggatgagggttggagggggaaggcaaaagaggaggatgttatcgggcttagagggataaccatgggaggtgacggcggtgccacaccgaagccacgagatcaataggtagtggtatgttggtgttggtggcgggagcaaaacagagcaacatattaagaggcactgagcggtggtggtggctgatctggcgacggggagccatctgaataggggcacctcactattgttggattggaggagggaggagggagtagaccagcccaggaaaggggatgcctccctgtgccgttgacgtcttctgcctagccgacaagaccgggtgataacacgctatgcggaggcaacggtgagaggcatcaagcgtcgttcaagaatgcgacaccgaggggaaaagaaaaaaaatgaaaggaattaaggttgggatatatgcacgaatctcaaagtaatccaacggttaaaaaagtatttattatatctattatattattaaaacagctttgaaaagagacaccatgtttgctgtgggggggttagaaatttccacattaatcggagaaaaagaaaaggaagtccaagtaaaaatacaacttaaaaatagctgaaattcagaattaaaaatagacaatattaaaagaagagtccatataaaaacctaatacaagattaatcaaaattcgaaataaaaatataataaaatctgaaattagaaaagaaaatgagagtccaaataggattgcaatttaaaaataaggaatattgagagaagagtatatataagaacccaatacgagtttaattaatattcgaaataaaaataaaaataaaaataaaatccaaaattagaaaaagaaaagaagagttcaagtaagaatacaatttaaaattaacttaaatttgaaattgaaaataagcaatattgaatgaagaatctataaaagaacccaatacgagattaattaaaattcagaataaaaaataaaataatatccaaaataattaaaagagacttcaagtgggaatacaaacaattttgaaacaactgaaattcaaaaattaaaaataaaaattttaaaagaacactatatgttattaattaaaatttgaaaaaaaaataaattctgaaattagaaaaagaaaaaaaagatttcaattaggaataccatttataaataactaaaattggtgatataaaataaatactattgaaaaaaagaccatctaaaacccatgacgcgataaattaagtaagaggcctataaaggagtagagtagtggcggttaatacgacatataaaaactattagtaaaacaacaaatagaatcctagtaatgattaataggagagacgacaggcatgcagtgaagcagatgggcaaggtggttgctggtacttctagaaagaaaaaaaaaccccattgataattatattcgatttgtaaaatctcaatgacaataagaaggagaagca

SEQ ID NO: 40478 - DNA, 5256 bp, Oryza sativa
aattcctgcagccctctcaatggcaataaaaaagggtggcagcgaacgagccataaaggagtacaatggcaaagccgctgatggtttagcgagacgtctagaaagttaaaaatgaacccaaatgataattatattcagtttttaaaatcccaatgacaataaagagaaaaggtagtggatgggccgtagatgagcataatgaccgtgtttgacgagacttctagaaattataaaaagaaacccaatgagataataaaatctaagattcaatttttaaaggtttcaaggagaataaataaaaatagtggtagatcgagcaagcaaataaagaagaatatgacataagtaaggggtagcagctggtgtaacttttaaaaactatattagaaatacgggatgataaggtttgattttttaaagtcttttgacaacgagatatctacttaataatttttaagtaaaatcatactgaaaaatatataattttgtttgggtgctcgccgcgcaattgcgcgggtcatccagctagttttgttatactacttcgtttttttaatcctttgcaattgtttcggttttgtaactcaacttagcaattgcgtgatacgggtaagataatactagtcgtcagatagttgagaaaaatcaatacttagagtaaattgcatccatggtgcatcaacttggtatgtgggtgtaatttggtacaataacttaaaaaatgagcgttctagtgcaacaacttggtaggtaggtgcaatttagtttaagaactttgtaagtgatagtataaatgcaacaacttgcaaggtagatatgattttgatacaataaattaaaaagttatacggcaacttaattatttggagtattttttatataaattcaatttttaagtacttattttgacaatatagtagcgcggatttgtataagtatatttatatttttatcctaataaataataattgaaagtcaattaaagtggatgtaaaaattattatatttcggttgatatttgagaaggtgaagaaaaaaaaaatcttaaaggtaattggatataaattgtactagaacgcacccatttgtcaagttattgtactcagacgttcaattcccaagttcttgcactataccgcacccacctgtcaagttgttgtactgtaggtgcaatttacactaatacttaatattggagtcgtagatgttgtttaagtcgtggaaaaagaaaattcagaaaaatatcatggaaaggaaaatctgtgggaggggaggggaggggacgaggggacagagaccaaaccaaagcaccatgggctgcccccgtcgccgtcatcaattcatcatattctttctttctaactggagtacactagtgctaacactcttaagactaggggataggagtaataaagtacaagtagtagttgctgttgctaattataatccatactaataatcaaacgacctcccctcccttctccttctccttcttcttcttcttcttgttgcaggtcacatgggatagatagatactccttcctccttccccctctcttccaatcctaatcctaatcctaaagaaagaagttggagaaatctcacggcggaatcaatcccacgcgattcgtcgtcgatctggccacggcactccgcttctctcttctcctctactccagcacagcagtatgagtatgaattaggataggagggagggagggagaggaatagcatagcagcagcctgcaggcggaggaattccgcccgatttgatttggatttgggattcttctctttcgttttcgtgtgttttttttttctttgttactacccttcaattcctccctttatttggggccaagccaaagccaaagcaatcaaccccgatttcacgccgcaagattctcttccttctcatgcaccgcctcttaatttcttcttctttcttggggccagaccccaacccccaatcccttgaccaccaagctcctgcttcttgcaatcttgatcgatagtctcctccatcttcttcgtcaagcctctcctccttggatctttcttactacctaggtttcctggtgcaagtgcaacatggttgggcagacggtcatgcggattgtgcgcccctgcttcaagcccgaccaccagctcgccgtcggcggcaccagggatggattgctctggtacaaggacaccgggaggcacgcttgcggcgacttctctatggccctcgtgcaggcaaacaaccttctcgaggatgccagccaggtcgaagctgcccctcttcttctctcccactcctcctccaccacttttgtcggcatctacgatggccatggtggcccggagactgctcatttcatcgcacaacatttcttccccaatctaaagagtatgttcattcctctatttctctcaatactactactactactacaatctaaagagtatgttgcttccctgcagaatttgctacggaacagcaaactgtttcagttgatgtcattcgcaaatcctatgctgccacggaggaagggtttctcaatcttgtaaggaagcaatggctcatcaaaccgcagcttgcctccgttggttcctgctgtttggttggcatcatcaatgaaggagttctttatgtagcaaatactggtgattcccgtgctgttctagggagacttgaaaggggtgttattaaggcggttcagctgtcagccgagcataacgcaagcattgagtctgtaagggaggaattaagacagtttcacccagacgatccacgaatcgtggtcctaaagcacaacgtttggcgtgtcaaaggccttattcaggtagtatttgtttcactttgatcacttctgtatgacagattgtgcctcaaaatattattccatgtgcaccgcactccggtttattaactgagtgggtgcacaatttgtgacgtttcacaatattgctcacctttaccatataatagcgcaagtactcataccttttgccttgccaatttgtgatgtgctcaggtttccagaacgttaggcgatgcttacctaaaaagtactgaatttaaccgagagcctcttttggcgagattccggctttcagaacccttccacaaaccaattctttctccagaaccatccatagaagtacataaactgtgtacagaagaccaatttgtgatatttgcctcagatgggctatgggagcacctgaccaatcaggaggctgtggatatagttaactgtgcgccaagaaatgtaagatgatatcctaactttctctgacaataattttttttcgtggagttctgaattagtttccatgtcagtcatgtctttatcgttgaaatttaagaagaatcaacattaattgttatgtcagacgtgctgagtttatttgttagaacagcaaacatcctagggatattcaacaacatctgtgctgggtcacacataacatgatgttgcttcagatgcttcaagccatatatttagctctaatggaattaatatcttttgaatttataagttccattcgctgatcagttccttaagttcttgtttcaaaccagattaactgtgcgctttcccctgagttcactctgttttctgaattaattcattgacttatgtttatccagggtttgctttattgttgtgtcttttgatttttgttgtatctttgtagaatcgagtatagtatctcgggcaaagtgaatttgccttgctcaggtagatcttcacatgtctcatgttcatattttgcaaccgtgatccccttttctttataatcgctgcgtgctctgaatgttctgatgctaacatcttgttgctaacttttgccccccaaaaaactgtagggtattgcaagaagactaataaaagcggctctgcgagaggcagcaaaaaaaagagaaatgaggtactcagacttgaaaaagattgatcgcggggtcaggagacactttcacgatgatattactgttgtagtactattcctggactctgctctagttggcaagagattctatggtggcccattactttcactgaggggtggtgatggtgcttcaacgcttacacagaaatgatgaagatcatagaggttttctgagtgaataatccatggtatcttggctggttaaagggtggagcatattaattttgattctataatatgtacggatagacttgtacctttgcatgagctcaggaatgcaaatattgatcatattactcctatgcggttggcgaaacctgggagctgcataacttcaggtaccattgcttaatctttcagtggatgaaactcaagcaatttttttttgaaacatggcttgagatgattatatctcatatccttcctttcattttgcagcatctccctccgcctctcaagtctccgttgtactatgtgctagagagggctttggagagtttgaagctggaggtagccctgtgcaatgagagccggacttgtttgctttcagctttggactttgaatgtatgtccatcttcaccgcggcagaagaaagatccattccatctcgttcattcagtattttcgttctgcggtagtacatatatttatataacagagaacacatgcaagtgagaatcacaattttgattgcagcatcgaattgaactgccctatttgtaaagcgttcctttggcaagtctttggattttgagagcaaattagtgatcgtcatccatcagtttgtcactatgtaaagagttgcagcgatgtgagcaaaatatccaatttatagaatttgttagttacttgctctgcccatttttataggaccattttgatttcaaaaggtcgaaatttgaagattttgaccaactagttagtccatgcatattacggtgcaaaagttagtaaccttcgtcccaaaaagagtacaatgaacatggactagtattggttttataactatcattaagaacatattttatgatgagaagttaatactcaagattaccatgaagactttgtgaaattgaaaatacaccttataatgaggtggttttcacacaagttaaacaagtccattgatgataacaaaaacacattggacgcatgctaatataattacgtggtacttgatgtatcaggatttgtcagcaacggacataggatttgccttttacttatactgcattggtaatttagtggaaggaattactaaactcacccaaaaaaaatggaaagaaaattatgcgtcctaatcatcaatcaacata

SEQ ID NO: 40479 - DNA, 2957 bp, Oryza sativa
catgttagtggcccaatcatgttcaactctctcgacatcggtaattgaggcggtggtggtcttgctagagcggccgtggccgttggcgggcgctggtgcctcctttggacatcacccgcacttgtccttgcacgtcgcagtggcccaatatcatctggcccaataatagcccacacaaccctaggctgcgctagtgtcgtcggtccccatcccattcggccaccgatcccaatctcaatctgacgccgccgccggcatccctgactcaccgacgcggctgcaccaggcgccgccgccgccgcctccgccttgatcgtaaggaagtaagtttggagcaccatggctctgcgatcggcggccggtaggctggcgtcgtccagccgccgccgcctcctctctccgcccaccagcatccacacggccttcctccactcccacgccaccagcttcggtacccttctcctcctaaaccctaccctaccacctaactcttcttcttcttcttgtccaaactccttcctcttggttggttcatcaggatacaagcaagtagctgaagaggacaaaagcaaattggtcggtaacgtcttcagcagcgtcgcctccagttacgatctcatgaacgatcttatgagcgttggactacataggttgtggaaggacaggtttgcttccaatctcctcctcctcctcctttttttcatgtcaggcttaccacattcctcttctctattttttaaggctcatctcaaagcttaatccttttcctgggatgaagcatctagatgtggctggtggaacaggtattcttcctttcttaccttcagcattaacatcctaagatgccatgtaccatgcatagcttactgacccacccgactaaaaacatagccttgctagtcaaaagatattagtgtatttgtgttatgtaactcctctgcatttttttggcatgtctaaaacgtcgatgtgctgtgctgtgttccatgtgctaatatccccatttcctgtgcaatactgcaaattatatgaaatgtgcatcaattaggtgacatgttaatttcggaacttttctttgttctaaaaatgcgcgctgtcctaaaataaggtgattttacacctaatgtttcaattactactagtctgttcatgaatgatatttcaacatgtccaagtaaacggttactcccttctcaaaagaatttatctagttgcttgctaatctcgttttgaaattggaaagtaattcatccaatgactctctatgccttcaggggatgttgccttccgtgcgctcgagagaatcaatagcgtgagccatagagctatgcagggtactcttactgatattgaagaagaaacacaaatctatgtttgtgacattaatccaaatatgctgaatgttggaaagaaacgtgcttcagaaagaggtttggattcatgaaatttcttagcatcatgccacctttatttcacatactgcttctgttgtcccatggttgattttgttttctttttatttcaggatacaaagaaggccattgccttagctggatacaaggagatgctgaagctctgagttttgaggatggatctatggatggctatactattgcgtttgggatcagaaatgtgacacacattgaaaaagctctatcagaagcttataggtcggcccataatattgaactaactgactgtatttatatttgatcatgattttcaaatgttgtgtatgtgtagtatgtttggatcaaatcattagatgtgtccaaagcgcttttcttttcttattaatgtctaatctcagcttctatcaaatgctgttagtttcacatggatttacatgtttcagagtcctaaagcgagggggaaggttcctatgcttggaattgagtcatgtggatgttccgctttttaaagagatgtaagtttctttagccaagtatatgtttcttttctacctaatttagaaacacaggtaggatagtttcatataaggtattttccaagtgtcttcttacacatggtgtaaaataaaagagaaaataacagagttaaatcagttgtgaacaattacatttttagctttcataactggtaatcatttctataaagctatcgttcgtagttctataccaagctatgtattaaagcgttgagggttctaaaaatgaaaatattacttgagatgtctcaatggtttaaaggttcccttcttctggggaaaaagaatatttgatgtttcttcctaccaatgcttgcggaaattaacaattctgaggattgtaaaaaacaaaagtaatacttgtggtgatttgtcagtggacagcttaatccaaccggaaaagtttcccttctgttagaaaatatatttgaagcttcttcctgctggttcttgtggaaatttgacgccaaagtttttggcatagttctgttactaacggagagtgaatctgtacacgtgaacaaagctgtgaccaacatttgtgagaccattagaccagaatattttcagcaggacagtttctgtaaaatatgcatagttactagtagtatttaacaaggagtcattcttgaggcagttaaagttttaaatcaacagaaatagcatatctattatgtgtatatagttgccagttacctttccattgatctattgacaagttgttgattcttttggccttttcttcagttatgatgtttattcattttctgtgattccggctgtgggagaactagtggccggtgatcgccagtcataccaatacttggttgagagtatccgccggtttccaaatcaggtaattctggttctttattatccttgcctacttctgagctgccatgttaggattaactattgacaaaacatggatgtacatttgttgcttagaattttggttctaaaaggctttctactgtatgctatccactccagtataggcaactagaaa

SEQ ID NO: 40480 - DNA, 1645 bp, Oryza sativa
tacatgcagtgtttctgtacatgtttcttgtatttattttttttagatgaaaggcttttgacagcccagctttactgaaaagcataaaatgttgttttgacaaccaaaacaaacaactaaaagggagtcacactagattgacagaaaagttacagcctattctcacgcctttgttttggtcttgtcagctcccgccggcttcagttgcattctgcatcattctttggatgatggcaagcagtgagcgacatgtaacgacgttgttgtgttatacagacgaccatgctgtactagtagcatccgacccagtgttgtaaaagtcggccgaccatacggccgtatatacggaaacgccggccaaaccgttccgtttcagcatgtcgaaacggtgtttgaaaatgcgaccaaatctggacattttgtttgcttaatcacctttttttataattattagattagacctattatgtgtcacaattaagttatattggaacctgttttaaatggttagcaacccacaagagttggtcaacccttccggctatatgcgtaacaaaagttactgtttgtttcagtataatcaaatggtgatgcaagcatattatctcattttgataatatatgttaaagtatgtctataaccataagaaattatcaaatatatcgttattgggcctgtttggctgccggggttgcagcagccgcagccaaccggaatagtccggcaagctctaagatagcaggggctacagcagccgcagctgcagtcccagtttgccgaacaggcccattagtgtgaacgccaaaattccgtttaatcctgattaattatccgtaattcgattaatcgcttaacggtactcattccatttcaccaccgtttttcatcttttataacactgatccaaccacgtttcatccatcaaccctctctccaaccactatttcccatcttttataacgctgatccaactactactcatctatcaaaccttacaatcagcttatctctacggggataagaacgtcttttataacacttatctaaccaggaaaataatagttatgtcttttataagactgatccaactacttctcatacaccaatccttacaatcagcttggaaaacaatagttatgcgtcttttataacaccgatccaactacttctcatccatcaatccttacaatcagcttatctgagataggaaaacaatagtaatccttactatcatcttcctccaaccatcttttcccgccttttataacactgatccaactacttctcaattcttacaatcagcttatctctatggagataggaatccatcaattctcacaatcaggttatctctatggagataggaaaacaacagttatgcgtgttttataaaactgatccaactacttttcatacatcaattcttacaattagttgtcttttataacactgatccaactatttttcattcatcaatccttacaatcagcttatctctatggagataggaatccattaattcttacaatcagcttctctctatggagatattgatcagcttatctctatggagataggaaaacaatagttatgcgtcttttataagactgatccaactacttctcattcatcaatccttacaat

SEQ ID NO: 40481 - DNA, 6414 bp, Oryza sativa
ttggcatccttgttttcctcaaggagcgccctgtactccgccaccaggataaccttcttctcttcttcaaccccttctccttcttgtcctttcttctgcttccgcatgccatcggggtcatccactgcagctggagcttcatcgtcacagcctcccaggtcgtcggaggagatgtgacgcagccgtaccaacgaccctctctcccgcgaacatcctcctgctttctcctgtccaacgtccaccgcctgggcctcctcctgcgtcgctgttgatttacccgcaggatcaacgtcagctgttgatttacccgcaggatcaacgtcatcagatgcagcctccgtctggacctggggttcagcaacatcatctatgcctcctgcatcattgtcctcctcctcctccttcccatccgccactgccaatgtgcctcctacaccaccgtgttcagatgactgcaacatctctgatataccactcagtctgcttatggcttcgctgaagttcgagcggatcgtgctctcgtctttgtggaagcagctttcaagagcctgcactctcaccagctcctcttctagcttcttcagcttctcatttactttatctgggtcactcacattctcttcctccagactctgcagacaactctccaactcgctgttctctcgacacagcctgtctatctgtgagctctgcgatgacaccataagctccaaatcaaccaccttgttaacaagttcatcgatatgttctgtgatttctgccaccgagatgctgccgtccctctcaaaatgttccttgatcttctcgagcactgtctgcgtctcaaattcacccagtttgatatgctgtacctcttccatctcaaagccatgattcttcctcacgtttttatcacaaggatctggagaatccggcaaggatttcccatgcccctccattacagccttgagcttctcacgtagaaccttgactctttctgactcgcccattgcctggctagcagatgtcttccgctgttcctgcagtttgacaatggtgtcttcacaagatttaagggctgttgctgtcatcagtgcccgggcttcatcatcctcaatcaccgcactttcatcaaacttatcttggaaatggcacacctgttcctgcatgtcattgatttgcttctcaagatcccagtactttgcaatgccactctcgtacgagcttttgatgaattctttctcggtctgcatcacaagtatctctttctgtagtctgctgatctcctcccgtgcgttgtccttgtcgattggagctgacgtcgtgttcttgttcatcgaccctgcaggctgctctcctcctttcttcttcttcatcaatccgtcaacagtcgacttgtgaattttacgtggatcgactggggtaaatgccttggggatattgtcatcttcctcttctagcattgcatactgcacttggtcagggaaagctgtcgcgatggtatggtttgctttgtgcagttcccctgaaatgatgtcataccggtcagctagacccctgtacgccctgtatacttcttccacttgagtgatcacctccggccgccttttgtagtacatctctgccctttttgaaaaggaatcagcttcctctccaaggagtaagagcatgcacttcactctgtgttccatatctgcatatatatccacaagaccatttcatgggatcagaaacacaaatttctatgatgattttacagcagataagatttcacatacattattggtttcatagcttcaaaaaggccctaattatgtcacgggtatcaacattattttgttttgctagcaagtataactgcaacagaaactgctgaaaacacaggaataaagctcccaaacaggagaaacagtttcctgatatgacaatattctaaagtaaatttaatatatttttaaggcgattgttttccatctagatgtataatgtttctttgtcccctttatcaggttgcatcatatcaattgtacgcatatgcattcacctcagttctggaggttcaggaatttacacattcgatttggtccaaattgatcctcagtcccattcccataagcaatacatgtttaatcttcagatcaacaagcctaagctgattatgattgtgcagatttacccagaaaagtgaagaggttatgtgtattaatttagagatgtgagatctcgtgctactccaaataagaatatctgtagcctcatatcaagaatcacatggatggaaggcttagaataatttcgttattctccccattgaagaacttctaggattgaacaaaccaacaaatctcccatataagtacatacataactcacagaaatcaaatatatgataaaaaagatcaagattatatattggacggtcaccttggagatggctatcaagccatttggactgcttggtgcggatgtggctcgcccaccaccatgaatacgcattgctcgccgcccgctgcagcatcctgcctcctctgtctcttcctccttcaccttctccaaaatccaaagcattagtctttcctgtgcatgaaaactaacacacgagaacagagaagtggcaaatgaaaagagcaagaaaggaggagggaggagatgccattgagaggctcatagccaagtccattcaatggctaaatatagttaagatggtgagaggttaaaggaaaggagaacacacagcagatgcacaaacatgtacataatagaattgcttaaatgcagataggaaaaataataactgcgctgaaatggcagatcaaatgagacaacaggcacacaatactgctacctagctgtgccccacgatggaatggaatagggttctacttctaaattacttgctatattctttcagaaagaagagcgacatttcatattgttccaaaggcaatctgattaattatcaatcttctcacatgagataaataggtaaaggccatttagaattcatgaatttaatgaaaaaaatatcaagcctctgaaattcctgcaaaattcatacatttcgaacaggcttaagataccagcctatatgttggcaggggatttattttttctctttgaataagttgacatacgccagagagacaagtgtcttccatgcatggaacagtgactctgatgttaaactccctttcctgctcctgtcaaagcggcattgcctcgatgagattattgtggaatctttattgtttcacaataatttgcaacccatgcatgagcactttccaaaactcggagctcgccgacaagtagatctttggccatttcttttctgaatggatgcatgctcctagaggcagggccatcaacaatttcaagttgctgcaatatagaaattaaattagattattcaattttactgtttaattgaagttttgcttcactcaagtctttcatgataatttcaatttgtgtccctatttttttagtatagtatgtattcaaatttttaattggtgaattaatctcccaaacactgtaataatcatgaaatatgattactaacttactatattggaacatccatgcctgagttgtatatatgtgtgtgtgtcttacttcctctgatccaaaatataggtcgttttggagttgtgcacaaagagtaataaaagtgactaatgaatttgatggccttaaattatttttgcattggaaaacatgggcaatttattcatgagagaagcagcatttatgtaacagaaaacaatgcattgaaattctggcatgacttaaatttggagcagaattgagagagctaaaaatgacttatattttggattagagggagtattcgtctttgtcaaagaatgcatgtgtataatttgccaagtgcattcctttacatagccacttataatcgtatgaatatgtttctacttaagaacaatagcaacattgttttcatacataccataaaacataagtgctgacagaatgggaaaatgcaaaaggatatttggaattgtaggttacttttttaatagacaaaactcttgttattcttggtgccctcacctcaatagctgcagaatggccctgaatcatttcagcgaagtgcaagagcaacctgcggtgagcatggatttctctctccatattcttcaaaggacatctggcaagcctaccatcactttcagcagcctccatggccatctcttcgagttctaaagacgttgtaatcatgccattggacatcaacagaaactctttagtatctaacctaaaggggctgtcaggctaaatgcaaaacaagaaaaatatgctactagcatagcacctttaagtgacatggcagagaaaacccgaagaaatgcgcgcagaatcagaggaatcccaatgcctttgctctgagaggatttgacttccctgtttccattctttgaatttaaaatacaagcagagaccattttcttatatcatgccaaagctattacagaatgataactttttgactatttttttcgccgggaaggccgaaggaggccatccgaatgtattaagaaggagtaaaaattacaagaaaaaaacatcacaatgcaccaaggtgcatgaccacacaccacgcgctaccacccaagcacaaaccgctgagggtgaagcctagcaccaaacgacccccgctaagcgtggccgaacgccgctaggcctacggcaacaccacagagacaagactctgaaaacgatgccaccacggtggtcacgacatccaggatgccgccatcgcccatctaaaaaagatgtggttttcacccagagaagctcatcaagaaaggaagaggatacccctcgacaacgccccaaggaggttacgacgcccgaagacgtagccgctgccggcccggtgaaccaccggactaggctttcgcctgggaccctacaaccttgactgcaaatcgccgtccaccaactcagaaccaccacacagacaaatggcaacacgtagcttccgccataccacaccaacgcccctccgtcggccgacttcattgaaccacaccgcactgacgcccctccgtcagccgacatcaaccaccgcccctgagagcaaggttgtcagtatcccgattcgtattctagtatcttacgataatacgatcctaccaagccgaaacgataccgatcccacatagtatcctaatattcatagtatctcgatcatactattcattactacacgatcctacaaaattttaggtggtatcccgattctatgatccctacgatactacaaaatattatttaaaataacatggtttcaaataaataatataaataaatatgctcaaatttatataaaaatcagctaaatatatcaaaaccaacgtggtttctctcgataaatatctctatttgcatgacatatatcattactatatttttttaatatagaatggctatatataattaatataaatattaattaaacttaaaaaaagaaaatcccatagtatcccgatactacaatacgatcctacggtacgatattactttgagtaaaacgatactacctattatcccgatcctgacaaccttgcctgagagctggcccaggacccctccgttccaccacccgctggcctcctcgccagctttggacgaaaggagaacccgggactggatggcattgctttggcagcctaggcttcccccgctgacgagctgccgcctcaatccaacccagaaactccccacagagaaggggaggagctccaagaagggcgagggtgccgacctgtcacaccctgaagttctcctcccaagcctaaaatttaatttataaatgaccctaagaaaatgccggtgcaaatctaagagaaaaccctaagaaagtaatacaaataataatcgaatctggcatgtggaatttttcttgagttctacatgtcgaaagtcactaacaggatttttagtggaattttcagagccctagaaataattttaaccaattaaaattgagcaagcaatattttaattccagggaaaatccttttcttcctttttctttttctttttcccccttttcttttcgagtgggccgccggcccattctccttcctcctctcccctccgctgggccggccgaaggccaaggcccagctaggccggccgcctccctccttccacccgggacgccgacaggtgggccccacctgtcgggcccgtctcctacctcgcgcctgcgccgccgcgcccacgcctccgcctcctccgggccacgtcggtcacgcccgcgcatgcgccgcacctcccgcgcccactcccctctctctcccgcccgcgcccgcgcccgagatggccgggattcgattttcgaatcccgcctatctctctcctctcccactcccccacgttggccggcagaatctcgcccct

SEQ ID NO: 40482 - DNA, 12088 bp, Oryza sativa
tttgttagcttgggttataacatgaatagacgttggactaggagttgcttagccatgcttagttcaactagtatataatggggaaaatcctgttaatgtttagactgttggttctaatggtattgttggattagtgccaccgctttggtgttattaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagctgacgcatccaggcaagggtgggcgtgatggagtttggatgggccctgcgacggcctatgcggcttccagattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtgggatagcgttggacagcggatgatcaatattaattaattattgcaactgtttaattctttcaacttctgtttataaatgctcgctttatgcaaatgaaccactctagctctcccttgataattccctgcatcatacccctattccggtatgacttgctgagtacagtgggtagtactcagtcttgctctattttcccccaaccccagagtgcgagtatgtgtccgatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtggatctgaatgtcaacattgtcttttgtgtaccccggccggtcctggacggggattttaatgcacattctgcttggaattctattcgggaatttctgggcgtgacacgaccggcaacggagaagacgacccaccgctgccagctccctttacactaccatctgggcttgcgccgacgccagtgaagctattgctgctccggctccggcacaacccaccggcgcccccgtcacccagccgccgcgccccatctggccgcgccgcacagcccacccggccgaggagggcactgcggcggcaccctggctgcctggctgccgaggcctgcccgcgccatgggggctcgcggccgcactgccgagccgcgtgagcccgcaccggccgcacgccgagctgccgcctcccagccgccgcgcccgggcagccgcaccgggccggccgtgttgccgccgccgctcccagccaccaccgcctccaggctgccgccgtcacagccgtcgagccgccgccaccgcgcccaggctgccgcactgggccggccacgccgccgctgagccgccgccactgccccccagccgcctcgcgccgccgtcgcaccaaatccgggcgcgtggtggccggatccggccttggaggcgccggatctgctgcctcccctcatcgcaccgccgtcaccacctccgaccacggtggagggtcttcgccggcgtcgtcccgtccacgtcgtgccgggagggagtcgccaggaaggaagggcctcgccgccgccttccctgctcgctgccggctttgccgccggcgagctctggcggcggcaaggcggtggggagggagtggaggcgcgggcggctagggtttttcgccccccgagccgcccgcgcgagagcgacgcgagggattgttcccttcattttttgactatttcaaatgtctcattccagaaaatattgaattaatgcacacgagaaatacatttatgataaagtttctctagatacataagctagtgtttcaaagttcattcaagcttagcatatcactttgcaatctgtttttaacgggtccgcggtcatagttcaacacgaacagttgaactcatgacgacctcggtccaaggccctccaaccttcatgtagttaatgaagttagcctacctctactcaatttcaaggttcagcatgctgtcagagaaaaaatgtctacagcataaatatgtccagtatctctatactaatagagcagataaaatatagcaactgaagagtgaattgaactggtcataaagagctgaccaacaacatactttatgacaaaagaagtagcagagcttaaattgcacatatcttcaaatattgggagcctatgcttttgccatatgtcaagcttcttcttgtatagtggatcttggactggcatatctattcgaataagtgcctgaacagtgataaggagttactcgaacaccatgtgcaacaatacatacaaagggcagcgatttttgaaaaatcaatgtgcaattaatatgtaatatttcttggtcaatggaaaaggaagtttaattagaccttaagaactatatttttaatgacatctagtcctcaataataaaattactaatctttcaaagtgacaaagatgcgaaaaattggtatttgttttttattgttttattttacataatataagtgccctttcaatttatagtaagcattcgtgcctcctggaaatcaggacatttgaatttagagctaggctgctgttttacctggtcatatatgtttctggcgagtgtaaatccaaagttgagtgccagtgtagcatttgagtatttcccataccttatcatcacctaaaattgtagtgaacacttgagatttcagagctagcagaaacacataaaaagaaatgaagcacggttgcctccattcccagaaacatttttgtgataaggataaagatgcagctcatggatttggctactcacagtttatcaggttatttaagtgtatagaataaagcataataactagtagcaagaatcacctgttcaccaacagcataatttctgtcagcaatgatctgcaagttgtaagaaataagagcaaagaatgttactttggtatctctaggtggataagaaattatgtaaaagatcttcgtaaccatacaacataggcacaaaagtacacagatagatgtggaactaatgatggttacctcacaaacatctttctgctcatcatatatcaaaacagaaccaaaaacaccatcatggttgaggaaatctgcaaatggaatctaaatgacgctttcagtatcacgaaaatgttagggcattatgcatgcgatccatttaatctgcaaaaaagatgataggaaacaaatgagagaaactgtaccaacaatacacctctaggagtccgccaagctcgagatgaaactgcatgtgccatgtaaaaaatgccccaagtttacagtctctcctattatgctccttttggtcatttaaaactcaaatgaaataccactgtacattgcaagaaggtccaggtggaagtgcccttcttactaatttggtttaaccaacaatcagagggattcaatgtctgacatgtggaaataaacatgtatagtttcaaaacagtaagaatgttgccagcctggttccaacatgttgaaatgccaaaactagtttaatatattgattaattactaatttatattttcctccttaaatgaggagttgaagcggtggcacattctacatcaacccctcctctatcagaatctttagtgtctttgtaaatgattgcatcatatgccatcatccatttaagtgtatatgcatgtggctataaaacctgatgtgaattatgtattccctattcctgatttgattatatttatttacaaccctctgcagtgcatgggagccatatgatagcaatgttgcatggtgtgaccgatgtactcaacttgcatgcattaagcaacatcaaacacgaattcagcgaggaaatgttactacatacccaatgcagaagcatgcatgaaatcccccaatttaacttctccaaacaaatgtgggaaatggtcaagagccttgcatatgaaaaggataaaaatgagattggtggaaaaggaaggatagattggatgtgcatattgcgtgcatagatagagaaaaggagggtacaaactggcttcagtgccaaaaattcctttttagcttgttccttgtgttcaatggcttcatcataaattgagctgttttggaccgcatggagctcatttagatcccagagcacctagagcaaagtagagattttggtgcatcaaatctctgttggaaatgcatataaaactcaaaaactgggatatgcagatttgagaacagaaaaggtaaaacaatcaggccccaagttaagcatattgaaataccatgttatgcatctgatccttggtgggaagagatttaatatacggcgcccatcctgattcctacatcataaaaggaagcctctttcttgagaatgatatgtgaggaggggaggggaggggaaatagtagagagtagagagaaggaggtacatttcccaagtgttgctccatgatgaggagcgcagcaagcttagatgtatctccaacagcatggtcaagtaaggtgttaaacttttgaggaagtttatcaagggtaagctgctgcacatacatagagacaatatagatgtggtagaaaggatgagattggttgtagcagagctgatgagggggaaggaagtattgttattataggaacatacaacatggtaaggaacttgcattatacagtccccctcttgaatgggctccgatgcaaataatgacctgaatggacaaaaaaagctagcagctagtaacagattattatgtagtagtagaaattaagagaacaaattaagggagagaatgagaatgagaatgaccttccaaaggcagaggaggttccgagagataatacagaagaaatgtgggttccagacttgctgcgcagccaacgcaggaatacagagcagtcgcagtcgccgccgccgccgcccccctttgaattccaaaacattattattagtaatagtagtaggcagtagcagctgaaggtactccatatattatgaagcatatagaaataccttggaggcggaggcggcggcggcggcggcgcagcggcggggtgcgaagcggaatcgcatcgagcagagactggctagtcgagtcgtgggatgacctttgcgttagctaagctcaacaaggcccttcttgggccccaacaaaagagggcccccaccaaaaccaaaaaaaaaaggcccaaaaatttaaaaagaaaacgaccacagtgggagtcgaacccacgaccttctgatccgaagtcagacgcgctaatccactgcgctatgcggtcgcctctctttttctgctttatcctttttttatttgtacagaacaatcactgtaccttttttttttactgaacagaagacttgtgactgtatgggattagcctgtcttttaaacacaaatgtactgtaattgatagccagaaggcaaaaaaaacgcgctgattactctggggatgcatgcgagacatggaaggagtagtaatctctgtaagtactgtatctaggaagcatcgtatctaaccaaagcagagaatatgaaagtggctagcaggaacacgtactacgcgctcatccatccatccacccactgattacttcaattaattaatactaatagagatcctgaaaaaaaatgatacgtggtacaagctagcaccaggataagttccaacttgaacttatcttttctttttcttctccactcacctacctaagccgggcggacagaagaagaattcccctttcttttcgtttcaagttagatatgctagtagctactagtaggaatttgttcggttcacactaattcaacgtcatattaatttgtattgtactacagtactactgttccacatcatctaaaatatcgtcagactgtactttttacctacactcgtttcatcctattcaaaatcataggtctccaaccatggttcagttgtgttaggcgtaattagtgctaatagtaagttttttatatttaaaatgaaaattgttgaagtataatttgagagcatttacgaggtaagttgtatcgatgatatttctctcactagctattaagatgcatcgataactttctcgtagttcataatctgtgaattgataccccctcacatttcatgaaaaaaaatggcttttataaatttccgtatacagtagtacttacagatactagtgcacataataatctaaaattaagggtgaagcaagcagtaagcagggtggatgagaaatcagaaggaagcggaagcgcgtggaggcatgggcgatgaggaggaggagatgggccagaactgtgcgggcttgatcttggagacggcagtgagcacggacagcggcgtgacgtggccgacgacggtgaccttcttggtggcgatgtcgatgtccaaggaggtgacgccctccatcttggagatgtgcttcttcaccttccccgcgcatcccttgcagtgcagggacacccgcaggaccaccacctccacctgcgacgatgactctctcttttcctcttctcctcctcctccttccactgcagcagctacgatctcattctcctccgccgcagccgcgacagcaaccgggatgacgaagggcggcggcaactcatccgcgctgggttgcatccgggaggagttgagaaggaacctggacgagcttgcagggctaaccagctgctgcttgctcttgttcgccttcgtcttcttcttcttgctgctgttgctggtgcgagctgggtctcggaggtgcggcggcgagtggccggagaggacgatggaggtggaggcggcggaggagcaggagaggcccagcagccgcttgttcagatccttcaacaccacagacgccatgcctactgcctcctctgcttgttaattactgtactactactgtagtttgctgctgattttgctttgctctcgcatcgcgcgcgcgtgcctcttcttgcttgctgattgctgctgcttcttttaaactccccaccccagcagcagcgacttcagcataggcccaccaaacgaacctttgctttgcttctctgcccctgcccccactgtgctgtccatttcttattcgttttaattttagctaccacagtatactgcgctagtgttttactcctatataaacatcatcttttgtacttacctatatactgtactccatatactatgcaataattaagtacgtacagatcgagatcaacatcgggtcttttagttttgtcttattgtctgtttcatgaatacagtataagagatggcatccacactgcataaatacatacgtatacagattccttcacatgcgcaacaggacgtacatacatgctgctctaccacacttattttaatttttctctgctaattactacaactaatcaggccgccatacattcattaattagcaaacaattagtaaaagaaataatcagagagacatagaccaagtgctagctgcaagctagtcaaatgcagattgatagactgtgtaccacaactagaagatgagagatgagagatgagacaagaggcaactaggcaatgatgcaagcggattattaaaattctagtacaatttgctcactactacagtttactaattagactgcaggtacgtcgccgtcgaaatgtagaaattggattagtaaaggttgactcaactgaaggagaaccactctttcttcctccgcggaaatgaataaggcatctgcacgtaccttacctttcggcccatcagtttgaaactcatgcagtgcaggattacttgtttacgaattagtatgagtcagtggtttaagtatatataaataataaaaaaataggcacggatcagctgagcaatttgctttgttgacattggtacttattactgctcttttcttttctttagggaccctacatattgacgactttgggtttatctttcttacttaatttggtgagtcattaattggttcatcatgatcaaatgatgattgtctgcactgaactgaacaatcaatcggtcggtaagctcttcagtcggtgctccgttcctgtcacctatacttacttgttcatctttaattactcccagtcttactacgtgttctcccatctcaagtgcatatgctcaacatggagacactcctcctactgctgcatctgaatggagcaagtagttagacagtcagtcactccttttagcagaaaaaaggctgatgatggttgcttcttgttggtcaagagaaaaaagaatgaatcacaaaattttaacaagattaagaatgtaagcatatataggcacccactgcattagtatatactatatagtactagctagtaattgctccctgaatttcttcacctcgagcctaacccctgaaagaaaggaagaaaaaagaaaggcaaatggcaacgccaggagacggctagctaattaagctagaattaatacacgcactgattaagctagaattaatcaaaagctaagcaaattcagttgacgagtggactagtgtagacagtagcccccaaggcccaaacccccggccgcaaaagaaaagaaaagaaaaaaaatcacatgctatgcaccatcggcggcttctggtgaagctccgactctcgttaatttgtacaccttaggtccggaggaataatcgaaaataatttggcagtctcctctttttcctttttttttggggacaaatatatactctacctcctttcactttttagctaatcgtagtatgctctatctgcatatatacatcgtgcttgcttttctgatatagtatatgcaaatggctgctggaatgttgaggtttatatgaacaacccctgtagttagctccttttcttcatttggaatgttgagagttctgtacggttcaccagcagcaaattcggcgttcaagctaggctgtgtttacttcagcgtaaagtttgaattttggttgaaattggagatgatgtgactgaaaaagttgtgtgtgtatgacatgttgatgtgatgtaaaaggactgaagtttagattcaaactttggatctaaacatagccctagcttagtttttttttgtctttttattcatgttaaattattgatttcgatatgattctgatcaatcctgttaggtttttgttcatatcatatctggttcacactcagaaaaaggtttgcaatctatgggcaatggtgagaagcttctcatccacgactagaatagaatctgatgctgccaggcaggcaggcagccaatggactacggagcactctactccaatgatcaatccctttattttctttctttttttggatcatttcttttttcttttggaaaggcttcaatgatcaaggtagaatactaggtatggaaatgggaaagaaaagaaaaaaaaattggaagatacggtattgggccttgcaaagaaaggcataagggagagatggagtttctgggccaaagttaattcagtgagcccgtccggagtaagagtattaggataagttcacttaaggtccctaaggctgtgtttgagggaaaggtgattgagaagattggaagaaacgcaaaacgaggtgagccattagcgcatgattaattgattattaactattttaaacttcaaaaatagattaatatgattttttaaaacaactttcatatagaaaatttttacaaaaaacacaccatttagtagtttgggaagcgtgcgcgcggaaaacgaaacaaacaaactccctttgttctccaaacgaactcagcctaagttgtccctgaaacgaaattagatcccaaaacggtttaaactacggtttcaactgatgtaccgcctacgtggatggtttgacttgattcatgtcccatgtggcgttgatgtggcactataagcaatatttttttaaaaaataaaataaaatgtttgggtccatacgtgagataaacaaataaaaagtatagtggggaggcatatgtcggtgagtcccacttccttcaaacccccttcaccccccccccctctctctctctcttctctatgtcattccctttgctcccaagctattggcaaggaacacagcaaacaacaaagaggtaccgaggagggagtcgtggtgtcctgcggcagcggatgagaggacgaaggcaaggagagaggagctataggagccctcccacagctcctaatattcgtcactggagcagcttgccttctcgcggctctagtaaaactaatttacataatatttttttctaaagtctgatgtgtacctttttttaaaatttttaatgtatattttgttgttttgataatcaaaatagaacacatatgtgcctcttgtctaattcctatggaacacttcatttatttattttttcatttatgtagtatttttatttttttcttcaattaatatatggtaatttctagttatcgaaagtgaacatcggtgcttttcttttagtcccatatatctagcaattacacactttgtatttttaataaattttattatgaatttattccaaatttcttattttgaaggtttatttgaaattagtattgaaaatcaatttcgggatttattttattacttagttcggattttaattagtagtcttggtatgcagtatttatttatttaaatttttactcttgtttttgaattttagtgatattttaaagcttatttggaatctattttgttcttattcggaattttaattaatatattttgggttgatgatggagcggaagtgcggaggtggtgagatggggtccatgcacgcaaggtcgcgctggcgcgggcggcaggtaatcgatctgggccggccaggcctcagtactacgagtcaatacacgaacggaacggacgtctcggaagataagtgattcatcgcccgatccgatccaaccgggaacggatccaaggatcgcaggccatcagcttccttatccggctaactgacgataattatctttgaatgcaaccaactgaacttgctgcatgtacgcagtcactcccaccccacctggactggagcatcttctataaatagctacaatgatcagtctccctcccagttaatcacttcaccttcttcattcagttcatccaatccacgatcacttcctagcaattaagatcatggtgcagcgcacttcatccgattcggcggcgtcggctgaggccatggtcatggacctgagtcccaagcgtcccgccaagtcctacggcggcgaaggcggctcgtactttgattggtccccctccgagctgcccatgctccgcgccgcctccatcggcgccgccaaactctcgcttgccgccggaggcctcgccctccccttctactccgattcggctaaggtggcctacgtcctccagggcaagggcacctgcgccgttctcctccccgagaccccctccgagaagatcctacccatcaaagagggcgacgcgctcgcccttccattcggcgttgtcacctggtggcacaacctgcacgccgccaccaccgaactcgtcgtcctcttcctcggggacacatccaagggccacaccgccggccgcttcaccaacatgcagctcaccggctccaccggcatcttcaccggcttctccaccgagttcgtcgcccgcgcctgggacctcccgcaggacgccgctgcctccctcgtctccacccagcccggcgccggcatcgtgaagctcaaggatggcttcaggatgcccgagggttgcgacaaggacagggagggcatggtgctcaactgcttggaggcgccggctgacgtggacatcaagaacgggggccgcgtggtggtgctgaacacgcagaacctgccgctggtg

SEQ ID NO: 40483 - DNA, 5852 bp, Oryza sativa
tcatcgtccccaggttcttcgtcgtctccaagatcgccgacgacaccggcatggagtggttctccatcatcaccactcccaaccccatcttctcccacctcgccgggaggacctccgtctggaaggccatctcccccgccgtgctccaggcctccttcaacaccaccccggagatggagaacctcttccgctccaagaggctcgactccgagatcttcttcgcccccaattcgaattcgatttgatggacaatatccatcctccatctccagcacctgcccacctagcagcatcagcagattcagcttccttccttttatttagatcatgtcagtcgttagatttaattcggttctttggttgttagcatcacctacctcttttatttgataataacaataagctcgagatggagtggaatttgatagtcctatcatgcatatgtcctctttatttttttaaaactctgttttaaagtcaacagccgttcgattcgatctgccatgcatgaacgaactggttttatcagattttgtttgttttacagtggagtggagttgttattctgagaggcgcgcgatatatatgaatctaacaaattggctgcatgaatgggcgccatatatccccgctgcccgcgctaacaaacaaaggcggcgagtgtgcgtgggatagatcataatagatggacgcatgatgattgcacaaaataacctgtttattgtgttttcttgtctcctacatctaggagatgaactgtagagggagatgagctgttaatcatgcatgcatgctgctttcattgttgttgaacaggggaaatgcacactgctatagctctgaatttagtgttctgatttttctttcgaaatcattaattcaaatcttaacttttgtggaattcctgaatctaagctatgaattcagcacttaatctaaactctgaaataattcccgtagtcctgaaatcaatactacttcgtgtgctcctaaatttcattttagtggtacatctgcaaaaatcgttatggtatcttgtcctctactgttcaacagaacttgtttcgcagctctagttgatgattcttttaaaataatgatttttcattaatccagtctcaatatccaacaaggatatacataaccaaattatccacatagggtatatataacgaaatgaatacctaaaacacttagactcgcatctcaacaagaagagaacatataaccataaaaaaaacaagaagagaacatacaaccataaaaaaaccatgacctcggtacacatttgctttaggtgagttgaattgatgccacgtgccgctggttagcccaccctcattagttgtcgtccagtcaaaactagccgactagacgggatccgcttccgcgccttcgccgcatatagagcagctgtcattgtcgagatcctcttccgcctcccggactcccaaccttccaccgcccctaggaccgcatatcttgctgaaatcccagttctcctccaccgacgtcgaggaaatcctcttccgcccgaactcctaggtctctgccgctctagttgatgatggaaatcattgacaagaactatagcacttggaatttagagtagagttctgcccattttgctaacagagtgtgaaattcattaagtgggctataaaaattcagtatggaaaacatgaagttgcgagaatctttaggcttagatcccaccccaaaatttttcaccatgtcacatcaaacgtttgaacacctgcataaagtattaaatatgggttaaaaaaataattaattgcacagattgcgattaatttgcgagatgtatcttttaagcgtaattgctccatgatttgacaatgtggtgctacattagacattttctaatgacggattaattaggcttaataaatttgtctcgtggtttactgacggattctataattagtttttttattagtgcgcggacacccaatacaacaccatatataatacccgatgtgacacaccaaaactttacaccctcttagatcagttagttgggcttgtgcttagaattttacatggttgtccaatattatctgagctatttatgacttttattattttttaataagagagtaaagaggaggagtaaagaggcaaagagtagagtagcaggaacccgaaaacgcaaaacagcagaagatggaggtgttgagcggtaaaaagagccaacctgtaaacctaaacctaaagaggaaagcaacagcagtagcagtagcagtagtaggctagtgtggcgagtagtagtggtattcccctcttggtcttggtgttgggctccgatccgggtcggccggcgatcgaggtccgccaccactgaccgattcacctcgccgcccgccgcccgcccatgaagcattcttcttcttcttcttcttcttgggtcttcttctagactggactaccttgtttgactagctagctactaaggtagtgtggatgccattcaaatctgcctccgccgccgacgagtactagccgctgctcatggtttcgcggggcctcttcggctggtccccgccgcacgtccagcctctcactcccgtctccgaggcctccgagccgccggaatccccctctccctacgccgctgacctcgccggggacgccgcgccgcctccggaggatgacgccgccgccgccctcgacgatggggacgacgagcccgatccgccccccgccgccgtccccttcaagcgcctcttcgcctgcgccgaccgcctcgactgggcgctcatgtccgccggcgcccttgccgccgccgcccacggggtggccctcgtcgtctacctccacctcttcggcaccgccatccactcgcttcatggccgccacaaccacgaccttttccaccacatcaaccaggtaaggttccttcattcccctttctcatacgtactaccagatctccatttttctcatatacatgccactccactcctacatatatggtatacgtacgccccgccccaccccgcaaatcaacattccttcttacttggcgcagtaatcatgcaaatttccttggttgttacagttacaattcttctgccagctttgcattagttatctccaatttcataagcaaactacctagttagtattagactgcagatttattcttaggcttgtttggtaagctgtcattatttatttctgcctctctctgatgttgatttagataagctgctgaccttttacgatatggtattgctaccggtgtttataggcgtatggttgaagcttatatcactccatgtctgaatgtgccgctttcgctagcttttctatgacctatgcatttatgcgtgttcagctggaaccaacctttcgctccaacacactgaatgaaacaattcgctctcacgcgatgaacctttgcaaattcatttactagtaaaattactttggcagcttgctggttttctaaaccttcacaattttctaacctccacactaatatctgtgcatttctacactcatttatgcatctcttgtccatctatctaattggttacactcacttttatgtgaatatcagcatttgcttgtccttctatctctgtataatcattttttctcagaattatgtatctttgtgttttggaagttagtaactaagtgttttacccgcagcatgctttacacttcctatatattgccattggcgttttctttgcgggatggataggtaagatgaggctacatcagctttttatgcactctctgttttcttttattctaacaaattcactgtctgttatatctatagaggtttcatgctggattcttactggggaaaggcagacagcagtgataagatcaaagtatgtacaagtgttgttaaatcaagacatgagtttctttgatacctatgggaacaatggtgatattgtcagtcaagtgctgagtgatgtcttactcatccagtctgcgctgagtgagaaagtgagtaattatgagccttcatgattattcacaacaaatcgcatgcttatctgactgacaagggttattctcccattctggctttgttcttttaggttgggaactacattcacaacatggctaccttttttggtggtcttatcatcggtttggtcaactgttggcaaatagctcttttgacattggctactggtccgttcattgttgctgcaggaggaatatcaaatatttttctccacaggcttgcagaaaacattcaggatgcgtatggtgaagcagcaagcgttgccgaacaggtattcaaattctttgactttcttttatcctgtaatgactgcccacatctcatccgtgaataaccttggtttgtcctactttctcgctacaaacgactatttctaaaaagatgagagtacaacatcatcgtctaaaaggataataaatttatggtcttgaaattggtaggcctctagtgatgtgcggaatggtggatttagctaggaatatacctcttgctaaaatacaaaacacactttcctttcgcaactgcatgtagcattattattaattgctaatgaaggtatgcatccatttgaatcattctcattattgcaggcaatcttatacattaggactttgtactcattcacaaatgagaccctcgcaaaatattcttatgctacttcacttcaagcaacactgcgctatggaatcctgataagtctggtgcaaggtcttggtcttggatttacatatggccttgccatatgttcttgtgccttacaactttgggttgggaggttccttatatctcatggaaaagctaatggtggtgaagttgtagtagccctgttttctattatcctgagtggcctgtaagcatccaattttaagagattgccttacttatagttttatattgatcagcacactcatggttcccaattgtttgtaggggacttaatcaagcagcaacaaacttctattcttttgaacaaggacgtatagctgcatacaggctctatgaaatgattagccgttcaacctctgttgtaaaccaggatggccgtaccttaccttcagtgcaaggcaacattgagttccgcaatgtctacttcagttatctatcccgcccagaaatccccattttaagtggtttctaccttactgtacctgctagaaagactgtcgctcttgttggcagaaatggttcagggaaaagcagcattattcctctcatggaacgtttctatgatccaactttaggtattatgctacaagctattctttgctattttctgtttactcaattatgaatttgaatcatctttgttatatgttgcaggtgaagtgcttttggatggagagaatataaagaacctgaagttagagtggttaagaagccagataggacttgtgacccaggaaccggctttattgagcttgagcatcagggaaaatattgcatatggaagatctgccacaactgaccagattgaggaggcagcaaagacagctcatgcacatactttcatcagttcacttgaaaaaggatatgatactcaggtgctgttcatgctttattctaacatatattgaaactgtgaaacttcttattctcttttaccggtgaacgtgcttatttagtgaacctaaatatgacataggttggtcgggctggcctttcactgacagaagaacaaaagataaagctctccattgctcgtgctgtgctttcaaatccatcaattcttttactggatgaggttactggtgctcttgattttgaggctgagaaagctgttcaggaagcactagatatcctgatgcttggtaggtctaccatcatcatagctaga

SEQ ID NO: 40484 - DNA, 1906 bp, Oryza sativa
aacttccaaagcggttagtgcacccatcttatctaattaccatgtatttttttgttctgcattaatgctggagaattttcctgatttcctttggtgctagcaaatgttttatttttatttgaattttgaggtcccaagatacatgtattagaaaagaaatctggacaaccagtactatctgcctctatcgtattccagcttgagtgaattgttctgacttcacagttttaatagtttcctttcgtgcattcaggattcacaatttattttctttagatagcctcatatcatattatgctctttcttattgttcagtatatatccctacttttaatctcttagctatttatttgcccatcaatcaaataacgtttattcttcatagcttataagtgtcctaaattttgatggttgatttgaaggactcattcccacctaaaatgtttcaggactccgataagaaactacaaagagcctagctccttccaaattgaaagggattcttcagcaagtcacagcttccaagagtcatcatctcctaatatgtcaaagtcgccgtcacttcagaaaacacacggttttcttgcattccgtaattcagatgcaaatcataactcacacgaatcaccaaatattcaaagccctccttccgaacaaatggcagaaactaggttacctacagttgcttctgagagagctccatccatcaaaaggcaggacagttttgaaatgaaattgcccgatcttcccaaaattgatgtcccactacaccgacaatcttcaaatacttcagatccagaatcaccaatatcaccactattgacttctgatccaaagaatgagcgctcgcactcaaaaactttcagtcgtcctcttgatatgtttgacaattttcatgctgaggagtcaaagaagcagaaaacaaaagctccatcgttttggaggcttgtagaacttagtcttgctgagtatttttatgctctattagggagtgctggtgctgcttgctttggttcatttaatcctcttcttgcttatacaatatctttaatagtggtggcatactatagaattggtgtacgtgatgtgcatgatgaagtcaataagtactgctcattcattgttggcatgggtataataaccgtgctagctaacttcttacagcacttctattttggtataatgggagagaagatgactgaacgtgttagaaggatgatgttttcaggtatgcctcttctgaaatgtgccatggaaagttccattgcgctatttggttcaataccaccattataacatactcttgattgtttatcacatccatatttaaaataatgtctattttgtgattgtgtgtccatgacactacgcttctatagcacagatgattcggcagtagacatctaacatatccactgcaatcagaattcacatttcttagggaacttacattttctgtttactgtattccagcaattttgcgcaatgaagtagggtggtttgatgaagaagaaaacagtgcagacatattatcaatgcgactcgcaaatgatgctacttttgttcgtgctgctttcagcaacaggctttctatattcattcaggatacagcagccatttttgtggcacttcttcttggcatgttgctagaatggcgtgttgctctggttgccctggcaactttgcccatccttgtaatttctgcagttgcgcaggttagttctcatctattttcaacatttcttcaagctggtaatgccgtaagtctatactaatcttacattttcctatatagatgcatcttatactgaacgcttattacatgctactaagatttacaacgttcttttagctatgtcttggtaacagttgaagttttgaactctgtccaactgggctgcaggaa

SEQ ID NO: 40485 - DNA, 2225 bp, Oryza sativa
gttgttatcactgttttgaatagcttatagtggctttgcttcttttgttttgcatgtgagtcaagtatacatttgaatccacaattgtttttcttcatatagttgtccaatgagaatgcacagatcttgacatgaaaagttttacagtgagcttgttgaaaaatgaaaatcatgtggagctcatgcctggatttgtttttttttccttccctcagaaaatgtggctttctggcttttcaagaggaattcaggagatgcacaggaaggcttctttggttcttgaggatgcagtcaggaatatctatactgttgtggcattttgtgctggtaacaaaataatggaactttacagactgcagcttgggaatattctttggaaaagcttggttcatggaatgggtattggttttgcctttggcttatctcagttccttcttttcgcctgcaatgcacttctgctgtggtatacagccgtagctgttaagaatgggcaccttagtctggtaacagcacttaaagagtacattgtcttctcttttgcgacttttgcactggtggagccatttggccttgcgccatatattctcaagcgtcgaaaatctctgacgtcggtatttgaaattattgatcgtgcacccaagattgatccagatgatgcaagtgggctaaaaccccccaatgtctatggtagcattgaattcaggaatgttgatttttgctatcctacacgccctgagacgatggttttgagtaatttcagccttagagtcaatggaggacaaactgttgctgtggtaggtgtatctggatcagggaagagcacgataatttctttgatagagagattctatgatccaaccgccgggcaagttttattggatggccgtgatctgaagctgttcaacttgagatggttgcggagccacatgggtttagttcctcaagacccagttatattctccacaaccataagggagaacataatctatgcaaggcacaatgcaacagagtctgagatgaaagaggcggctaggattgcgaacgctcaccatttcattagcagtttgccacatggctatgacacacatgtgggaatgaggggagtggatttaactcctgggcagaagcagcgaatcgccattgcccgtgtagtgctgaagaatgcacccattttgctgcttgacgaagccagttctgcaattgaatccgagtccagtagagtggtgcaggaggccctcgacacattgattatggggaataagacgacagttctcattgcacatagggcggcaatgatgaagcatgtggataacattgttgttctgaatggtggaaagatagttgagcagggaacgcatgattcactggtgcaaaagaatgggttgtatgtcaagttgatgcaacctcatttcaccaaaggattccgtcaacgtagactaatataagaacccctggtagcatttgtacattgctcactctgcttcactaactagtgactggaaacgtggaaggcagcttggagacagtatgagatggtacaagtatttgtgttgcgatctgacaggataggcataggcattggcacaggctctggagtctggacacatgatattttaatttgctttgctgtaataaagctttgagatgaagagtccggaatagcatatagcatgcggcataaaggaggtgaagctgagatgcgctgtcccattgaatccactccaacattgacttgagagtttgatgagtccggaatagcatatagcacatggaattggtcaacattccatgtgctgcgctgcctgcctattcattcatttttgtaactgatcgttattagatcggatttgttcattgtgatagtgtgatgtagttttggcattttatttttgacacttaaatggaattcttggtgggggggggggggtgtgttgtgtagtttggtactgcattgaagtgtaattagggaagggatattatatttgttttggtggaagtagtagaagtaattttgggcataggtgtgctggaagtgggagtgggtaggtattcttgtttgatcatgtttaagcaggcgcactggtaattaatttgttgatacactcagtttggtaatggagcaaagctctgggttgttgaatggaatgatggggcggcggaagagttggttatatttccggttgtgtgggttttgcccctctcttgtgtggttaatatctatatct

SEQ ID NO: 40486 - DNA, 1508 bp, Oryza sativa
caaacatcaggtgatgtgggcttcctgtccaaaacttgtatacttttatgccgcattcgaagataaatccaagcataattaacatggacttcttatttccaaatctttctaactcctacctattctccatctttcagatagttttccttgtcaagggtccaatatacttagtttgtataagttgcactgaagagtcatatgaaggattgaggggacaactagagctcatgtatggtcaggtgcttcccctgctgcattcatcctaacacaattaatttctgtgggcttttggttgtgattacacaaacttactttctaaagttctcatccagatttctctatctgaaaatttaatttgtagatgctgctgattttgaccaagtctgtcaacagatgctttgagaagaaccctaaatttgatatggcaccattgctaggtggcacagatgcagttttcctatcacttatacatgcattcagctggtcagttttgttttttcctttgcctgaaatattttacactctagttgcccaactaaatctcaccaaaccattctgcaggaatcctgctacatttcttcatgcgtacacatgccttcccctcgcccaatccacaaggcaggcggctagtgcagttttacaagacattgctgattcaggagttttgtttgcactgttgatgtgtgagcacaaggtttgtccattttcacgccagggaaaacttttactgggatattaaattatgtgactttttgggcataaatgaagtatttaagtttagtgtgctgaatttctgagcacaatttaggtaccacatgtccacattcatctattagagatgcgtatatactatatacaatggtatctctcgtcatttttattggttaaccaaacctgacatgtcttcaccttatgtccttaactatgctgaatttacaattctgttaaggtctttatgaggcgtcattcgttttgtcgccgtcccacgcttcagccaacaattatctgtagttctttgccctataattttacaaaaggatctgtatgtctcgctctttgttctgtctatctaggtttgttatgtgctgctagcatcccatcctgaggcaggctaagatagggcctgtcctcgatctttctcttcaatcctacttgttcgtgtttctgggatttcattctttgttatttttcaggttattagtctagtgggagcacaaaaggcaactttgcatcctgatgatatttttctactttcaaatttcatattgtcctctgaatcttttaggtaatcatcacgacacacactctgaaatggtaatctttactttgagacgttcttactacattttctttaatgcaggacttcggagtctttttcacccatatgccttccaagatacaattctatggctttcttatatgcttatgttcatttttttgatgtgagtcaaatatatcatctgaatatgtatgctttttaatctgtgtcgaaataacttataagtaca

SEQ ID NO: 40487 - DNA, 2076 bp, Oryza sativa
taagaatccaggtcctgtaaaaaatactaagcacctagcatgctgggactccttttctttttcctataggggaattcaacttttggacaaaacatatgaatgaatagaattggcgagtgcagggccatgcttctaatcattcattatataatttgtatcatatttgagggggaaactatattgtagcttcttaagtaatcttatttaattcatggcaggaaaatacatacttgacacttcttactgcaagatcagacgccttttatgatctgaaagattccaggtgagctatacaatcaagtgaccacgtctcttaaaaatatcatgatgcctgagcatgtcctgtcttaagtgtatatggaattaatttcctttcccttttatgaacattgtgtaggtcccgcattcagaatgttctcttgaaggcaaatgtccttgtggaagtccaaaggtctctgcgtgagagcgcactgcgcattgaagatctccctgctgatccatcttctcaatctgtatcaccacctccacagttctctcaagatctgcactttcagttattatcttctgaaatggcaattggtggaccagctggactttggcattttatatataaaagcatttaccttgatcaatatgtatcatctgagttccccttaatcataagcaatccaaagcaacagaaaaggtattgtattttgatttatttattaaatacaattcactgtttgtttttcatacgtatgatattttctataaaattaatattcaactgatatgcgcagattgtacaaagcttatcaaaaattgtatgcttccatgcatgataaagcaactggtccacataaaacccaattcagaagagatgaagattatggtgagttacccagcaatttaattacccttgtttgaagagatatcattgacagatacagcatttcagttaagtttgttaaccagacggtggtgtttgttgcacatttgtgagtagaatctgtatagttttataccacataaaagatgaaatgtgcaatccattattagtcaattctgatgctcaattatttttataatgcatacgagttataatagccactgataagatacctgtggggattcaggtttctgctcatcaaattgttttcatgaaaaagagaagtagacaatctacgaagaatgataagatagatgttattatacggtgataagttgtcattggatccattttagttctatggtaattttgttgggttttccagcatgagccatttgtgttgatgcatgtgtcctgcaaacaaactgacctagaagttataagattttagcttgatttttgctttgcacgttgcattttgtgacgtagagggcccatttgtcagtcttccatgtagaattgcaatacaaaattatatttattaagttttgattccagttgctttgaatctgtgacccataaaggttctgtaaagtctcacgaacatgacctatagcccttgtataactggaatgtcagcttctgttagcattactaaacaaaacataggtgtgaaatccttcttgaaataattttaaatctggggagtatacaatgataagggatgtaattgcttttctcttctgtaagatttggttatgaacgtttgcaagcccatgcatatgtcatcatggtgttcttgggtttactagaattactgagtaatgatattctccgtgtgctttataggaagacagtttgttaaagttataatttttttttgttgcagttctgttctgctggataacccaggattttgagttgtacgccgcttttaatccactggctgacaaggtttgtacctgtcacaatcagtttatgtatgctcacttgtgttttgtttgttgtggtaaatgctgtggtagtctaggcaccaggggaatggattaaggtaccatattcttggttgtatagcaactcaataattttgagcatacttattttgcagagtcaagcaatcaaggtatgcaatagagtatgccaatggatcagggacctggaaaacgaaattttcgtatacggagaaagcaccctttcctggtgat

SEQ ID NO: 40488 - DNA, 6752 bp, Oryza sativa
aaccacgggggtacggtaatagaaaaaccacggtaacctccttaaatttaaataaatttaaaaaataatttaaatttttgataaattttgtacggtttcgtacagttttttatggttactgcgcagtaaccgtgcttaccgccggggcgcccggcggtaacctggcctttgggaaacctgtgcgtcaaccactttttcgaagtttatgccatgttttaaacgctgagaatgtgcgagagagagacgggtaataggatctttctggagcagtcgagtggagtcgattccagaagcatccgctagctctgctggattttttattttacaactccaagtgtggatcgatctggtcctggaatacgcaccgcaagtgtctgtactagcagacacaaagtgtaaacgtcctggaatacgcttgtttctctttgacatttttccgatttattgctggtatttttatctgtgtagagaaatgcgtctattaatgcacatttgctagctgacagattctactaaaaagattccaaactgctgtgcaacatatactggctgcctggtagtagtgtattccaacctcatctgatcatcacaagattctgaatgacgatgatggtcatgtcctactctatggagtggagtggagtagtataccattgattgatgcttgattgattggtttggtgagtcttctttccgtcccaaaatataagggattttggatggatgttggatggatgtgatgcatcatattactctgaatccgctcaaaatcccttatatattatagggcggagggagtattttgcttcccatttttggatatgtcacatttgatacttcctctgtcccaaatcccatataaatcaatacaaaactaagaagactagaatatcctcactttatcaactcacaatacaatgattttctactttacctactctcaatacattgattttctaatttcactaacttgatgcaatgattactcaaaaactaaatgaacttattttaggacaaacgggatgggttaaaaataaatttatacatctcttcgataataagaacctagaatcgaatgagatattttctagcctctttagatttgtggtactagaaaatgtttcatccgatcctgattcttgtattatgtgatgaggaagtatttcggtacgaagagagtattagcttattttaggatgaagggatagtattttgggacaaacataagaaactgaaaatgaacttattttgaaacaaaagatgtactccctccatttatttttgataggtatatttttaaatctggaaaatttatttttgataggcatattttaatccaacaatttatcatcttaattactttctcggatttaatgcgtgacttcattcttccatacaagattggctacatggacatcgagaaatgtaaatattaatgaatcacttatttacgagaaataacccgtagtatgtttaaataaatgacaagtagaattacttatcttttatttgtgtgctaatataaaatataactataaaaatagatagagggagtactacatgaccctgcaaattccatggatgagctctcacaaccacaacacgagcctccatttcattattatagccagacggtcagataaattattgaatccagagagagcatgcagccacgtcacggtcggcgcctcagaagcgaccctggccaaccgtttgtcctcgtggcgcgtccctactggccaggaggcccggcctatcagcaaggacaacggctgggcggcacacatcgccttcttcctttgtttctactccctcccctcctctcactcatcgttttctataatggacgattcctttctaaaagaaaaaaaaatacttcagttattatttattttacaggttggtactctcctatattagtccaaacaatttctctagctccgtatgaatgcatttcttttctaaaatttctgagcatcttttgcttagtacagtatattataagggagtggttatacattatttgatatattttacagaaaacttttaaatgtaaatatagtaaaaataactatattccaattacaacatatagagcaatttatatgtagttcgtatgttattgaattaactcgagtgtggcctggtggctaagagcgaatgcatccgctcacgacgatgagggtttaaatcctagcttcaggtacctgcttgtttttcgtagtcaagtttcccttccttttcataaggaaaattgcttttgagatcttttattttcggacgatgtatcatggatttacttcatgtgaactctgtctttaatctataatattatattgagttttcaaaaaaaaaagaggtacctgcttagtggtttttttttctcacatggcacaaatctcaagacgacccaacggatgagaaaaaaaatgcaatgttatatataacgatactctcagccaggttctggaagaagttttgtttggacgtttttttattccttctggataggcatctagtctcagaaaatctctgaaatacaaataaaaaaaatcatagaacacgtccttatccatggaactgtctgcaacttttgttattgatgacaaaaataggcgcgcaaagggcggtgaagaaactaattaataaaatgaaatatggatgccttatgcatggctttggcttggtttggtttggtttgaagaggtcatatatgaatcactcactctccctccttccctatatatagtagtacaaagatgggagagagtgtggaggggagcaatataatagccgcgcttagcgtaactagacgaacgtactagcagaagaagaagaagaaaatgccggtgagccggatcgcggtgggcgcccccggcgagctgtcccacccggacacggccaaggccgccgtcgccgagttcatctctatgctcatcttcgtcttcgccggatcgggatccggcatggccttcagtaagcaagcattgaatccaagtaattcatccgtttaattatgagtaattaatatgatgatggatcgataatggtacgtaggcaagctgacggacggcggcggcacgacgccgtcggggctgatcgccgcctccctggcgcacgcgctggccctgttcgtggcggtggcggtgggagccaacatctccggcgggcacgtgaacccggcggtgacattcggcgcgttcgtgggggggaacatcagcctggtgaaggcggtggtgtactgggtggcgcagctgctggggtcggtggtggcgtgcctgctgctcaagatcgcgacgggcggcgccgccgtgggtgccttctcgctgtcggcgggcgtgggcgcctggaacgcggtggtgttcgagatcgtcatgaccttcggcctcgtctacaccgtgtacgccaccgcggtggatcccaagaagggcgacctcggtgtcatcgcccccatcgccatcggcttcatcgtcggcgccaacatcctcgccggcggcgccttcgacggcgcctccatgaaccccgccgtctccttcggccccgccgtcgtcaccggagtctgggacaaccactgggtctactggctcggccccttcgtcggcgccgccatcgccgcgctcatctacgacatcatcttcatcggccagcgcccgcacgaccagctgcccaccgccgactactgatcatatcatatcatatcgtctgctcccagtctcaataatcgaattcgtcccccgtctcgatccatatatagctagaatattaattactccatgcagctgctacctgtgtcgtcttccacccccaatcaattactactctcttcttctgtacaaacaaattacgtaaatctcctttaattccaaaatctgtgctgtgctgtcaaccaagccaaccatgcattgcagctgtaacgtcgtccatccatcggttgtctcatctgcaatataatgtcaacacatcccatgcatcctaatccaaagctctcttcactgtcgttcttcacgtccttgtttgagttggtggaaagatatatacatacatgctgcgtttgcaccatcacttcatgattgaaacgagtttatgcgctccgatccatttgcttcctccaaatgaggacctaaataaatcccatctatctattatttatatattattaagggatgtacgtagaaaatgaaccatcatgttctcaataatggttgtaacttatttgaagcaaaggccgaaatgaattcaattatctaaaaatcactagttctgccatctgggttgccaactacggataattattgggttaacttgattcgtgggtggagatagaggcaagctgatttgaatcatctgtctttaacatctccactagaaagagtagagatcagaaagaagcctttcacttctagaaagagggtgctaggatgcaaaatcaaccgaacacatgaatgtggataatagaggcaaagatattgggagttatctctaactctctcttcggccctgtttccgagggaatcgcctccttatttggtatagacgagctaacgatacctagttatttgctagttacgtagagttatgttaaagttatatagagaagctgctactttaattggtggatcccacttttcttagttatgtactggtttgaaatcgaacaaaaaaaaagatcataacagggattacttcttgaccctagtcatgcactggtaggatatatttgtggtagcaacgatcaaatttctatcatgtattgacaatcttgtttcagcatgacaccatacgtattgcaaatcacttcattgctaatccagagtgtgtggccttctacatagagatatgcatcaataattgttatagaggtccattagaaatgttggacaaggggctaacacacaaccggcaccagaggcggatctatctattagttagggtgggccgatggacccagctacgacccgtgtcaccctagacacccccccccggaaaaaaaccctcctaccctcttatcgtaccatcaaaattaggtataacaaggtgcgaacgtccaacagattagtctgtctcttcacaacacacgcacgctgtaaacaatgatcgagatagttatacgattgaactataaatatgatatatgttgtgttcaactactcttatcgagtgaacatttccgttctctgccccatctatattttaaagctgcgtcctcctggcacacatcatcatgcatgcataacgaggagggtagcagtgtatttagttaggattagctagagacatggcaatgggaagaaaggcctcatcctcttgaaccctggcacaatgggagcacggagataggagaggtagcacacagatggaagacataatttgataagagattaggggaacgtttggatgctaggctagctacttccactccttgccatgctaggctgtgcatttgggtaactgcttagaaaccttgctttgcttgggaaactagcacgcccggcctagttgaaaatccttgcccctctcctttgtcgacaagctatcgaactagcaactttgctttggtgggctatggcttggtgagctaacctagctgagcaagggctatagagatgagtggattctaaactctcgaggggatgtcccctcgttatttgcatgtcatccaaatagttataaaaaaattaaaaaaaattaacaagataggttagtatatgataaatcattcgacaaacatgcaagttgttccaaacgtatcctagatgtcgggctctagctaatttactttgccattttagattaatagcttccttttctagctagctagaaacagtcttgccatatatagaaatagcgcgtagggtgtaaaaaggactctaatcttatttttcgtaatgttcgttctagtttcgtggaacaactttctatttcacgaagagaaaaacgagaagaaaccatcggagacctagtggtaaggccatgatccgcagggggatcactcattcttctactagggataggtgcacgaacgacaactcacaaacgccatacatttattccaccgcctatatatacctacgtactgaacatatatatgtgggctagcagggcgtatatcccagagtcacgcagagagaaaaatatattaacaataacaataacaataacaacaagaagacatgtatcatgtagctaatgcatatatttttagtaataaaaagggtgatattacatccgcgtggctgcagctaatacattggaggtgaactactaatctgtcatttgcagtggcgcatataagtttgcgcgtgcttgctaaggacgatacatactgcagcagaagacataataacatgcagggatacaaatctccaatctccatggaatcgaatgaatgtgtgatggaaacaaaaaaagctagctagcgatcgatcgaccgggatacaacgatgaggccgggtatgatatgcatgcatgcagcaactaattaataatagatgagatgaaatgatcaaagaagaagaggaggctagctctagcagattatattgcggagatggatgaatggagatagatagatagatattattcagatcagtagtgtggcatgtggaagaagccgaagccggcggtggtggtggtgggcggcctgcggccaatgaggagcgcgtcgcgcagcatctggtcggcgcgcgcggagacggcaccctgcacagacatgaggcccgtcccgaaagccatgagctccttcggcgacatgc

SEQ ID NO: 40489 - DNA, 4232 bp, Oryza sativa
ccggatctcgatcttctgccgccccaagctcggcctcctccgcgacggcgccgccacctgcatcgccatatctatctaatcacacaaccaacttcgatcttcacaactacgactagctatagcgcaggtgtcctctccatcgatctgtggttcatatgtctatatatacagctccagcctcaggctccatcatatcgatcgcgtgagttgtcactagctttaatttgggtgtggaggagggatatgatatgatgcatatctctaaaattattacagaattaactcgctactagtgtttgcaagcttgctaatatggggtgtgggttaattaacaataatgtctgtcatgctggtaaataatgcacgctatatatgtatgagcatgcatcctgggaagggttttacgactagctagctatttactctcatgctagctagtcgcgcatcaatatattcatcatcttccaattttgtacgtttatgtacacacacatatatattgttttgcagctagctacctagctatgtccattcttttctgctgactgcgcatatatatattgagtaagtatttttatatattaggatcttgtatacaaatattattgctagacgtctgctctaaggtcgatcgatcgtatacatttctcggtacatgcatgctgtatactttagttatcactcagtacttcgcgaggtgttcgttgctgtgcacatatatacacatccagattgacgtgcattaccggttatttttatttatatctaactagcatgatggcccgcgcagattgcgcggctagcatcattatattttctctcatataatagcatatatgttttctcattatattattaaaatatattacaatgacaacgtaattttaaattttgcaataacttttcaaaactactaatgtgtaataactactctagtctgctcttctaatattttttattttttaattctgaatttcagctatttctaaattgtatttctatatggactctgctttttctttttctctgattaatgtgataatttctaggccatgagagcgaacgtggaggctcctttttattccgaattttagttggttttaaattccaatatgaactctatactctacttctaatattccttattttttaattccaaatttctattttttttcttaattgtatttctatatggactctatactctacttctaatatttcttatttttaattccgaatttcggttatttcctaattgtatttctatatggactctagtctcctcttctagtattccttattttttaattccgaatttcaactatttctaaattgtatttctatatggactctagtctcctcttctaatattccttattttttaattctgaatttcaactatttctaaattgtatttctatatggactctagtcttctcttctaatattccttattttataattccgaattttagctatttctaaattgtatttctatatggactatagtctcctcttttaatattccttatttttttaattctaaattttagctatttctaaattgtattttaatatggactctgccttttctttttctccgattaatgtgagaatttctaggtcatgagaacgaacgtggaggctcctttttttttttctgaattttagttagttttaaattcctatatggactctatactctatttctaatatttcttattttttaattccgaatttctattttttttcttaattgtatttctatatggactttatactctacttctaatattccttatttttaattcatttctattatttcctaattgtatttctatatggactctatactcctcttctaatattccttatttttaatttttaattctgaatttatattatttcctaattatatttctatatggactctatactcctcttctaatattccttattttttaattctgaatttcaactatttctaaagtgtatttctatatggactctagtctcctcttctaatattccttattttttaattctgaatttcaactatttctaagttgtatttctaaatggactctgttttttctttttctccgattaatgtgagaatttctagaccatgagagcgaacgtggaggctcctttttctattcctttaattatataatagatttatctagtacctatctatcgccagcgatcgtacactacacagatatataacaggtttaattaattaagggccagtggagcgctgttaattgcttgaacacacacatatttctctacctagctagctagctcgagggccagccattcctcctcgtgtcaaaattaatcatgcaaattaaactggccaagctgtataaaagttgaatatcagagtgcacatttaatttgacagcatttagaaattaatacaattaataaaacaatgtgctgtcctggcccgtagaagtgctagctagctaaagataagttgctgatgtggaggagagagaaaagtacgtatcatctcttcgatcatcaaggaaaatttttgatgaaactcaacaaccagctcaatgaccaaaatttttgggcacaagccaggggaaaactgaccgtactagtcacgtctatgacctagcggtggtcaagctagctaggacgatagatttagtggggctgagatatgatcgatcgatcaggtgctgtagaagagaggttgagatgaggagaggtgcatctattgatcagttaaagtagagcaacgtactacgcattctatgtacacacgacacgacttcatgaagccctccgatcaatcctacggttaataaatctccaagcctgcattttccaaacaaccgcccaccttcaatagtacttgacttctgcaaaacagccgccctcttctagtcttcctcgaccgatccatctcgccaataaacgaaagacaaagccgtggaggtagaatctcgtgccacggcttcaaaattcctgaatgaaatttcgattctatcggattcccccctccccccgatacgataatatttcggctaaaattttgaaaatttttcattattttatgaatttgacaatattttgtttaaatttgatcaaattttgttcaaaaattcaaataatttcagaccaaaattttggtatatcgcacccccgatacaaatgccgaaaatgaaatattaaaccctagtgacagctagcttgcaaaggtagcggcgacaacacgtcagcgcagacagcgatctgggccgatagcaagcctatagaggcggtgatttggagcctcgtttttaaagtctgccgttgatatcgttacttaagttttttcgaggctcactacaagaaaccagaattttcttggtagccaaaaagggtcaaagatagcatcaaaaccatcaagacaatatattttgttggccaaccgccaagtacgtaataaccaccaaatgtagagggcaaggatggattttcttaactgctaaccatgaggctagtattcggaggcaacgacgacaactcattggcggagatggcgatatagagatagaagtgacactgtgcctacgaaggcttccacactactctagtctactgtgccagtgcttataggaacactatcatatatatgaagaagatgaggatgatttgacggaaagagtaaaagggatgcatgaatcggttatataggttaactactcactagctgtttttgctttcgataattttgggctctctaaacaggacacaggacgtaagcagaaccttgagtcactgacatgtgggtcccacttagcccatatgtcattaacacagatgatcagaaaagctaattaatgcgtgaacgttcgcgggtagcgagatcagcgaacgaatccggatttccatttctagggtcacgcatgattttccttttctgttcaccccacggcctgcctgctctcacgtggaaaacgaaaacgctggtacacgtgaaatcgtgaacacaagcacatctgatgggcatatgggccttaatgatcttaatataaggtttttgcaaattgttttttaattcgttgaaatttatatgtgcaaagtttataggtacaaaatttatatgcagaaattttctatgcataaagtttatatctataaaatatctatgtataaagtttctatgtatagattttttttcgcgtataaatattcttttagaaagggattgcacactgttgcat

SEQ ID NO: 40490 - DNA, 15709 bp, Oryza sativa
tacatatgtgaagtatatagtctaggtataaatatgttggaaaaagtacacccaaggtccctcaacttgtcatcgagttacacaatcgtccctcaaccataaaaccagatatattacatacctcaacttacaaaaccgttcgctttaggtccttgagtggttttgaacccggttttatccaacgtggcggctaactcagcgtgggacccacatgtcaggatgccacgtcatcaaccctctctctccctttctcgcttttctcctttgggcaagccggccgacgggtggggtggggaggaggtcacccgggacgaggcgggagaggaggagaaccggcggcggcggcggcagctgcgacgggaggaggccaccacgcctgggtcaggcagcaaaagggcagaggaggggcgcctcctctccgccggatgtggcttgtgggcgacctcgacggcggcgggacgtggacccggctccagcggcagcgacgccagcggcgtgtagcggcttcacacgggtgaggcgacggcgggagcagagcaggaggcggccggcggagagaagcaggacgtcgggggagggcgtcagttagagcagacatggctgctccaaaacctcggccaccaagtaaaacagtatcaggttcctgcccagaagcagcacctcgctcccacgaagatgtatgtcgtaaatcgcaatttatcaagggcagcagcaattcgatctttgcatgtgtcgatctgctcgtaaatttatcttgtcattattacatgttcaaattgactaaacaaactgtaacacttcttacatagaggggccaaaaaagaaattagaggcatggcatcttcaagggcagcaggcagcccatcttcttctgtgtctggagggataaaaacatcttttataactggaattggaccttgtacatcatactgtctaaacagggagcctggaatcggagctgttgcacagagaaaaagacaactgaggagcaacataaattatactcgctcacaattcgcagttcaagcaaccaataattcagtaagtttcaagcgttcaaaacagtaaccttctagtgctgccagaagcgcactcttaataagctccagaactcttcagaacctgaatccattcaaacactacaatatcatttctgtaaataaatcatataagcacgaactgaggggactgtttgaagatgcaatgcaactaaaatttaatcatcgaatgctcatcagcttcgagactcatacctgcagatactatcaaataacagcatacaaattcgagctacacgatttcattttctctctcctttctctaacagcatacaagctcgacaacaacctcctccctcgcctagccgcgcccccaagtcccaaccatgatgccgcccgcgggctgctcaccctaagccgcctcgtcgctagaagaccctagccccgccacatagaggcaaagctcgctccgtctttactcgccaccaaatcacatcggagcgcaaccgcctccactggtctcaatcagagcggcagtcacgccgggccaatccgggaatgcccgagcgtcgtcgcccctatcgcaagtggccactcgtcacaggactcgcatcgttgagcttcgctccgaccgtcctcctccatcctccgtcgcccctgcgccaaccgccgccacggcgcccgcctccgcgcctaccgccgcggcgcctgcttgctcccggcctgccggcgccgcgtcgctccttctccagcatcgccggccggccgtcggacctcctctccaccaccggacggcctgcccagagagaagagtgagatagagattagagagaggaagggagagggaagacagaccttgctgacgtggcaggggagagagaccttgctgatgtggcattctgacatgtggggcccacgtgggtcccacgctgactcagcctccacgtcatacaaaactggggtcaaaaccgccgagggacctagtttgtagtggttttgtaagttggaggatgcgttgtatccgattttgcagttaggggacgattttgtaactcgatgacaagctgagggaccttcggtgtactttttcctaaatatgttttgggttgatcaagacattcttgggctaaggcatggtacaaagagaaaaggcaggttaaagcccatgggctggcttggctagcttgcagtgttgcacgcgcgtcagaaaccaggtgcggatgttggaacgagaggctgttggaacgttcgctgaccgcgaatatccgcatactagacgccccctcagatgatccctttcatgtaaaacatactcacgaatagacggtgttaaatgtgaattagttcatagggaggacccacgcatgtcatgctagcactttccgtggcctaaatatttcaggccttcaacgtacgggaggcccaattaactggtcacccatctatctcattggacggatgggccagaacttcggcggcccataggcccatattcctttgtccacttactggaaatttggagctgatgagtaaaactcaatttgtcgctgagttcgaaattcgtccctcgagtgcaaaacggatacaacgcatccttcaacttacaaaaccgtgtaaacaaggtcccttggcagtattagagcaggtacaatagcgggcaataagccagttataaacatattttaaagagataaataaagagagagaagagcagtgggctacagatctgtagccagctgcagcacggactccaagacataatgtgtgtatgataggtgggaccagatattatagtatagtaagcaaatattatataaattggctatagataatttggagctagtagttggctatactattgaacttgctcttatgcccggttttggctgacgtggcgtctatgtggctccattaactaggtattcatctcacgtggtattgacgtggcgcttacgtggcaattcaatcttaaaaaataaaaatcatgggacccacgtatcagctacacacatgtcagcggtggctggagcaggccagcggagctaagcggcggtggctggagcaggccgggacaggcgaggggcaaggggcgacggcaccgcggcgccgaggggtgacgggcggagagaggggcggcgggcggagcagtggagagtggcggcgagctcctgggagatggcgacgggatgaggccgagaggacgccaacggcgaggtggagcacgcacctcaagaagcgggtgttgccggagcagaagaagggtgggggcaagagcaagaagaagacgacctggaccgacgtgctcgtcccgtccccctcgccgttgtcgtcctccaccgcgcgacggccaactgctccaacggcaactcagccggggcgcagagcaacacaagcaaggaggaggaggcggacaagatcgagatccctatgctcgacccctgcagcttctcatcaccgacgcaaccactgctgccgttacggccatggcgccgcctatcagcaccagaacttggtatttccctgaagaatctcgcatattgtttgctgctgctgctaccagggcagcgacgagcagtgccaagcaagacggcagcgaccgagtaaccattacagtatcaagatctactgcttgctcaagctaaaatcatcgcatccagaaagaatcaagaattaattggccagaatcaagaataatgacgcgggctgtcgtcctcgtgagcggcctcatctcggtcatctttagcgcccagcgccgccccgccagcccctgggcagcccactgccgcttgtggttccggttgcgctccacctcccgaagcgcttcctcgtcctgttcgcaatccaagaccacgaaggtgcctgacggtgacgacgtgtcgcctgtgcgtgacattgctggtcgccgataggtacacgccgctattcgccgacgtgctgtggtgggaggcgttctcggtggcggtggcggtcgccgacgtgcccagactgagggagtcgtcggcgccggaggtggagcgcctctgcggcggcgtgcggctggtgaagagagggggagaggaaagaagggaggcgaggttgacaggtggggcccacgtgggccccaccatttttatattttttgtgtagctgacatgtggggccactatttttattatttttccggaatcgaattgccacgtaagttccacgtcaaatgccacgtgggacaaagaccaagtcaaaccggccacgttggcgccacgttagccaaaaccgcatttcaaaccaccgagggacctcgtttgcaccgattttgatagagcagggaccggttgtatctggtttttgagttgaaggacgaaaatcggattcggtgtaaagttaagggacctcgtatgaacttattccgtaaaactttggtgggataatgttggtttactctcaacctgtgttaggaggcctgttcaccttgttacttctccttttcaagggggaaaaaagaactacaggctacactactagtactaccgaaaactcaattcatccattatgggatatccccttatttttacatgtcacttaaaaagccatcaaatttttttttaaaaaataataggatagatcaatatgtgatatatcacttcacaaacatgcatattaaaattcaacttatacaagtaggaataaaaataacgaatttgacaattaatagaacgcgtaattcatggtcaaatttgttatttttgttttgaattgtataagtcgaattttaatttgcaagtttgcgaaaagatatatcatatattgatctatcttaatatttttttctaaattttttgataactttttaaacaccatgcataaaacgagagaatgtcccctcgagagataaaaatccactccctactactactctactagtgcaagtactaaatatgccttggtgctccctagttagttgctactcttttctggagtatctaacgatttttttattatatgacgcacccacacacacatcactactcactccaccctaaaaaagctaacctagtaggaaatgtgacctcttctggtacaactaatgtggatagccctttgtttagattcgttatactaggaggggtcatatctcctcttagtttgatttttttttaaaaagaacggagcgcacccacacattcttaaatgcatcccgtaatgtacgtttaaatagacggaaactagtggtatttcttcgatcttcgagcatattaaagaatgaataattcatgtattaattttgaattatctactttaggtcccgttcttttctccaacaagagttggataaagattaagattttcgtggcatgcttttcaaattgctaaataatgtgttttgtgcgaaaactttctatatgaaagttgctctaaaatatcatattaattaatcttttttctagtttgttataattaaaatccaatcaatcatacgttaataccacctcgttttgtgcaaaaaaaaatttaatctttatcttcatcttcaaaagaaaagaaagcagtattgcaataggataattaactaggcatcgatcactgatcattttcagatgggtctatgtgggaatcccccccctccccaatcgaaacgaaacggcagagagttatatatggactagaaggaagtaaaatatacagtgtaaatcattctatatatattcttgttatcaagagtaaaattttacccttaaatttaatcatgcgtaaaaaaattgagagtaaaagttttctctagctagatgacatggatatagttttcagatttttacattatatatatatgagttttgctacattttttttcaagaagaatcgcaagcggatcaacactagtatgacaaggaaagctttgttagtgcattgcatgtgtgcactaacatttcgaactatagtaaaggataaatatcacttggagattgcaaccgcgtgaaatttttttctatgtcgtccactagtatatagctaaccgcatgctctttaattcagcatagtgcatttttgcccctcccaaacaagaaaattagttttggatcccctggccctgcaatgaagtagtaacaacctccatcttaaaaatcgtaagcagtggcaagcactattaaaaaggattttcatgtgtaggtcccttttacttttactaaggaggaaaaaaaatacccgcttataaaaatgtgcgagaggtgtttgatcaaggcccacattttaaattttcacaagtaggtctcttaacagatccgtctacaataataaattattttcccagacgagcatcttaagaggtttgtatgtgaaaattgaggcacgactggccggctccattccccattatttattttctttcttttctccttatcaatccatttcacttcttctctctcccccttcacttctccttctcttctcctctcttccccatcgagcaatgacaggagcattggtgccaggagcggctaactatgggagcgatcgctatagaggttggcggcgactgtggaggccgacagcggtgacgacgacaacagagataggtggtggcacatctccctcttcgatgacgggaggggaagaaccatcgaggagggccctagccatggtggatctgtctcctgctagcccgaaggcggcaaacccacgatggcatttcgtggatctggtagcggcgacacctctacccctctgatggcgggagaggaagatcagtcgagagggctccagccatggcggatccgtctcctggtggccggaggcggcggatccacggcaccatcgggcacaagggcagtgtcaatgagcgcgcgatgaagacctcgacctcgacagcatgacgaggacctcaaccacgcaacaacaacatcgacattggaccacgcgatggcagcaggctgttgtggcggtgctcgatgatggcggtagccttacggggaccttggctagggttttggatttgattttttatttttatttttaaaaaaaattgcaatccggtgttcttgcttggtcggttgtaaaaatcggtttttccaagcagcttccttaggacgtccatatgtgaaaatcgtgtttgcgtgtggttgtgacgtctgcatgtgaaaatgccgattttcacaaacacatgtaggcagggggtgctccaccttccagcgaaaacgagatatatatacgatgataaggtcatatggcatgttgtctgccattggggacaaatcgatctagattagatagctagtgtgatcgacatgcgcagccagtatgcatgtgtgatatgatagatcctaacgaaattgcgagcggtgatttgaaaacgtggataagcccatccaattcaatcaattgtctagctagttagttagtacgatatcgtcatcaatggcaatgcctgcctgcgtttgttattatacacgctaattatataaccaatcggcaaggccacttggaattaattaaactctgtagtgtattgcgcctgccttgagctaacatcgacgtgatcttttctctgcaagttggatggatatgaatgatgatggatatgcgttcgtcagtgacgtgatcgatcgaaaaacaatcatgcgcttgcattgcttgcttgcgtagccctcctccatgatcaatgggacggtcgttgtaatgaagaccctacttacccagtaattatattagtggctaaagtgcatgtcgtctctactgacgccttgtttcttgttgaaccagtgtctgcctgaattaatcctttgtgggtgttaagtgtaacctgaatgatcgatgcaagcctaacccatccatccatccatcatgatatgcctgatggttgattcttcagctctgctcacttttgattagctacttcgtgcgtgcatggcaccacaataaagtaatctttaagtgcttaatttgatcagcactcacaggcattccgaaattagcatttaggataggcccacatctacctgtaatatatgtacctgcagctccagttttgctcctcaattgtgacaaatcaattatatatattgtcgattagctcagtccagtctctactactagctagctagttactgtcagacacttattaactattattaatcgcttaattttctgcctagaaaaaggtgaacctgaattatgcttgggaatgaatatactgtacttttcttttgccatgatcagaccataggccactgatgcatcaaggtgtaagattatatggaacaagaaagcaaatgcagggctagcctagctatatggagtatgttgtttgactttgcactgaaagctgtgtcaatgctgcctatcatggatgcatcttatagtatgttccaagtgcacttctactttcactaagacatctagagacacaagtgtcagctatgtactgaatcctcaagacgtcagctttttgttcactaatgagaaatctctactatttaaaagggagtcgtcatccttttatctcctcctctcaccacccgcacacatcttaatttctacggttttgtatatgtaaccaccgcctccagtgctttatcctcagtccacttttctagtcatcttaatccaccttcctagcctatattatatggatctcatccgttgcaatgcacggacatattactagttataaacagatgaaatagttaactagctttttcacagcaaacaacgatgggacgctccttcgaagtttagaaccatttcctcccttttatcctcatgcatgcataatatactagtttcagaattgcggtatacactatatcgaacttttctttcttgctactccctctgttctatattataggttactttgatttattttgccaaacttttataagtttgactaatagaaaaatatagtaacatttcaatataaaacaaacatattattaaaatatatccaatattatatttgatgaaactaattcgatgttgtaaatattgctattttttttataaattcgatcaagtctaaataagttcaagtgggtaaaagttaaaacgacttataatatgaaacggagggaatactaattaacaagcatctatctatatctaaaatacatccaaactactaacacatattgtgaacaacaaaacaaggaaccttaaatcccctgtatgatttcagtgcgcgtgtcactagatccatatgttttttctttcttccttttggaatatatgatgagagaagatttgaccctaagcttaagctaagaaggacagagggtagtagtaatacttttgcaaccatctttccccacagaaagcgactttatggatgttgtgataaaaagaagaaacaggaaggccgcaagattcttgtgcagtgcatatatcatatccctatcccatgtcaagctagacgtagctatcgaattggaggccggcaggaaggagaagaaaagaaaaaattgcaagagattgcaagcagcagctagcattgtgggggtcagaaaagaagaaagtgaggatcaatatcagatgagatgaggctgggcatgcgtgaggttagctatcagcacgctagaagacaagacaacagcactaaagcaagcaagctagctacatggtgatgaagcactatctagctagttggagtaaactaatcatcaggataatgctaggtaatatgagagaattacagcaaattaggcaagttgcacaaaggtaccaagctgctgctggctccttatcacgtacggcgatatctatatgctctaccactttaatcttggcaccttctagctagctagctcttcatcttgttggatcgtcatcgatatgatcgatctcctttttaaaggccggccggccggagagaaagaaagaaagaaaagaaaagaaaagaataaaaaccaggtggcttatcagaagctatctagcttggaagcagttgaattggggcctctcttttcctctccaacttgcaggggcagtggcagtggctgaccttcagctagctagctaatacacatcacccaattccctccatctactatctatctcgctcattcaggccgactacagttgagatggaatttggaaaaggaacacgtacctgtccggcctctgatcttctcttgcttgtatagctaatcgccggccgggtggcaacagtagctatttagatagctgtcctcctaatcttgttgttctgtatatagcacgtagtacgcagcatcttggattgatatagtacgtatcagttgcaatcgctccacagttttcaggtaggaggcaatatgcatgttgctcatgcatctgcatgtacagacacaattattaagattcacgcggcgggcgggtatcaattcaatcagcctggctttgcatctcatgaatgcatttattcagattctgtgtaagcaagctatttgcgaaattcagattctctactgccctaatatgcttgcttcgcgcgcgtgcgaaaagaataacgatgatcatctgttaattccactcggtaccataccaagccaccataaaattattatctgatatgtatatatacaaaatggtacgtgaagcataatacagtattcagttcagtgtataacatgatacatatgaatttgccagaaatgaagaaacgtatgcacgtgcacgtggcgcgctgatcaaaatatatcagccagcagccgtctgttgcacttgcacgtatatgtgcatatactacaagaggcagtacaagcatgaacacacacacattcatatggatgtgtacgcagctagctatagctagcagctgttacatatatatatatttatatagtactgatcagagattgagatgcaactgcaagttgcgctatagaacgagttactaacatgtatatattaattcctccgtcgatccctatatgcaagctagtaattacagtaattagcagctgtagcaaggatgtaacaattgagatgagctgagtactcccacatgattaggaggcatcgatcgatcgagttgatgtagtcgtcatcgtcttggcggctgatggatgatatatactatccccagagaggtagcgaataatccgagcagaagaaggcgtcatcgatatcccagagcggcgaggcgggcatcggcggcggagcgacgacgttggtgctgctgctccagcagtcgacgtcgacgatgatgtcgtcgttccagagaggatgaaggaacagttggtgctggtcctcatgatgttgggcctgcaggctgccactggccgacgactcatcctctggctgcggctgctgctgcaggttgctgttgctgttggaggaggacgaagaggaggaggagttgcggtcgtcgtcgtcgtcgttgtcgttgtggtggtcgtcggactgctgctgcttttgctgtttgagcttgagcttgcgcaggtgggtgcgccagtagttcttgatctcgttgtcggtgcggccaggaatgctcttggcgatgcgagaccacctgttgccgagcttggcgtggagctgcaccaccatcctctcctcctcggggctcatcctccctcgcttcagccctggatgcaggtagttcacccaccggagacggcagctcttcccgctgcgctgcaaacctgcatcagccacacaccacccatacacacgacggacgatccaacaaccagcgttgatcgcacgcatacattatatttatgtcagttactatcatcaaatctactatgtacggcatatgcatgcatccatccatctgatcgacatcatcaacaattaatcgatagattagatgcacgcacgcatatgctcatcacccgccgccgcgcaaacctgacacctttgctaagaaatcccaccgccgttcgcccagcagccgcacgaaccaaaccaactgcacgtcctcctgctccgtccacgggccctttctcattattcctcctcctcctgctgctgctgctttgatgccgatgagagggtcctcaccctgtgggcgctgatgatgacccagctgcactactgaacaagaagaagacgaagacgacgatgatgatgcagaaaaagaatgccgtccctgcttcttgccggccaccaccatctatacagatcgatcgatcactatgcaattagctactgctcgattgaattgaacaagcaagctagtataatacaattagctagctactataggaagatacctgcactctccttttatagtcgtcgtgcgcctctctgcagcagcagtactactccgtgcagtgcgagtgcgtggcacacctagctagctagtaccacctactccagcttacttgcctttccaatccatcatcatccgtcggcatctagctagctagtagtacgtaccccctccgtccttaaaaaaacagtcaacgtcatacatactagtgcaacaaatctggacatacaaatgtttacatcctaatatgaggttagttttgacagaggaagtagtactaacagatgtcgcatcccatactaaattaacttattttgagatagagaaaatacttcatatttcctagccatcgatcgatacatttaagggaaagtattttcatccctctcaccatatcctcatgtcaccttaaaataatcaataaaaaatagctaaatagctgacgatagatttggggagccaaaatcttacaaattactaaccttgatacttgctttatgattcatgctccggcgatcccagttctcctcctcaagctctgacaacaccttcttccctagctccgccagcttcagcaaccccaacgaaggtagaagagttaaggtttagggtcccgtgttagggtgagggttggatgaggagagggggggctaggggaagaggagggagatcactgagcttagagggatgacgcgggccgacggtgggcggtggacacgggcagatgatgaggtggtggcggcggcactggagccatggggatggaggagggtgatgggccggtgttggtggcaagggcaaagctagtttatgggcagctgttgtgatggatccgatgacggggagacaccagcttgagtaggagagggaggaaagggagggaggtaagggggagaagccagccggtggggctcgccgcgccgttgacgccttcccgcaagccattgaggctaggtggcggcagcggcatcaagtactcaagctcgtgtcgtggggccgctaagggggagaggagatgaggaatggtaggttatgtttcattaggtaggtgcacacaaatattaaagcaatatgacggttgaaaaattgtgagattttttaggggttctttttgtcaaatactacatagacagtccaaaaaagggtgcatctaaaattatacccatagttttttttaaaaaaaaattgtcaaacataattacaatataacttgcatgtaattatagtataattacaaggtaattaaagtgtaatttcaattcaaatcagaaaatgttcattccttagttggtccaggcgtgtggtgcgtgaaatatgtgtgaaatcgataaaaactatcgatggtttttagcttttccatcaaaataatttaaaaagaattgagaagatagattagtatgagacatatcactccgtacacatgtaactttaaattttttaaattttttatgactatttagatgacatgatggaaatatgttttcagtcaaaaaaaaaagaatggacaagataaattaacgagacatatatatatatgactctacgtacaaatatatagttcaatttttaaaaattgtttttatgacaaaaaagcgagggatatctctcgatgaatgaaaatccatctcctaaacataatactatatcagtggaagctgacgcaagatacacaaacatatgatatgtctctccatgcgtgcccatctgtcatatatactccaccattacattgatcggagtcgtcacaacctttttttttttttgacaaagcgtcgtcacaattatattcactgcgatagatgtcactatcgtgccctacgacgtcatatatatgtggacattttaaagatttaattaattagcaccatccatcatcgtcagtgatggccgatttggattagaggaccgtctatattctgatattcaccgttaattaaaatgatgaaaagaatagtatacatgaatcatcgatgatgattacttcctccgttttctaatatatgacgctattaatttttaacattattcaaaaggttctataaacacaaaatataagttatgcttaaaaaaaacttttagataaattttactagaggatactaaaatttgatgtaattttacagtatgagaaaatgtccgttcaaggaagcccaataagcagcccaggaggggagacctttagggccagtgggccggtaggttgggccaaaagactagtattacccttataaacatacatgtcacaaagacggttgtgtaaactcactaacagtaccttagagttagggatgaaaacggagcggatagtttccgtccgctccggacaaaaacggatacggatacctttcggatcggataattctcggatatttcggatacggatacgaatacggatattttctcccggatacgaatacgaatataatatcagggtttccgtcggatacggataataattcggatatccggtgaacagtgctattcggatatccgcaggacccatgagacataccccatttctttctaactctataaccttcaatatacatttatagattttaatagtagtttatctcttaacactagtccatactattaatattatttaaattttaaaaaatatttataaattatacctcattttatataaaatgagctaattatatatgttgatatttatttatattagaagttgagttggttttcgtgttccgagaaaaatttgtttccgtattcgtgtccgatcatattcgattcttattcgtattcgagataatccgtatttgtttccgtattcgagctatccgtattcgttttcgtatccggtaaaaaatatgaaaatgaatatggtatgagcattatccgtccgtatccgctccgttttcatccctacttagagttctaaacccagatatgcaagctataaataaactcttaagggttatgtaataggggatacaattttggagagattattacatttaccatttaccttttacacataatcaagtgaaacttaccctttggtaaaagtgtttgtcaatcgacaacaactgtcaagcataattatatttattttgaaaaaagaagtttatgctcgtttagtaaataaatactactagtacacttgtttggaattaagcatgcatacattatagtagaatagtagtgtcgcttactcgctgtaacctgcagataagggaattttttttatttttaattttttttattaaaagttttacaaaaataattttctatttcgaaaattgacagaagtagtcgcctgccgccctctgggagggtgatttctcccagagggcggcgaatgtgacgtggcagacggccgttcgctctcgggcgacggccatcaacgaaatttgcaggcggcccccttgccgccctgggggagggcaattttgcattgtgtggggggccgcctgcaaatgggcggcggggggcctgggaatttgtaggcggcccccttgctcgctctgggggagggcgatttatgtctcccccctatatagccccgtcccccctctct

SEQ ID NO: 40491 - DNA, 13244 bp, Oryza sativa
  unsure (1)..(13244): unsure at all n locations
agcacagaatataatagtatgaattgagacatagatagtagtgttaattgtaagatgtagtttagtttgatctggagaacgtaacctacttttagaattttggagaacaatattgtagagaatgtaacttagggtgtagtacagaaatgcgaggttaacgtaattattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgttgcttggagacggtatgtggaaatggcttttgaacggtcatggcccctcgttatatttgtgtcggtacaagagaaatatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccaatgaggaaggtgatgtaatggccactgattgggcaaatgaggacttctctggacttgttatatcagagggtgatcatgtaccctgggagtataaggagaacgaggtaattaagggtgctaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcataaaagggtaaatggaatgattattggaaagttagcattgtgaccgagcaccaatgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtctattagccaccattgcccagaggaataataatacttactatgacctacatacatttacatcggttgatgatcgaataaagagtgtgctgcaaagagcctttttctcattgggtgcttgcatcaatgcttttgtgcattgtcgacctgttctatgcatagatggaacttttttgacaggtaaataccgaggtcagatattgacagcaattgggtgtgatgggaacaaccaggttctacctatggcttttgcatttgtagagagtgggaacactgaaagctggtactggttcctagagagagtgcacattgcagtggtgcgtatgaggcccaacgtttgccttatacatgattgtcatgcgggtatgttgcgggctattgactacttgcagaacggttgggatgagaagggacttccagctaagtggcctaatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagacgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgattgatctcggtatggcataatgacaaccaatttggcagatgtgtacaactgggtaatgcgaggagttcgggtacttccattggttgctattgttgaattcatccttcacggcacgcaagcctactttagggatcgatacaagaaaattggtccgtccatggccgatacaacatagtgtttggcaacgtagtgacaaagtacatggaagataaaatcaaaaaggcacggagacatagagttgttgctcaaggcacacaagtgcatcggtatgaaataatttgtgttgataggagcaggcgtggtatctatcgcaagcaagccatgcaggaatgtgtcttgaaggcggatggtggatgtacctgcagttgtatgaagccaaagcttcatcaacttccttgctcacacgttcttgctactgccggtgattgtggcatatctcccaatgtgtacgtctcaaattatttcaggaaagaagcaatctttcatacatggagtgaggagatatatgggttcgggatctcaggatcttacacaacgctgagtggcaaagttttttatattccagatccatctaagttaagggtgaaaaagggttgacgccaaactagacgcatcagaaatgatatggatgagtcagaagcaggtgggaggactttacgctgcagcaagtgtgatctgcgtggccatacttacaagaaatgcccgaagaatgcagaagttccaagcggcgcggatgctagtccatctggacaggcaagtgatggaaggcgaccacttggtgaaggaacaacaagcaggcgcgcaaggccaaggcgtcgtcttgcagcaggcgattccatggtgtaacaatgctatcgatttaggaaataaaatgctattgtgatgtgatgagtgttcggactaaatacttctatcgtgtaatttcaattgaatgttgttgtaatgagtacctctgactattgttgtactagtagtattgtgaattattcggtgttgtatcataatgttatcgtgatgagtgttcggactaagtactcatatcgtgtaactgcagttattattgtaatcagaaatattccgtattgtgacacttttgtttgtttgtactcttgtttaatatgtgttagtaatttacttatgaacatttattacttatgttgaactaattatttttatgtttctgatcgatctattggatgtaggtatggcgtacgacacaccggcgctgttcaaccgtgggattgacaggagccactgctcgttcctgtcatcagtcgagggtgcacagctcggcaccttccgtccacgcacgtcgcgcgagtggttgcgtgtcgacccccgtcacattccttggaacgcgtatgttcacatttcaactcaactttgctttgtcttgtacttatgtttaaagtttgctctatgcaggttgcgtgcggcaggccttctaccaactttgtaggcttgttgaggcggcggcggacgaccgtgacccagcgaagcggtgggatgcagaccggtcactccttgccactctggtagaccgctggagacctgagacgcacacgttccaccttccctgtgggaagatggctccgacactgcaggacgtgtcgtacctgctcgggctaccactggcaggagccccagttggtcccgtggacggtgtttttgggtggaaggaggatatcaccgcgcgcttcgagcacgtgatgcgccttccacacctaggaccggccgacacccttccccctaactctaccgtcgggcctagcaaggcttggttgcttcagttcactgtaagtaaataacttgttattatcatacatgcttattttgcgatcaacagattgttttgtactaacatttcattcttaattgtagacggaccttctgcaccctgacgctgatgattactcggtccgacgctcccttgaggcgtacctgttgtggttgttcgggtgggtgatgttcactagcacccacgggcacgctgtggactgccggctggtccactacgcacggtccatcgcggatgctcagccacaggacgtgccgcagtggagctagggttctgccgtgctagtagccatgtaccgtgccctctgtgaggcgtgcacgaagaccgacgcgggagcgatcttcgctggttgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcaatcgtcttctttttttatcatcacataacatgtctaattccgatcatgtttattgcagcgtcgttacgctcacgtccaggtgagacgaggttacccggactttgtgtttgagtttgaccgtctccagccgagcgacgtcatctgggagccgtacacagaagaggccgtcgctgcgagagcaccgctaggactttcgtccttgtgcacatgcgaccaggcttactggctccccatcctgccgatggtgttcgacattttcgtcgagcctcactgcccgcagtgtgtgatgagacagttcggactgaggcaggtgtttccgggcaacgtgcagccgaccgtcctccctgccgaccactcgtgagttcggatggttcatttcaaaatttttatgctaattacttcatcgagccatataatttacctctcttcacaagttgactcgacagggacagctagcaggcgcactttgggctccacgtgtacaacagtacgttgacgactgggtgttagctacagaggaggtgatcaacgagctcttcccacacacagaggagaactaccgtgactaccttcgccggtaccttcctcgcactcgtgcgtgtgtgaccttcactccagacgccccagagccgcacgttgccgctgtcacggacgcgtatcccatgcaccatgaccgagactacttcgtgggggtacgtcgaatttgtattagttcttacaattatttcaattatcttgcataatataggacaattactgaattttttatttccatcttgcataggccgatgccgcacgagatatcagtgccgatatcaccgcagtccaagtgaggttgaacagaggtttgcacttgactgacgttgagcagaggatgaccttcgaccggatgcaggagaagatgcgtgcggtcatgcgcgtcttctcctgtcgcagcgccgtggacattgtacctccagctggtccagtacaaccacggcctcgcgcacctaccgtcggagcagaacctcgacctatggcaccggtttcgtacagtactgctcagcccagaggtttcttaagttttgtttctgtttttgtacgaaaacatcaccccgtcgtaacttgatgttccatcctcgcaggacctcgtttgccttcgagcgcccctagcgtcggagcagtgcgacctacagcaccggtttcgcacggtacagctcagcccagaggttagttcatttttgtttcagcttttgcacgaatacgtcaccacgttttaactgcacgtttcatcatcgcaggacctcgtctgccttcgagcgcgttcgcaggcacgactggcgcttccgcgagctctgcaggggcattcgccagcacttccggcgcgttcgccacctcttcgggcgcgttcgccagctcttcctctcacggagcgtcgatccctcgcccacatggtactttaatttttattaatactattaaatacctgtatgaaactgatggtccttgtccagcaggatttgcagccgggatcttgggtactggtgcctcttcgtctcacgccggtaggtctggtcctactagccatttctatgacgacgacttgcacggtgcgcaccaccacgacgtactaggctcctctcagcttggaggagctccagaggtgacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcacacctttcctggatcataatcacccccttataaacaaggcatggactccccagcgacccccgtggacttctcgccacttctcagtctggcgcactataatgaatcacgctacacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcgatcttcaattaatcttcttgaatacttccggcgcactcacgaaccttcgcaacgacggaaacgacaagctaacacgcaaaacaaagaaaaagactaataaaaaccaaataaacagtacatataaagtaaacaaacatgtagatcctgattttagatgaatttagcaacttgaaccactcaaaaccgagttacgatgatttagttatgaatttccgaagatttaatctattagaaaaacaggaaaaagaaaaaaacaatgatgacgtcatgatgatgacctcatcaatggccggaccaagatggcgacctcgccggagattggatggtcggctgcgactttggaggacatgaacacgtagaggacgacgagacgaacccaacggtacccaccctcgaaccaaacgacgaacgacgacggccggcgacgaggtctagcggcggcgcggcttcggtcgacggcggcgacggggctgcggtggtcggcggcttcggggagatagcggccgagcttgcccacacctcggcgcaccttacggcgatgacggcgaccggcggcgacgacggaggcggcggcgcgacgcggatggagctcggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgatttgcaccgatttttgggggtaaagatagaggaggataagaggaatatttcccctcaactaaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaatttttaaaaatacttcctatgctcaaataattccaagaaaaatcttgaacatacttggacacccaaagtatttaacaatattaaaaacagaccatttaatgattaatttaatatgtgggtaattactgaaatgctctttgtatgattaaaaattaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacaacgtactaggctcctctcagcttggaggagctccagaggtgcacactcaggagcagccagaggtcacacctgtacaggcaggacgggttggccgtgccataccaccggaccgactcacgtactcccaggggcacgttagggcgcagggtaggagggacaggggtaagaggtctcgtcagtagtgttctacctcttcagtccttatgtgaccgtttcttttggcttacaaacttgtaaagcaatactacttttgctattactactgcagtactacttgtgtttctctcgcctacatagttcttttcattcatatggtgctagaacaacttatgctcacgacaacacactttcggcgcttcacggtagtgtcagatccagtagcgcgcacagtccagcacggcacacatgaaaagcggcagctcgagtagtcactatcaactttcggcgctgcctgctgacataaagtgaatcacgcccgcgcgtgctcgtcttgtcacatctaatgaataatgtatctcattgagtgcacatatattgcactgaaaacgatgctatataattgacaatctgaaggcaacctcttcatatcttctttccaactagcacacaactaacgagaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgtgcgaactttgatcaggtatgattcatctattcaaagttcaaatggataaaaaaactaacttcttcgtacacaattgtaacatcttacgcagacatatcgtccaatgtgcaacttcatcgagtgggtagacatggagaacccacaaaacgacggaacacgtgcatacccacgtagtgaaacaagatcggactacctaaggcggaaggatgagcatgaatgtcgaattgctgctgaggctttagaatggcaggtaaatcccctaggactccccacgtggcgtgagcgtccagagtgtcgttgtggtgaccgttgtcaggtcataaggtccgtaaggcaccgaactcgaggacaaaggtgtttcatgtgtccaaacattgtcgacgatgatttcgtggtaattacaactattcttttcatcactcctcagtactatcattaacttaactatcccaaaatggatgtacataagaggatgtaaggaaatgtcaattcgtacaatggattgacaaagtccgagttacttccagtggcgggccgataacgcaacctgaaccgaccacatagttcattcatgcttggatggagtacgaacatcgggtggaaattgcaagcttagattggaggaacaatccattagggttacctaaatggtccgagcgtccaaagtgtgggtgcagagatcgctgccaggtggctacatcctttgctgaacaaacatttggaaggagatattttgtcttccccaatgtagacaacgatttcgttgtatgtctaaccgtttccaaaatccgctatgatttgcacaaaatttctacccaaactgaataacattactattttttcagggcaatccaaggatgtgtggatttactcgatagatcgacaatgtcactccatcatatcatggccagaagataacagagtcagaaacacaagtagagtatcaacgattgaaggaccacgagaatgcaatgcattctgaccgacctagaaggggccgataggttaccgcaggctagattcgtcgggatcaacaaatttgtaccgtgtatcgatggcacttcttatctatcttatcattacaatgtttaattatggtggtgaatttttgtatgcgtaagactaagggcctatttggattgctaccaaaaacatgccctactaatattttggtaatttgaatagtacttgtgtttgatttggattgaagcctattcattggtaatacctaatctagatttgggatcatgtagaacattcttcactacaattttacattttggctctattttggtagcaaaccaaatatgatcaaatgcaattttaccttaccaaagatttggcagtgccaaaacttgcctatattttggcactaccaaaaaatttgtagggtaacaattcaaataggccctaaaaaaataataaaattgtattttaccaatcttggagattttaatcttgtatagttttcaatacaaaaagatttgataactattgatattaataaaaaaaaatatatttctcaaataaagcatagtataaaatcgccctcccccagggtggcaagggggccgcgtgcaattttcaatacaaaaagatttgataactattgatattaataaaaaaaatatatttctcaaataaagcatagtataaaatcgccctcccccagggcggcaagggggccgcgtgcaattttcaatacaaaaagatttgataactattgatattaataaaaaaatatatttctcaaataaagcatagtataaaatcgccctcccccagggcagcaagggggccgcgtgcaaaattccagtcccccgccacccatttacaggcggccccccgcacagtgtaaaatcgccctagcggagggcggcaagggggccgcttgcaaatttcgttgacggccgtcgcccgagagcgaacggccgtctgccacgtcacatttgccgccctctgggagggcgatttttcccagagggtggcgggcgactacttatgtcaattttcaaaattgaaaattatttttgtaaaacttttaataaaaaaaattcctgatagggctaggtagcggttggttaatgtggtgaggataaattagcccagatgcatggttgatgggctccgcggcccgctaaaagagagggacacacatgatgggaagttagttgaccatccagttgtcaagtttgactcggattgatgactggacccactggtctgcatggagtatctgtagtactagggagtagtagtaggtgtggactaagtgtagtatgtttgaccggttgtgccgcccgtacatatgcatgtgtagtgatgggagcgcgtggagtggaattgactagtactagtatagtagacggacggccattgatgcatgtggcttgtgtggtcgtgatgcgtcatgtgaactgctgactaccttcttcacacttgtttttactcccaaaatattccggctatcgaacgcgtttgagcgacggagagagttgcatatagagagagagagagagagaatgatggattagctagctagcttgttcctccgtcggctcgggcggtcctcttcgaattggatcttcttcttctactcacatacacacacactcgatcttgtgcctctgcagcacacggtagtgttggttgatggcaaatcctagtcgtcatagcaggtcaggtgatggtaatggttgggctagccccgagcggacgatggtgtggaggacggagctcaagaagaagcagatgaagcaggttgtggtgggcgtggtgtactacctgtgccggcaagacgggcagctggatcacccccatttcgtccacgtccacgtcccctccgactccgactccgatcatccgcggccgcgcctccacctccgcgacttcatcgcccgcctcagcgacctccgcggcgccgccatgcccgccgcctactcctggtccgccaagaccacctacaggaggaacgccggctacgtctggcaagacctcaccgccgacgacctcatccccgcgccatcaaccaaccatgaggagtatgtcctcaagggctccccgctgctccaccataactccaatacgcccccgcagcacaggaggtgcatgacatcctttgacctcgccgactatcaccgcaccaccgaccctgtccctgtcccggcggcggcgcagcagtccttaattggcattgatgagatatcacctccaccgtcttcaagcagccccgacgacaccaccacccagcttgttaccctgaagcagaagcaacaggaggaggatggctgcacgccccagcaacaagcggcgacgacaccggcagggcggatgcggacgtcggcgatgctgatgaagctcatctcgtgcggcgcctcctccatcaaggagctgcagggccaagcacaatcacaacgctgccgtgctactgcttggcataacaacaagccggacatcatggaccaccgtgactacttcagtggnnnnnnnnnnnnnnnnnnnnnnnnnnnnnnnnnnn

SEQ ID NO: 40492 - DNA, 1031 bp, Oryza sativa
gcgtcttttataacgctgatccaactacttctcatccatcaatccttacaatcagcttatctctatggagataggaaaataatagttatgggaagttgatccttaggatcagcttatctctataggagctagtaaaacaatagttgagtcggacatgagtcatatacacagattgtacgtatagcccatttcagaagtagaactaattgcagtcgttatctatcaagacccattatgcatgtccaaaattgagatgttacaaggaatgagcgaggttacagttgggaaagaagtccaaatcgaaggaagggcggaatgcaatggtggaagtagagaagagaggagctacctcggttgcagcttggcaaggaacctgagatcgggctgctgcttctggaggacaggggtgacgcgcgccagcagcgacggcttcttggccttggccgggaacagaaaggactgcaggggcaccttggacttggaggcgacgcgcgtcaatggcagcggcggcggggttgtggctccggctccggctccggctgcaggtccgtcggcgtcaggcagggtgacgcccccgtgctgcagcttcttctcgatctgggcctggaggcccttgacgtggtcctggccggcctgcagctcgtcggaaacccggttgttctcctgctgcatgttgagcacctcgccctggaacttggccgcctggtacgacgtgaactctcctcctcctcctccttgttccagtgccgccgtgatctcctcctgcacgtcgcacagggccgcgaacctgcactgcagctcccctcgcagcatcgcgttctgctccgaccacacctgcagctccgtcttgagcgccctcagctgctgctcctgcttctgcttctgcttggtgtcactgttgccgtcggtggccgccggctgcagctgctgcatcagctcgtcgtgcttgcgctggaactcctgcacccgctgcagggacgagctgaacttcatccagaactcgaggttctcctccagcagcgtgtcgatgt

SEQ ID NO: 40493 - DNA, 2897 bp, Oryza sativa
  unsure (1)..(2897): unsure at all n locations
cttcagttgctgccgactgagatggaatttggcaatgaggcttgatgcattggaaagagaactccgagagctttccatcaagtactcacgggctgaaaacggaggtcgtatggagtttcggcggccgtttgaagtcagcagtgtagcaggtggccgaattggattttggcacttggaggactcgaacttgatatcttgttgttcatccatgatgtgagcaacggatgtatccgtagtagccatggtcacatcagaatcacgaagtgagtttttgctacgaacgcacccaatacactccaatatgtccaaaaatcatgttttggcgttttttgaactttttcatttcagtagaaaacattgcaccctcgtgtgccaatattggcattaattgacaaaagttcgccgcgcgaatacactccaatttgtccaaaaatcatgttttggcgttttttgaactttttgattccggtcaaaaacagcgcacccttgtgagccgatattggcattaattgacaaaagttcgccgcgcgaatctcaaagtgagtttttgccacgaacacacccaatacactccaatatgtccaaaaatcatgttttcgagttttttgaactttttgatttcagtagaaaacatggcacccttgtgagccaatattggcattagttgacaaaagttcgccgcacgaatcacggagtgagtttttgccacgaacgcacccaatacactccaatatgtccaaaattcatgttttcgcgttttttgaactttttgattccggtcaaaaatatcacaccctcgtgtgccaacattggcattaattgacaaaagttcgccgcgcgaatcacgaaagtgagtttttgccacgaacgcacccaatacactccaatatgtccaaaaatcatgctttggtgctttttgaacattttcattccgatcaaaaacatcgcacccgtgtgggccaaaataagccaatattgacattatttgacaaaagttcgctgagcgaatcacgaagtgagtttttgccacgaacacacccgatacactccaacatgtccaaaaatcatgctttggtgctttttgaacatttttattccggtcaaaaacatcgcacctgatgaggacatcaacaccatcgatacatccacgtccccccatatacagcatgatggtcctattacccgcgctcgtgcacgtcaactaaattatcaggtgagttctttcttgagttcatattcctcgtctttataccccggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtactacatggaaagcttatcaagtctactttcaaatggatccagccacatgtccatatctgttctggagcggccgcaattgtcattttactcccgactattttctgtccattgtgctgcgtcacctcttttggcccaatgggctgtgtatccatgttgggcccattaggggcgcgtcctatggttggagcacgaccctatggtcgttcttcccctctttttatacctctagtcgccgccaagaacaggcgggtttttgatgatagagatagcttcttgctactggctcacagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggtgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagagaatttacccttcccttcgtcattaatttttttttccgatagtccagaaaagaccaacaaaaaaaatagtagattagtttttccatgatcctatagaccattgtgccttttcactagtactgcttagttaaggcttgttgagttttcgattgcatcggttgtgttaatttgctggtcttagtgttaggcgattacagtttcgagttcttgccaccaccgcacaacgctaccttcatcaattttgccgtcatcaccaccgtcaccaccgtcacagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacgaacatctacaaaaaaagtacatccgattctccccgctttgccgggttcggcaaatttaaaatcgccaaattcctcttgcaaaattctgtttttgtggcgagaagcttcgggacctattcgcatagaactttgaaaaaattctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40494 - DNA, 1365 bp, Oryza sativa
tttgggaccccggcccaggtggggcccatgtggggtgcgccccaagctggtggagcacgaccctaggcacccctaggtcgtcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttgttcttgcttgtttcttcgatttgcttgcaggaatagggttgatctgcaccggcaaaatcagcaacccacggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgcgaacttttgtcaattaatgccaatgttggcacacgagggtgcgatgtttttgaccggaatgaaaaagttcaaaaaacgtgaaaatatgatttttggacatattggattgtattgggtgcgttcgtggcgaaaactcacttcgtgattcgtgcggcgaacttttatcaattaatgccaatattggcacacgagggtgcgatgttttcttcaggaatcaaaaagttcaaaaaagtccaaaacatgatttttggacatattggagtgtattgggtgcattaatgccaatattggcttatttcggcccacacgggtgcgatgtttttgaccggaatgaaaaagttcaaaaacgcgaaaacatgatttttggacatattggagtgtattgggtgcgttcgtggcaaaaactcacttcgtgattcgtgcggcgaacttttatcaattaatgccaatattggcacacgagggtgcgatgttttcttcaggaatcaaaaagttcaaaaagcaccaaaacatgatttttggacatattggactgaatcgggtgtgtacgtggcaaaaactcattacgtgattcgcgtgggtaacttttgtcaaataatgccaatattggcatatattgtcacacatgggtgcgatgtgaacgaccggattgagaatgttcaaaaagcaccctcgcatgctgttatgacatattgtagagaattgggtgcgtacgtagcaaagactctgttagtgatacgcgcgcgcaacttttgtcaattaatgccggcattgcacatgagggtgccatgtgatgactggaatcaaaaggatcacaaagagccaaagcttgattttaggacctaatggagtgcatggcgtgcattagtcgcaaaaactcactacgagattcgc

SEQ ID NO: 40495 - DNA, 2867 bp, Oryza sativa
caatacactccaatatgtccaaaaatcatgttttggactttttgttgagctttttgattcctgaagaaaacatcgcaccctcgtgtgccaatattggcattaattgataaaagttcgccgcacgaatcacgaagtgagtttttgccatgaatgcacccaatacactccaatatgtccaaaaatcatgctttggcgttttttgaactttttgattccagtagaaaacattgcaccctcgtgtgccaatattggcattaattgacaaaagttcgccgcgcgaatcacgaagtgagtttttgctacgaacgcacccaatacactccaatatgtccaaaaatcatgctttggtgctttttgaaaattttcattccggtcaaaaacatcgcacccgtgtgggccaaaataagccaatattgacattatttgacaaaagttcgccgagcgaatcacgaagtgagtttttgccacgaacacacccgatacactccaacatgtccaaaaattatgctttggtgctttttgaacattttcattccggtcaaaaacatcgcacccgtgtgggccaaaataagccaatattggcattaattgacaaaagttcgccgcgcgaatcacgaagtgagtttttgccatgaatgcacccaatatactccaatatgtccaaaaatcatgtgccaatattagcattaattggcaaaacttcgccgcgcgaatcacgaagtgaatttttgcaacgaatgcacccaatacactccaatatgtccaaaaatcatgttttggactttttttgagctttttgattcctgaagaaaacatcgcaccctcgtgtgccaatattggcattaattgataaaagttcgccgcacgaatcacgaagtgagtttttgccatgaatgcacccaatacactccaatatgtccaaaaatcatgctttggcgttttttgaactttttgattccagtagaaaacattgcaccctcgtgtgccaatattggcattaattgacaaaagttcgccgcgcgaatcacgaagtgagtttttgctacgaacgcacccaatacactccaatatgtccaaaaatcatgctttggtgctttttgaaaattttcattccggtcaaaaacatcgcacccgtgtgggccaaaataagccaatattggcattaattgacaaaagttcgccgcgcgaatcacgaagtgagtttttgccaggaatgcacccaatacactccaatatgtccaaaaatcatgttttggacttttttgaactttttgattcctgatgaaaacatcgcaccctcgtgtgccaatattggcactaactgacaaaagttcgccgcgcgaatacactccaatatgtccaaaaatcatgttttgtcgttttttgaactttttgattccggtcaaaaacagcgcacccttgtgagccgatattggcattaattgacaaaagttcgccgcgcgaatctcgaagtgagtttttgccacgaacacacccaatacactccaatatgtccaaaaatcatgttttcgcgttttttgaactttttgatttcagtagaaaacatggcacccttgtgagccaatattggcattagttgacaaatgttcgccgcacgaatcacggagtgagtttttgccacgaacacacctaatacactccaatatgtccaaaaatcatgttttcgcgttttttgaactttttgattccggtcaaaaatatcacaccctcgtgtgccaacattggcattaattgacaaaagttcgccgcgcgaatcacgaaagtgagtttttgacacgaacgcacccaatacactccaatctgtccaaaaatcatgctttggtgctttttgaacattttcattccgatcaaaaacatcgcccccgtgtgggccaaaataagccaatattgacattatttgacaaaagttcgccgagcgaatcacgaagtgagtttttgccacgaacacacccgatacaatccaacatgtccaaaaatcatgttttggcgttttttgaactttttgattccggtcaaaaacaactctccttcgtgtgccaaaatatgccaatatttgcattaactgacaaaagttcaccgcgcgaatcacgaagtgagtttttgccacgaacgcacccaatacactccaatatgtccaaaaatgatgttttggcgtttaatgaactttttgattccagtagaaaacttcgcaccctcgtgtgccaatattggcattaattgacaaaagttcgccgcgcgaatcacgaagtgagtttttgccatgaatgcacccaatacactccaatatgtccaaaaatcatgttttggcgttttttgaacttttagatttcagtagaaaacattgcaccctcgtgtgccaatattggcattaattgacaaaagttcgccgcgcgaatcacgaagtgagtttttgctacgaacgcacccaatacactccaatatgtccaaaaatcatgctttggtgctttttgaacattttcattccggtcaaaaacatcgcacccgtgtgggccaaaataagccaatattgacattatttgacaaaagttcgccgagcgaatcacgaagtgagtttttgccacgaacacacccgatacactccaatatgtgcaaaaatcatgttttggtgctttttgaacattttcattccggtcaaaaacatcgcacccgtgtggaccaaaataagccaatattggcattaattgacaaaagtttgccgcgcgaatcacgaagtgagtttttgccatgaatgcacccaatatactccaatatgtccaaaactcatctgccaatattagcattaattggcaaaacttcgccgcgcgaatcacgaagtgaatttttgc

SEQ ID NO: 40496 - DNA, 11772 bp, Oryza sativa
ctgaaaagatcaatgcaatggcacaatatggctaggtaaatgatacgaatttttttgtatggctattttctggttacaggaagataaaaactcaccgagcaacgaaagctctgataccacctgatgaaccctgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggtttcgaatacaagcagacggacggtctagccgacacgcgcgctgcaagcgaagtagcaatggctaaactttcatctaaacaaaacccaagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgttgcagcaccttgtttcttcagttgctgccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattgaattttggcacttggaggactcgaacttgatatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaacttgaaatagtgtgattagcaataacatgtttctctaaatccgaacaaatgaaaactctatgcaccaaatatattcctctatcattatatttgccaaagatatgaaaaatagcattagttagacatggcaaatcagacttagcaaataatttctccttcatattatcgagctcaccaaaatcatcaaactgaacatagcccaaagtatttaaagaagatagcaatttacgttcctcaacttcattaacaatatgaacagcatgcttaaaatcagcacacaaagaaacactaggaatagcatgttcattcactagttgtggcatggatataagtgaagcattatcgcacaactcttctttatcacaaggaacagcgagtaaatcaacttgtgacaaaggaattccagcatttggttccactaacggttgctctacttttgcatgaaaagtggacaaatttacttcgttaacaatgcaatcaccttgattaatttagtaccttttactttaccttggatgtcctcttttgatgatggaggtgtctcgaacttgagtgtgaacaatggaattggtggctctttcatgtctctctcctccttttcgtgattacgcacttcctgcaaatagttagtaattggaggcaaagacatagcgtgtttccttttcatatcctcctctattttactttcagcattgcaagcaagttgtaacaaatgagaaagagatgtatatctttgacaatcaagcatgtcctgaatttctttgttaagcccacataaaaacctcaattctttagctttttcgcattcatctaaaccacaacgtaataaacaagcttgcatatcatgatagtatgaagtaacagttctggtatcttgttttaaacattgcattttgttgaacaaaatgtcagcataatacatgggaacataaacatctctgaaatatcgtttcaggtctttccaagattgtggtattttgttatacctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttcccacgaaataaggcagtgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacgcaaaaatatgcgcgttcctattaactagtggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttggtgcggctttttttttctcttttttttttttgcacctttctgcctttttttctcacttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaattcatgccggttccgtttttccaaacagatctcgaaaccgacaccaaacaaaaattcgccaaggtgtttgacacaactcggaaccgtggaagagagggagggagtcggactcggccaaaggggccagtgggactcggcaaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgataaaccctgagttcctctcgacactcaaggctgttgttggcccgatctttcggtgagttgtgataactacgatttgggagaaacgttgacgatccgactacaaccgtacgagacgttgtgttgtgccttagcgatcgatacacctctccgtaggttgttgatcttgccggtgcagatcaaccctattcctgcaagcaaatcgaagaaacaagcaagaccaagaataaagcaatctgatattgcaaataggaatttaatacaaatgataagttggggttccgaagaacaagcagacggacggtctagccgacacgcgcgctgcaagcaagtagcaatggctaaactttaatctaacaaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcatattcggtggccgtttgaagtcagcagtgtagtaggtggccgaatcggattccagcacttggagtacttgatctcgatatcttcttgttcatccatgatgtgagcaatggttgcatccgtggtagccatggtcacatcaaatatgtccaaaaatcatgttttggctctttttgaactttttgattccagtagaaaacatcgcacgctcgtgtgccaatattggcattaattgacaaaagttcgccgcgcgaatcacgaagtgagtttttgccacgaatgcacccaatacactccaatatgtccaaaaatcatgttttggctctttttgaactttttgattccagtacaaaacatcgcaccctcatgtgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccatgtgggccaatatatgccaatattgacattatttgacaaaagttagccacgcgaatcacgaaatgtgtttttgccacgaacacacccgatacactccaatatgtccaaaaatcatgttttggtgttttttgaactttttgattccagtagaaaacatcgcaccctggtgtgccaatattggcattaattgacaaaagatcgccgcgcgaatcacgaattgagtatttgccacgaacgcacccaatacactccaataagtccaaaaatcatgctttggtgctttttgaacattttcattctggtcaaaaacatcgcacccgtgtgggctaatatatgccaatattgacattatttgacaaaagttagccacgcgaatcacgaaatgtgtttttgccacgaacacacccaatacacaccaataagtccaaaaatcatgttttggctctttttgaactttttgattccagtagaaaacatcgcaccctcgtgtgccaatattggcattaattaacaatagatcgccgcgcgaatcacgaagtgagtttttgccacgaacgcacccaatacactccaatatgtccaaaaatcatgctttggagctttttgaacattttcattccggtgaaaaacatcgcaaccgagtgggccaatatatgccaatattgacattatttgacaaaagttagccacgcgaatcatgaaatgtgtttttgccacgaatacacccgatacactccaatatgtccaaaagtcatgttttggctctttctgaactttttgattccagtagaaaacatcgcaccctcgtgtgtcaatattggcattaattgacaaaagttcgccgcgcgaatcacaaagtgagtttttgccacgaacgcacccaatacactgcaatatgttcaaaaataatgctttggtgctttttgaacattttcattccggtcaaaaacatcgcaaccgtgtgggccaatatatgccaatattggcattaattgacaaaagttcgccgcgcgaatcacgaagtgagtttttgccatgaatgcacccaatacactccaatatgtccaaaaatcatgttttggcgttttttgaactttttgattccagtagaaaacatcacaggccatctacaaacaaaaacaaaagagaaaagcaacattttaaaggtcagattttgacgataaatgaagcagcaggacagagagagactagaggattttcacaaataagaaaggatttttatttcgaaaatattgctaaggcttgggatctaaggctcgtcctagggtcaagggggctctgataccaacttgtcacgaccggaaataacccaacgggcgttccttacgtgcgtgcattattccttgtcccaggagacaagcggaagcgtaattaattaatttattacatgggcggcgaagacccagcacacaagaagacaaacaaaaaatagcggaagactagggcgatgaccacaggcgcttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatataggggggttagggtttgcagtaaacagcattaaaagacacttagttgctcaaagctattttgtaaacaccgtcctagagctatacaatattattaacaaaggctgtgaacccacacgaacctgccttaacccaaggcctacgatgattcagaccgaactggcaacccgaccctaggtgccagctcgtcccaagccaacctaggccaaccattccacattttagttgttaagcaggttttaagaattaaaacactaaattgggtacattgctcggcttgcccataaccgagggcgcggctattcgaatagattatactctgatcagaggtgtacatctttacccacaagacacattttcctcacgtgtaaccacgtgccacataccaccacggtatacggacggaagacttgacatagtttccaacccatcctagccataaacaagagtaccgacccaaccccacctacggccggaacccccaggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactaagccacaaactaagccttacccactaggcatgtggaagtacggtagtgctttgcaacagaggcccgaagaccggtccatatatggccgaggtgctactgtcaaaaccatgcaccccgagcccagcctaaaaccattttgagggttttgaatagagggggaggtgtgaatccaattccacaataatccaaccattccatagtgtccaggtgataagagtattcccaaagtctagagttgtaaaaccacctaatgttgcctaattaaccagcgaagcatctacctaaaatcatactagtggtaccatgagtgtccactagttggggttttgtttcttctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcactttcgcaaacgtcggcttcaacctccacgaagagcggatcttccgaatctgcaacgtctacacgaccaacggaaaataaaagggcttttactctaataaactccatataacaagcaggaacgaagcacaaaaatgggttcttgacttcttaaggaaaaaaagagacttgaacggtccaattccgagttcaaatggccaagttatggccatttgaagtttatatgctctttaaatgaatatttgcggatttcttcatttaaattttaatttaaaaagggtttattgcgtcagccgaggggagggggcgcgaggaccgggtccacgggagtggggcccacgcggcagcctcacggtccacggtggaccgggcgcacccgggctcgcaccggccggcgccgtgggccccacgcgtcagccgcacctgagggcgcgggcggctgacggccgggccccacgcggcggccactcggcgcgcccgaaggcggccactcggcgcggccggcaggaggcggcgcccgcgcccctatggtcgccggcggcggccataggcacggcggagcggcggccgagagaggggaagggaagggggaaaagaggcggcggtccacggctcaccctaggtcgacggcgacgacgaaaaaggcggccggagcggaggaaggcggcggcgcggctctggtcgacggggtcgacggcgttcctgcggtcggcggactcggtgagggggtggacggggtcgacggcggtgcagcgaagccggaggaggcgacgccggggcgggagacggtcccggcgagcggagaaggccggccggaggtcgtcggcgacggaggagtgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaaccccgagaaaccctgaaggggtaactagctatgtataggggtgggaggacgacctaggggtgcatagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagacagcagtgtagtaggtggccgaatcggattccagcacttggagtacttgatctcgatatcttcttgttcatccatgatgtgagcaatggttgcatccgtggtagccatggtcacatcaataacctattcgaatagccgcaccctcggttatgggcaagcctagcaatgtacccaagttagtattttaattcttaaaacctgtcaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatattgtatagctctaggagcatgtttttaaaagtagctttgagcaactaactgtcatttaatgctgtttactgcaaaccctaaccccctatattattactcccttgtactcctttgcatttattctgcactcgtggatgtgtcttgttgagtatggtggttgtacttagtcttgctcaatttttcccaaacccagaagaggagttgctggatgatgaaggctttggtgtctagctcgtgcctgccgtcaagcgcctgtggtcgtcgccctagtcttccgccgtttttcgtttgtcttcatgtgtgctgggccttcgccgcccatgtaataaattaactatttacgcttccgcttgttaaactctgtattgtatcaacttttggtgtaccttgccacctgggacaaggaataatacacgcacgtaaggaacgcccgttgggttatttccggtcgtgactcatcacattctaactcaaaagtcttaccaaagtttggaagttgtagcaatggtgcgtgtgtaagcttgtccttcaaagtgtcaaacgacttctcctgtgtcttttcccaatggaagaccacccctttcttcatcaactcattcaatggtgcagcaaaggtactgaaatctttgacgaaacggcgatagaatcctgcaagaccaagaaaactcctcacctgtgtgatggattagggaaccggccaactctttatggcttcaattttcgactcatccacctcaattccctgtggagtaacaacatatccaagaaaagaatctcgttccgtgcaaaagatgcacttttcaatgttagcaaacaaacgtgcatcgcgtagagcattaaaaacagcacgtaaatgatccatgtgttcatccaaagacttgctgtaaatcaatatgtcgtcaaagtaaactaccacaaatcgtccaataaaaggccttaaaacctcattcattaagcgcatgaaagtactaggtgcattagtcaaaccaaaagtcattactaaccactcatacaaaccaaatttagttttaaaagatgttttccattcatctccaagtttcattctaatttggtggtagccactacgcaagtcaatctttgtgaaaattatagaaccacacaattcatcaagcatgtcgtctaacctaggaataggatgacgatatcggatagtaatattattaatggctctacaatcaacacacattcgtcaagaactatctttcttaggaaccaaaattacaagaactacacaaggactaaggctttaacatacatacccgcggtccaaaagatcttgaacttgccgctgaatttccttagtctcctctgggttggttcgataagcagcacggtttggcaatgatgctcctggaatcaaatcaatttgatgctatatccctctcataggtggcaatcccgggggtatctcagctggaaagacatcctcatactcctgcaaaaggttagtaacaacacgaggtatcgaactagcaatatcatctagagaaactaaggcttgtttgcatatcaagaaatagcaaatatcatcatctgaaatttcagcaatgtcacattttgttgcaagcataacaccacccttcaacttaattccctcaaccttagaactaggtgaaagcttatcctttttaggtaggaaaatagatttagccacttgctgattttcagattcatcaagtttcaaactagcagctcgctctttatcagcttctacaatttcagcaggggtcaaaggtagcaaagtaattttctttccattatgcactaaagtgtagcatcattatcatgttcccaagcatgaccttgaaaaagtgaacaagcttgcataggaaccacatcacaatcaacagaatctgcatatgagccaatggaaaacgaaaccctacaaacctgtgttacctttgctcttccaaaatcgtttaaccactgaatatggtaaggatgtggatgtgtacgtgtggtcaagccaagcttcttgaccaaatcagaactcaccaaattgttgcagctacctccatcaatgatcacacgtgcacgacagttattgatgacgaagaaaatctgaaacaaattatggcgttgcaacctctcaggctgctgtacctgcatgctgagcacccgctgcacaacgatggtcctgtagtcagttgtgtcatcacgaccaaagacttctccatcctcatcctcaacttcttcttcctcctcttcctcttc

SEQ ID NO: 40497 - DNA, 1525 bp, Oryza sativa
cctatcgtgcatagctaccttaagttcttcccaagtagtaggtagtaccccctcatcagataacccagcccactacatgatagcaaaatccttgaactcactactagcttgtttaactctatgttgctcaggtacaaggtgggcattaaacttttgttctattgccatctcccaatcaaggtatttctcagcatcataatatcctgaaaaagatggtattttaaacttaatcttagcataaggatcatctggcacacgattattattaccttgttggtggcgagtgccacccatacctgtgcggtttatgcgtaggcgacgtcatagccgtgcttgccttgtagctggtgtgtcaatatagccactggaatcatacaccgtgtcttccgaatgagcatcgtcgtcaccactcaccacttcctcattggaaggtgtctccaacgcggcaacccgatcagttagcgtggatatctgcttgtccaacctctccatgtggttcaggaagccaattttagtgaaggcatcttggacagactttgcaacggcctctgataccacttgatgtgcactagggttcccgatcttccgaaaggttctgataaaaaacgatttgggcggagtcgcgacacaaatcgatccggcttcttgaacgcgcacgctcttgagccccgcaatcacaacaccacgtctcctctggttatcacctgtgtcgaaacgcggatgacctcgccaagaaggctaatccctatttgccaatcgaagaacacaaacaagaacgagatagaaaacaaccaaaattgcagatgaatgataagctcacgagatggggtcttacaaaccgatctagcggcgaaactgttctcgacagaataatctaagcaaaactctaaaacctaaagatggtagcggtactgatatatagagtttaggctcgtgcaaccccctctcgacgcaaccctaatgggttccaacacgatacacggcccaaaggcccaaatacggtgacacagcaccgggacggattctggatgtcaacttgttcagtcgatacccattgactcggaaagtatttggacgtgggaccaaaaccattggaaagaacgccccaatccgagcacgtatgcgacctgggcgcccgttttagtgcagactggtcctggactccgaattgcaccgaggtcgaattggtttgggcctccacctttacttggacgtcctcgatgatcctccatggctctaagtccttctccaagtgtctccttgtcccctctattatttctaatcacaatatattcattaggtagcaatcttttctcgaattcatacaaagaagaacataggaacgagctcacctctaaatttaattgtcgcgcacgagctcttgttatcagtccttgaatgaccattggaggattgttgtgtgtatccgaggtagtgatgtccgtatcatgtcgcggagcttcggcgtcttccatcaagatattagctgatgaacgagtgctagacccgtcatgatgacttgatg

SEQ ID NO: 40498 - DNA, 1104 bp, Oryza sativa
  unsure (1)..(1104): unsure at all n locations
tcaagtttgttttggaaagatatagtagattggattggttaaaaatcagtttcctttttatcccatacaccaaattcggctgccatccactccacctcctggccgagtcccactcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttttataattttaattttgggtttagacttttacatttgagtccctataaattttatatttatgtttgagtccctgtaatcttacattaaggtccttgagtcagtttttgttaaaaaaataagaaaaaaaagtgagaaaaaaaaaggcagaaaggtgcaaaaaaaaagaaaaaaaaaagccgcaccaaaaaaattcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcgttctctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40499 - DNA, 926 bp, Oryza sativa
ctcacttcgtgattcgcgcggcgattttttgttaattaatgccaatattggcacacgagggtgcgatgttttctactggaatcaaaatgttgaaaaagagccaaaacatgatttttggacatattggagtgtatcgggtgtgttcgtggcaaaaacacatttcgtgattcacgtggcgaacttttatcaaataatgtcaatattggcatatattggcccatacgggtgcgatgtttttgaccggaatgaaaatgttcaaaaagcaccaaagcatgatttttggacatattggagtgtattgggtgcgttcgtggcaaaaactcacttcgtgattcgcgcggcgaacttttgtcaattaatgccaatattggcacacgagggtgcgatgttttctgctggaattaaaaagttcaaaaaagccaaaccattatttttggatatattggagtgtatcgggtgtgttcgtcgcaaaaacacatttcgtgattcgcgcggcgaacttttgtcaaataatgtcaatattggcatattttggcccacacgggtccgttgtttttgatcggaatgaaaatgttggcacacgagggtgcgatgttttctgctgcaatcaaaaagttcaaaaagagccaaaacatgatttttggacatattggagtgtattgggtccgttgtcaattaatgccaatattggcacacgagggtgcgatgttttctgctgcaatcaaaaagttcaaaaagagccaaaacatgatttttggacatattggagtgtattgggtgcgttcgcggcaaaaactcacttcgtgattcgcgcggcgaacttttgttaattaatgccaatgttggcacacgagggtgcgatgtttttgaccggaattaaaaagttcaaaaaagccaaaccattatttttggatatattggagtgt

SEQ ID NO: 40500 - DNA, 20216 bp, Oryza sativa
tattgttggcccgatctttcggtgagttgtaggtaactacgatttgggagaaacgttggcgatccgactacaaccgtacaagacgttgtgttgcgccttagcgtctagttcgtttagtgtttcgtgttctggtcacgttttataccagagtcattgccgcctccgtgtctctgttatcgtcgggacctacgaaaacggaatcggcttgctgccatggttctatttttgtagttttcaaaagtttttatcggtcggttttggtgttgcatcaagggtttgttgtttacccaggcttagtgcttgtgccgtggttctgttttgcccgtgaggaagaagaaggggaaaggaatatagaagatctgtttggattcggttgggtggaaggaaagaaaaaaaaaggaaagaacagaataggaaagaaaaagaagattagatcgggtggaaatccgtttccttttattttgtgcactgaatccaaacactagtgctggccgcaatattcagctccacctctccgtggtgacttccttcctccgagtccgactcctccctctcttctgtcggtttagatccataccgtgtcttcccgcatagcttggtgaaaattttcagagtgtccgattggagatccgtttgaaaaacggaaccagtataaattcagcattccatttttgtataattttaatttttgggtttgcacttttgcatttgagtccctgtaatttgtatatttacagttgagtccttgtaatcttgcattaaggtccttgagttggttcttgctgaaaaaaaatttaaaaaaaagaaaaaaaaggcagaaaggtgctaaaaagaaagaaaacaaaagccgcaccaaaaaaagaaaagaaaaagaaaagaaaagcaggaaagacaaaaaaaagagagagaaaaaaagaagaaaaggagaaaatcattttgttatcattgagctgaacttcatatatcagagttgtgcatgagttgctcctagtgctatcttgtggtatcatttgtgtgtaggctcacgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtgtttgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctactagttaataggaacgcgcatatttttgtgtatgtttcttgtttgctactaaccatggcaggattgcgcacggggaaatgagatggtcatgctcaacgtcaacatcttcaccatcaacgagatatagcgacttcttcacgcatcacatatgaggtacctgataatgatcttgcaagggtagaatctaaattgccagtttttgatggtaagtatgattctgccgcttatgttaattgggagctagcagtagaaaaacaatttgatgagtatgatttttctaatgctcaaatgattaaggctgttagtaataagtgtatcggttctgcatctttttggtggcatactgtgggaaataagcttgaaacttgggatgaatgcaaaatactgatgagaaaaagatttgtgttttcatactatagacgtgctctctttgagaaatttgaacatataaaacaaggtgacaaaactgttagggagtactttcatgattttaaaatttgtatcacttatagtggtttacaagaatctaatgagaacacaatgactagatttttcagagggcttaattccaatattcaggttgggcttgttaatgtgacatataatcatataggccaattgttcatgcttgcttgcaatattgagcgcaaaattttggagaacccaatggagcaacaagctatgcttgtgcctcctatcgctgatattttgcaggaagttcagaacagtccccaaaatgagaagaacgatatgtttgagatgtcacttccatcactcgcgaatgaggagaaggctgatgcacctacattatctgaagagggcataaaaggtaaattaaatggtgcagaaattactcaagatgagtatgcttctgatgaatttcatttttccacttgtcatgctagagaagagcaactattagtggaaccaattgctgagatgcctttgtcacaagttgatttacttgctgttccttgtgatagagaagagttgtgtgataatgcttcacttatatccatgccacaactagtgaatgaacatgctatttctagtgttttattgtgtgctgattttaagcatgttgttcacattgctaatgatattgaggaacgtaaattgataacttctttcaatactttgggctatgttcagtttgataatttttgtgagctcaataatttggaggagaatttatttgctaagtctgatttgccatgtccaactaatgttatttttcatatctttggcgaatataatgatagaggaatatatttggtgcatagcgttttcatttgttcgcatttacagaaacatgtttttgctaatcacactacttcgagtttgtctagttttgattggatgaaacaggttatttttgaatggactatatgaagagcaccatatggaaaaaacgaggacgattttccgtgaagaaggggaggatgatgtgaccatagttactatggatacaaacattgctcatatcatggatgaacaagaagacatcaaggtcaaggcctccaaatgctggaatccgattcggccacctgctgcactgctaatttcaaacggccaccaaatctccatacgagctccgttttcggcccgtgagtacttgatggaaagctctcggagtcctctttccaacggatccagcctcattgcgaaattccatcttattgagccgcaattgaagcaacaaggtgttgtgtcacctgtcatgggcctttgggcttgtaacttcgtttgggaccccggcccaagtggggcccatgtggggtgcgccccaatctggtggagcacgacccttgtcgagtaactcttgcacttgtgatgcagcaacgggggttcccgatctttcgatgagaggaggataaacttcgatttggcgaaggatacgacgttggcggtccgactacaactaccacaggggtgttgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacctctaatgggctgtaatgatactaggcccaagcccaagtttctgatgtaaagaactattttcgttattctgagcagcctgggtcaaacttgatggtgaggccacacatagctgaaagtagacgacgagatctttccaacaagtactcatttgccccatttgccctccggagtgaagagcattgacttcatcaaatcagcgctgctagtgctgctggcgatttggttcctctcccatattcctaacaacaagtagatcacaacaaccatttagtagcacccaattctgagaagaacttgtatgattagctaggaatgactttacctgataattaagttcacgagcttgagctctagtcattggtccttgctgtgcaataggcgtggttgtatcgttggaagggatgtcctcatcaacttgacgctgattctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtatgctcctgatttttttgtttgctagctctagcaagttcatcctttaaaataacttcaggagacataggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccactgctattaagccattgaatatagtagggctgcggatgtggctgtgtgctcaatgaaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccctaatatgttcctcatcttggtggggcgcgtcaccttcccctgcattgttagttgcaagcaaagcataggtttcttcatctaaatcactagcggaggagtacccaccatcagctctcacgatcattacacgagtgcttgggcagtccttgcgcacgtgaccatagcccttgcagcgtaggcactgaatatctcttgtccttcctgatgaagctactgatgatgagctcttggaaggtgtagcagcaacccctcttgttggttcactcgggcatggtgtagagtttgttgtagagggacgcagcttgttgcttgaggacgatggtgctgctgctcgagttgacggtgcagcagcgttgggagatgtccaagagctagcacaacctgcagaaatgttagtcctgaagctagctcttcgtccctgtacttccctttcagctttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgtagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacgtttattctcaggaaaattatggcaagcaaatttctgatcaatggctaactcccaagtaagatatgcatcagggtcatattttccatcaaagcaaggaatggtaaacttgatcttgcctaaagaatcatcattatcacgtacctcccgccgtggtggagcgcccatgccatggcgctgccggtgctgttgtctttgtggacgaccaagtacctcctcattatgctcagtgtcagcagcgtactccagttcttcccttgctgcgatgctgctattagcatcatggccatgtggttgcgcctagccgatccatcatgaccatcttggcccattctctctaacgtattcaagatacctgcaagagaagtgttcacagccacaagggacatctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaatatgtcctatcaactattggagctaggtgttgtccatctccacttctaccaaacttgtgcaaacgagttcttacatgttcttactttgttatgtaaaaggcgttggcaaacagcaagaacagcaacaacggttagtagtaccggagccgacaacagcacgatcctgtgatatagtagataaaaatttgtggagctataggtggctgcaagtaatatcaaggtacagctagaaccacattaatcaaagcaagttgaataatcattcaacgatggtattgtgctggtcctaggcaaaaccctttagagacgcgagcctagtcacaagcgtagccactcaaaatagcacgaaaataacacaaacaaaacagcaacaacaacaacttcctctcttcccttccttttttttttcttctcttcacttctgattttttttctttcttttttttttgttttctttcttttttttttgtacagcaagctcaaagcttcagccaacaagtcaaaacaagccttagcaaaataaccttttctcaaacattttcgaaatttcacaagcttcagccaacaaatcaaaacaagaagtaatgatgggttggttggctagttacatgattcagccaacaagtcaaaagtgagagcacttaaatgctttcttgggaagggctgattcacttcaaaaagttgcaaaagggttggctgttggtggaggcagcaataaatgcatttgggggtggctgatgtggtgatgagggtgctgctggttgtggtggacgaaatttggtggggttggaggtggatttcgtggtgaatatggtggtgatggtggcagcgggatgaagataaatgaagtgatggtggaagtgtttgcggtgacgaaatcgtgagcagaactcgaaactctaaaggactaaactactagaaccagcaactcaaccaatcgatgcaatcgaaaactcagcaagcaaagactaagtagaacagcaaaggctcaacatgttttggtgatttcgggtctgacctattttagtggtttttcttttgggctgtaggtaaaaacaaagaagtgataaaatctctcaccgagcaacttgagctctcataccacttgatgcagcaacgggggttcccgatctttcgatgagaggaggataaacttcgatttggggaaggatacgacattggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccaggtggtctagccgacacacgcgagtacaaggaagtagctgcagctaaacttacatcaaaacaaaacccaaagtgcaaaatggtggctgctaggagtttatataggtggaggaatgaccaggagaggtggtgggagcaaaccctaggttttgtggacccctaatgggctgtaatgatacaaggcccaagcccaagtttctgatgtaaagaactattttcgtcattctgagcagcctgggtcaaacatgatggtgaggccacacatagctgaaagtagacgacgagatctttccaacaagtactcatttgccccgtttgccctccggagtgaagagcattaatttcatcaaatcagcgctgctagtgctgcttgcgatttggttcctctcccatatttctagcaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcattatggtcattctcccacccctataagtagctagataccccttcagggttgctggggttttgataaattgtaagtttagccattgctacttcgcttgcagcgtgcgtgtcggctagaccgtccatctgcttgttcagaaccccactttatcgtgtatcaattcatctttgtgcgtcttgtctatctagcaattcagttgctttttatcttgttcttgcttgttctcgattgcctgcaggaatagggtcatctgcatcgacaagatcaacaacccacggagaggtgtatcgatcgctaaggcgcaacagaacgtcttgtacggttgtagtcggatcgtcaacgtttctcccaaatcgtagttatcacaactcactgaaagatcgggccaacaacagccttgagtgtcgagaggaactcagggttcatcacgttgcctcaaagaaagagacagccgaccattggcctggccggttaggccgaaccagggtgttcggccgaacccctggtgggcccaaccggccccactttcagccgttggattccaacggtcagtgtggtcgtggcacaataaattttcattgaaaattttattttggtttgctctggaaaattcatttgaagaatttcctaaaaattcaaaaagcctaaatgcattttgaaattcaaatatgtggtgatacaaaaatttaaattgttgaaagcaaatatgcggatacatacctcctttcggtttagtgcactgatttttcacccgtctccggaggtgatggagcgggcatctttagcttttccttccacaccttttttgattttggtgcggatggcggcttcttctgagccggctgatctgacttcttggccggtacgggtgattttaccggcgttttccaataacggttcctgggcatcgttgtttccttctccaggaaattctgcataaatatcaccaagctgtccgttttgggtggctccacttcgaccacttgaatattctacggattcggcccgtactttattctgaccatggagcattgttccgtccttggttgaaactcaaacttttcctccttcccgttgatatggaaacggatactccccgttcccacgtcaatgttggctcctgcggtactaaggaatggacgccctaggatgagcggcatctccttccccatgtccatgtctagcaccacaaaatcaaccgggatgaagaaatcccgtatcttgactggcacattctccgctattcctgctgggtaacgaactgatgagtcagccagttggaggcgcatcggtgttggttccaacactgtgaagttgagcttgtcgaagacgtcttttggcatgacgctaacgctggctccaaggtcgcaccaggtctggtcgaattgttgtgccccgatcgagcaggtgatcgtaggacaccccggatctttcttcttctccgggagcttgtggagtatcaggttgctgcattgttccgtcagcttgaccacctccgttgttggcagcggtctcttgttgttgagtatgtccttgagataacgggcgtatgttggcacttgcatagcatccaacaacggcactttgatgtggatcttctggatcacaaaacgagcgaactgctcgtcctttcgttggggaaacagcagcaaccgtgtgtcgcagtactcctacggcacagtcttttccggctgaatctccttgtcagccgagtcgatagatggtgcttcttttgacatcccattccatggccttggaacccgtcgtaaacatgtgacataacccttcacccatcctagccgtgaacaaaagtaccgacccaaccctgcctacagccggtatcccgggacaggcaggccaggattgagccccgagcaacaggatctagaccgggtgcgccacacgcataggggtgagaccacccgcgtactagtccagtgccatggcatctcgactaacgggcaccgacccgtgtagtcttcatttgcctagatatctcgattaccgagccgcagctcgtttagccttcatttgccttagagatatccatcgtcgcaacgacttcatccatctctatccgtgtccttaatggcaacattggcacacgagggtgcgatgtttttgaccggaatcaaaaagttcaaaaacgccaaaacatgttttttggacattttggagtgtattgcgtgcgttcgtggcaaaaactcacttcgtgattcgcgcggcgaacttttgtcaattaatggcaacattggcacacgatggtgcgatgtttttgaccggaataaaaaagctcaaaaaacgccaaaacatgatttttggacatattggagtgtattgggtgcgttaatggcaaaaactcaattcgtgatttacacggcgaacttttatcaattaatgccaatattggcatattttggcccaaatgggggcgatgtttttgaccggaatgaaaaagttcaaaaagcgccaaaacatgatttttggacatattggagtgtatcgggtgcgttcatagcaaaaactcacttcgtgattctcgcggcgaacttttgtcaattaatgccaatattggcacacgaaggagcgttgtttttgaccggaatcaaaaagttcaaaaaacgccaaaacatgatttttggacatattggagtgtattgggtgcgttcgtggcaacaactcacttcgtgattcgcgcggcgaacatttgtcaattaatgccaatgttggcacacgagggtgcgatgtttttgaccagaatcaaaatgttcaaaaaacgccaaaacaagatttttggatatattggagtgtgttgcgtgcgttcatggcaaaaactcacttcatgatttgcgcggcgaacttttgtcaattaatggcaaaattggcacacgagggtgcgatgtttttgaccggaataaaaaagctcaaaaaatgccaaaacatgatttttggacatattggagtgtattgggtgcgttaatggcaaaaactcaaatcatgatttacacggcgaacttttatcaattaatgccaatattggcatattttggcccaaataggggcgatgtttttgaccggaatgaaaatgttcaaaaagcgctaaaacatgatttttggacatattggagtgtattgggtgcgttcatagcaaaaactcacttcgtgattcgcgcggcgaacttttgtcaattaatgccaatattggcacacgaaggagcgttgcttttgaccggaatcaaaaagttcaaaaaacgccaaaacatgatttttggacatattggagtgtattgggtgcgttcgtggcaacaactcacttcgtgattcgcgcggcgaacttttgtcaattaatgccaatgttggcacacgagggtgcgatgtttttgaccggaatcaaaaagttcaaaaaacgccaaaacaagattttttggtatattggagtgtgttgcgtgcgttcgtggcaaaaactcacgtcgtgatttgcgcggcaaacttttgtcaattaattgcaacattggcacacgagggtgcgatgtttttgaccggaatgaaaaagttcaaaaagcgccaaaacatgttttttgggcatattggagcgtattgcgtgcgttcatagcaaaaactcacttcgtgattcgcgcggcgaacttttgtcaattaatgtcaatatagctagttacccgttcagggtttctcgggttttgtttagatgaaagtttagccattgctacttccttgcagcgcgtgtgtcggctagactgtccgtctgcttgtattcggaaccccaacttatcatttgtattaaattcctttttgcaatatcagattgcttttatcttgttcttacttgtttcttcgatttgcttgcaggaatagggttgatctgcaccggcaagatcaacaacccacggagaggtgtatcgatcgctaaggcgcaacacaacgtctcgtacagttgtagtcggattgtcaacgtttctcccaaatcgtagttatcacaactcaccgaaagatcgggccaacaacagccttgagtgtcgagaggaactcagggttcttcaggtggtatcagagactttcgttgctcggtgagtttttttctacccataaccagaaaatagccatacaaaaaaatttgtaacatttacctagccatattgtgccattgcattgttctcttcagtttttgctttgttgaattttgtgttgcatcgtcacgtcgagctgctggttttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgtgttgcatctagagtttgcctatccttgtgtgtgtttgtttttgccgtgcatgtgcgcgtgaggaagaagggagaagatgcacatgaggaagatggaaggagaagattagactagattagattgctttcgtttctatttggggccacgcagaaaaggaatcggtttccttccttcagaaattctcaccgagtcccaccaccttccatgcggcattccccccttgagtccgactccctctcctttcggttcaatctacaccgtgccatccttacaccttggtgaatttttgtttggtgttcgtttcgatatccgttcagaaaaacggaaccagtataaattcagcattccattttgtataattttaattttggttttagacttttacatttgagtcactgtaaattttatatttatgtttgagtccctatagccttacattgaggtcctcgaatctgattttgtaaaataaaatcaaaaaaaaagaaagaaaaataggcagaaaggtgcataaaaaaagaaaagaaaagccgcacccaaaaaaaagaaaagaaaaggaaaggaaagaaaagaagaaagaaagaaaagagaaaaaactgttatgtttgagagctgaacttcatatatcagagttgtgcatgagttgttcctagtgctgagtctgactccctccctctcacgtcggtttcgcctgttccgagttgtgtcaaacacgttggtgaatttttgtttcgtgtcggtttcgagatccgtttcgaaaaacggaaccagtataaattcagcattccatttttgtataatttttaattttggtttggacttttacagttgagtcctagtaattttcatatttacatttgagtcccggtaatcttgcattgaggtccttgagttgtttttgcagaaaaaaaaatacaataaaaaaagtaagtaaggaaatggcaggaaggtgcataaaaaggaaaaagaaaagaaaagccgcaccaaaaaaaaaggagagaaaaaaaagaagaagaaagaaggaagaagaaagaaggaaaaaaaatcagttgtatctttgagctgaacatgatctatcagagtgtgcctaagttaaaaaaatcagttgtatctttgagcagaacatgatctatcagagtgtgcctaagttgtttctagtgctatcctgtggtatcgtttgtgtctaggctcgcgtctctagtacattctagcctaggaccagcacggtgcttgactttgaactttttcattccggtcaaaaacatcgcacctatgtgggccaatatatacaaatattggcattaattgacaaaagttcgccgcgcgaatcacgaagtgagtttttgccacgaacgcacccaatacactccaatatgtgcaaaaatcatgtcttggtgctttttgaactttttcaatccggtcaaaaacatcgcacccgtgtgggccaaaatatgccaatattgacattatatgacaaaagttcgccgcgcgaatcacgaaatgtgtttttgccacgaacacacccgatacactccaatatgtccaaaaatcatgttttggcgttttttgaacttttggattccggtcaaaaacatcgcaccctcgtgtgccaacattggcattaattgataaaagttcaccgcgcgaatcacgaagtgagtttttgccatgtatgcacccaatacactccaatatgtccaaaaatcatgttttggcattttttgaactttttgattccggtcaaaaacatcgcaccctcatgtgccaatatttgtattaactgacaaaagttcgccgcgcgaatcactaagtgagtttttgccacgaacgcaaccaatacactccaaatatgtccaaaaatcatgttttggtgctttttgaactttttcataccggtcaaaaacatcgcaccggtgtggtccaaaatatgctaatattcgcattaattgagaaaagttcgccacgcgaatcacgaagtgagtttttgccacgaacgcacccaatacactccaatatgtgcaaaaatcatgtcttggtgctttttgaacattttcattccggtcaaaaacatcacacccgtgtaggccaaaatatgccaataatgacattatatgacaaaagttcgccgcgcgtgatgtgaccatgactactatagatacaaccgtcgttcacatcaagatcaagccgtccaagttctacaatccagttcggccacctgcaacagaatcgacttcagacggccgccaaatatgcatgcgagctccgttttgggtccatgagtacttgatggaaagctctcggagtcatctttcaaatggatccagcttcatcaccaaattccatcccagtcggccgaaatcacaaaaagaaggtgctgcgtcacctacaatgggcttgtaacttcgtctgggaccccggcccaagtggggcccaagtggggtgcgccccaaccaggtggagcacgaccctagggttcccttaggtcgtcctcccaccttcttaaatagttaggttcccctttagagtttctcggggttttgatagattaaagtttagccattgctacttgcttgcagcgcgcgtgtcggctagaccgtccgtctgcttgttcttcggaaccccaacttatcatttgtattaaattcctatttgcaatatcagattgctttttatcttgttcttgcttgtttcttcgatttgcttgcaggaataaggttgatctgcaccggcaagatcaacaacccacagagaggtgtatcgatcgctaaggcgcaacacaacatctcgtacggttgtagtcggatcgtcaacgtttgtcccaaatcgtagttatcacaactcaccgaaagatcaggccaacaaaagccttgagtgttgagaggaactcagggtccatcagcgcgaatcacgaaatgtgtttttgccacgaacaatcccgatacactccaatatgtccaaaaatcatgttttagtgttttttgaactttttgattccggtcaaaaacatcgcaccctcgtgtgccaacattggcattaattgacaaaagttcgccgcgcgaatcacgaattgagtttttgccatgtatccacccaatacactccaatatgtccaaaaatcacgttttggcgttttttgagctttttgattccggtcaaaaacatcgcaccctcgtgtgccaatatttgcattaactgacaaaagtgcgccgcgcgaatcacgaaatgagtttttgccacgaacgcaaccaatacactccaaataggtccaaaaatcatgttttggtgctttttgaactttttcataccggtaaaaacatctcacccgtgtggtccaaattatgctaatgttggcattaattgacaaaagttcgccgcgcgaatcacgaagtgagtttttgccatgaatgcacccaatacaatccaatatgtacaaaaatcatgttttggtgctttttgaactttttcattccggtcaaaaacatcgcacctgtatgggccaatacataccaatattggcattaattgacaaaaattcgccgcgcgaatcacgaagtgagtttttgccacgaacacacccgatacactaaaatatgtccaaaaatcatgttttggcgttttttgaactttttgattccggtcaaaaacatcgcaagctcgtgtgccaatatttgcattaactgacaaaagttcgccgcgtgaatcaagaaatgtgtttttgccacgaacacacccgatacactccaatatgtccaaatatcatgttttgttgcttttcaaaatttttcattacggtaaaaaacatcgcacctgtttgcgcgaatatataccaatattggcattaattgacaaaagttctccgcgtgaatcacgaagttagtttttgccacgaacgcaccaaataagctccaatatatccaaaaataatggtttggcttttttgaactttttaattccggtcaaaaacatcgcaccctcgtgtgccaacattggcattaattaacaaaagttcgccgcgcgaatcacgaagtgagtttttgccacgaacgcacccattacactccaatatgtccaaaaatcatgctttggtgctttttgaacattttcattccgatcaaaaacaacggacccgtgtgggccaaaatatgccaatattgacattatttgacaaaagttcgccgcgcgaatcacgaaatgtgtttttgcgacgaacacacccgatacacaccaatatgtccaaaaatcatgttttggctctttttgaactttttgattccagcagaaaacatcgcaccctcgtgtgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccgtatgggccaatatatgccaatattgacattatttgataaaagttcgccacgtgaatcacgaaatgtgtttttgccacgaacacacccgatacactccaatatgtccaaaaatcatgttttggctctttttcaactttttgattccagtagaaaacatcgcaccctcgtgtgccaatattggcattaattaacaaaaaatcgccgcgcgaatcacgaagtgagtttttgccgcgaacgcacccaatacactccaatatgtccaaaaatcatgttttggctctttttgaactttttgattgcagcagaaaacatcgcaccctcgtgtgccaatattggcattaattgacaaaagttcgccgcgcgaatcacgaagtgagtttttgccacgaacgcacccaatacactccaatatgtccaaaaatcatgttttggttctttttgaactttttgattccagtacaaaacatcgcaccctcgtgagccaatattggcattaattgacaaaagttcgccgcgcgaatcacgaagtgagtttttgccacgaacgcacccaatacactccaatatgtccaaaaatcttgctttggtgctttttgaacattttcattccggtcaaaaacatcgcacccgtgtgggccaatatatgccaatattgacattatttgaaaaaaagttcgccacgcgaatcgcgaaatgtgtttttgccacgaacccacccgatacactccaatatgtccaaaaatcatgttttggctctttttgaactttttgattccggtcaaaaacatcgcaccctcgtgtgccaacattggcattaattgacaaaagttcgccgcgcgaatcacgaagtgagtttttgccatgtatccacccaatacactccaatatgtccaaaaatcacgttttggcgttttttgagctttttgattccggtcaaaaacatcgcaccctcgtgtgccaatatttgcattaactgacaaaagtgcgccgcgcgaatcacgaaatgagtttttgccacgaacgcaaccaatacactccaaataggtccaaaaatcatgttttggtgctttttgaactttttcataccggtaaaaacatctcacccgtgtggtccaaattatgctaatgttggcattaattgacaaaagttcgccgcgcgaatcatgaagtgagtttttgccatgaatgcacccaatacaatccaatatgtacaaaaatcatgttttggtgctttttgaactttttcattccagtcaaaaacatcgcacctgtatgggccaatacataccaatattggcattaattgacaaaaattcgccgcgcgaatcatgaagtgagtttttgccacgaacgcacccaatacactccaatatgtccaaaaatcatgtttttgtgctttttgaactttttgattccagtagaaaacatcgcaccctcgtgtgccaatattggcattaattgacaaaagttcgccgcgtgaatcacgaagtgagtttttgccatgaatgcacccaatacactccaatatgtccaaaaatcatgttttggcgttttttgaactttttgattccagtagaaaacatcgcaccctcgtgtgccaaaagttcgccgcgcgactcacgaagtgagttttttgccaagaacgcccccaatacactccaatatgtgcaaaaatcatgtcttggtgctttttgaactttttcattccggtcaaaaacattgcacctgtgtggggccaatatataccaatattggcaataattgacaaaagttcgccgcgcgaatcacgaagtgagtttttgcgacgaacgcacctaatacactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccatgaatgcacccaatacactccaatatgtccaaaaatcttgctttggcgttttttgaactttttgattccagtagaaaacatcgcaccctcgtgtgccaatattggcattaattgacaatagttcgccgcgtgaatcacgtagtgagtttttgccatgaacgaacccaatacactccaatatgtccaaaaatcatgctttgatgctttttgaaaattttccttccggtcaaaaacatcgcacccgtgtgggccaatatatgccaatattgacattatttgacaaaagtgtgtttttgccacgaacacacccgatacactccaatatgtccaaaaatcatgttttggctctttttcaactttttgattccagtagaaaacatcgcaccctcgtgtgccaatattggcattaattaacaaaaaatcgccgcgcgaatcacgaagtgagtttttgccgcgaacgcacccaatacactccaatatgtccaaaaatcatgttttggctctttttgaactttttgattgcagcagaaaacatcgcaccctcgtgtgccaatattggcattaattgacaaaagtttgccgcgcgaatcacgaagtgagtttttgccacgaacgcacccaatacactccaatatgtccaaaaatcttgctttggtgctttttgaacattttcattccggtcaaaaacatcgcacccgtgtgggccaatatatgccaatattgacattatttgacaaaagttcgctacgcgaatcgcgaaatgtgtttttgccacgaacccacccgatacactccaatatgtccaaaaatcatgttttggctctttttgaactttttgatttcagtagaaagaatcacatcgtcgtgtgcaaaaattggcattaattaacaaaagttcgccgcgcaaatcacgaagagactttttgccatgaatgcacccagtacactccaatatttccaaaaatcatgttttggcgtttttgaactttttgattcctgtcaaaaatatcacacccgcgtatgccaacattggcattaattgacaaaagttcgccgcgcgaatcacgaaatgtgtttttgcgacgaacacacccgatacacac

SEQ ID NO: 40501 - DNA, 1755 bp, Oryza sativa
aaataagctccaatatatccaaaaataatggtttggcttttttgaactttttaattccggtcaaaaacatcgcaccctcgtgtgccaacattggcattaattgacaaaagttcgccgcgcgaatcacgaagtgagtttttgccacgaacgcacccattacactccaatatgtacaaaaatcatgctttggtgcttttcgaacattttcattccgatcaaaaacaacggacccgtgtgggccaaaatatgccaatattgacattatttgacaaaagttcgccgcgcgaatcacgaaatgtgtttttgcgatgaacacacccgatacactccaatatgtccaaaaatcatgttttggcattttttgaacttttttattccagtagaaaacatcgcaccctcgtgtgccaatattggcattaattgacaaaagttcgccgcgcgaatcacgaagtgagtttttgccacgaatgcacccaatacacaccaatatgtccaaaaatcatgttttgttgctttttgaaatttttcattacggtcaaaaacatcgcacatgtttgggccaatatataccgatattggcattaattgacaaaagttctccgcgtgaatcacgaagttagtttttgccacgaacgcacccaataaactccaatatgtccaaaaatcatgttttggcttttttgaactttttgattccggtcaaaaacatggcaccctcgtgtgccaacattgacattaattgacaaaagttcgccgctcgaatcacgaagtgagtttttgccacgaacacacccgatacacaccaatatgtccaaaaatcatgttttggcattttttgaacattttgattccggtcaaaaacatcgcaccctcgtgtgccaatatttgcatcaactgacaaaagttcgctgcgcgaatcacgaaatgtgtttttgccacgaacacacccgacacactccaatatgtccaaaaatcatgttttggcttttttgaactttttgattccggtcaaaaacatcgcacccgtgtggtcctatatatgctaatattggcattaattgacaaaagttcaccgcgcgaatcacgaaatgagtttttgccacgaacgcacccaacacactccaatatgtgcaaaaatcatgttttggtgctttttgaactttttcattccggtcaaaaacagcgcacctgtgtaggccaatatataccaatattggcactaattgacaaaagttcgccgcgcgaatcatgaagtgagtttttgccacgaacgcacccaatacactccaatatgtccaaaaatcatgttttggtgctttttgaactttttcattccggtcaaaaacagcgcacctgtgtaggccaatatataccaatattggcactaattgacaaaagttcgccgcgcgaatcatgaagtgagtttttgccacgaacgcacccaatacactccaatatgtccaaaaatcatgttttggtgctttttgaactttttgattccagtagaaaacatcgcaccctcgtgtgccaatattggcattaattgacaaaagttcgccgcgtgaatcacgaagtgagtttttgccatgaatgcacccaatacactccaatatgtccaaaaatcatgttttggcgttttttgaactttttgattccagtagaaaacatcgcaccctcgtgtgccaaaagttcgccgcgcgactcacgaagtgagtttttgccaagaacgcccccaatacactccaatatgtgcaa

SEQ ID NO: 40502 - DNA, 1784 bp, Oryza sativa
tttttgtagttaaattccattgaaatcaattggtattgttgtatggctaatactgtccatcacaactgttgtcttgttacatttatcagttgaagctacatgtgaccaaattctttgtagaaaaatagctgtatgatagatgtcagtgcagattttgcctttatctccgtgctgcctcatgttcttaatattctccctgctcttacaggtatttgatttgtttgacacaaaacacaatggaattttaggatttgatgaatttgctcgtgcactctcagtatttcatccaagtgctccacttgatgagaagattgactgtgagttcagacgtactgtagctagatattttactcctcatctatgcagttctaaattatgtattgtcacaataatggcttggagcttatttgcaaaagtatttattgtagacttaaagttgatagtctgacttctatgctgtcctccaggttttctcttgtttacttatcttttctcaacaaaaaattctgaagaagctatgcaatttttgcagtttcattccagttatatgatctcaagcaacaaggctatattgagagacaagaggtattgatgccaaattactcattgcacagtgctccttcaagctagcatgttggcttgtctatatggctcacacacttcgattaattcaacattttcttttattgtttctgatacatgaaatcgtggttttattcatgtaactattctgtacttgatggtctatatttgttgttttgttatggcatactgcagaaagaaatgtcattttttcattaatactgtcagatcactgtcgttgaattttacaagattttaaatcacgtagtagcagcaatagcttaatcatgtgcgtttaggtgagttaggttttgattccaatgaattgcactgggctttgttgctgagagatgatgactatatctgccaatctttaaatagctgatatgccattatcaaagctaaatattttaaatagttttgttgtggatgtcattcttttgggtaggatatttccttttacttcatctatagtttataaaattgatttatcaggttaagcagatggttgttgctacacttgctgagtctggaatgaatctttctgatgaaattatagagagcataatcgataaggtatgttacggtttccatttatattttgttgtgtttggttataccctgtattggatggtatttttttagttggtattttgtggtaatcagtaattctcagcctgcttatataggtcagacttttgtatagcctagccttatcatactacatatatactgtatttactttgcaaatgaaaaactgcatcggtatgtttccttattatataagatgttggtaaaaaaaacattgaacttcttggtgaaacatagtaagaaatgtgccaatttgtaacaataagatgacacgtactaaaagaactataaatgtgtaatattatcatagtattttatgtataaatttactcttcattttcatccaaattatatattaatatattatagacaataatgttcgcacaaattattgtggtttaattagatgtgttctggatggcactatttttaaactgatagaagtaatactgattttgtgctattacttttttttaatagatagatatttagatgacatatcctcaataggcttggcataagatatggtcagtttatcttgtttctttttaattgtaacttccaatgctaaactattttttcttatttgtagacatttgaggaggcagaca

SEQ ID NO: 40503 - DNA, 1385 bp, Oryza sativa
agtaaatagatacctgatcacttgaacttgagctttgatggtaagaacatcatcaacaacaaagccttcatgtaatttggttagctccataaattttttccatccccaatcatgctctttcttccaaaaccggtgcagtgtatctgaaatattaatttctttaaatttcacattaagaattcaagtgaaattacaagaaaatcaaatagtgtaccaaactcaccagaatacttggatttcttagggtctctattaattacagctatggtaaactgtgcaaagtgactccatcctgaaacataagcaagccatgcaaaggattacgtttctgccgtcaaaaaataaaagcttatcactgctggaggcatctacctgggagcagcttatcatggttggctacacaaagaaagagtgacaagtgattgcaaacatcacatccttgtgggtaaatcaagatgtacctgaaaaatcaaccaatagatctcaaaattgtggtgcacaagtaaatcttaagcctgtacgatctcaaaatgtggtgcatccgcctatcaattagtaaacatgtaccaatgaagggaaaaaaccattaataaaaaatgttaccacctattgaacagaaaccaatagaaacagaatagataaatatatcatcccttaattctgtgtaattgcgtatgtaaatgaaataataaggtaaaatagcatccagaagacagaatagataaaagaaaaatgcaatgtactacagaccctagaaagtgttctaaaagtcggcgctaggcgccgcctaggcacccattaggcgctaggagccaggtagctgccgcaattagacattaggtggtgttttattgctattttagtgtgatatagtctagtttttatgtaatatgctggctaatttcttaggtttggctaattggtctgacctgggtgccccctaggagccgcctaggcagggcctaggcaccaaataggcgctaggctccacccagccactgactagcgccttcttgaaccatgccatagaacaaatagcgcagttttatatagaaaacaactatatcttaagacaaaaaaaactaattacatgacacatatcaaaatatttaggtataaaatatctgtatttcttgtgatctgtcacgttttataatacaatatcttttctctatagcactacaagctcaaatggtcatgtcagggaccaagtacggcttaatgaactggtatgaagttgctagtgggtagttagagagtgcctctaaaagggcgcaaggaaaatgtgatatcttatgcactcatttttcaacaacttatttgtacaaaggttgtgcttagtattgtgaatggtctaccctaagtactacaaccactaattcgtt

SEQ ID NO: 40504 - DNA, 2081 bp, Oryza sativa
tcttgttaatttgggaaaaattatcaatcctccaagtgaattttccataaagctcagaaggccttggccctaataaaagaaaatgaaaacaacaaggactgaagcacaaatatgaggaaatcagtaaatattagaaggttcaattatcacaaacattaatccagtagaatcctcaaacaggtaatgcattaattatatcacttctcaacaccgtagttcccaaagctggattttgactaggaggtctaggcgggagggtgccatcaagtgccaaagcatctgccttttattagacttactagttgaactagctgtcatgagatgttgtatagccattgaattttatttaaaaactgctgtaaaattatcgagaggttattgtaacagggtaatatagaaacaccttgctaataaatatgcatttgttgtagcacatagaagcgacgtaatgcagaaccctatttacaattatggaatgtgatggagtgttggcgggtcggaggaacccccccccccccaacacacacacacacacacacaaaaaaaaaatcagaagcatgggaagatatttgattcctatggctgtacatactagataactgaaaagaacaatatttttcatggttcttccacaatgatacattaggtatttaggccggctgggcaataaccactagtatggaaagatcttaaaggtaatgcattaagcagaaacaggaaataggaaagcgaattaaagaacgaaccacaatcatcatcatcactgtccgagtaagctggagaagttgatggtgttccattctcaacttgctcgctcgatctccattctgctaaagattccccagaatgactttgctgatcgcttggcaactcttcagttgacgaggatctaccatcccctgtatagtcctcaatcaaagtaccagccatgaatcaatcttcagggaaatgcagctcagctatccgcctcaccctttttgcttctataatagtgaaccaaaagccatcaaagttcagcttcaacgtgcgctgacaccacaaaatgagaaatcaacagaggtagacctaaacctaaccctcgggaacacaacagctaacagcgagcaggtgctatgcttcactagtttgccagtaaaacctaatacatcacatatcaagcaactgcaagcgactaatgtatacggaacccgaagtaagacattgtggagcacaaaggaacagagctgacatgagatcgatagtgtcctaaggtgctatcatataaaaaactacaattctgataccatataaaacttataattctgatatcatgtagaaactattataattccgaaacaccctagtcattagggcgccgctactgtcatataaaaccacctctaattccaacccaacgatctactttcggccgcgagaagagtaaaacctaagcagcattaaatcatctacgtcgaagttacccatttctgttctgttctttcaccctaggccctatatgcaacaactaatagaaattacagcgcgggcaagcaacgagcaaccatcccgatccaatcaaacaacgcccgccacgcaaggatcgcccctcgtccaatccaacgcctccccgggaaatgaacgccacaccgagagagagagaaaatgatagattacgcggcgcaggagacagatcgggacctcacggtcgggcaatgcctcacctcgccgggagcccccccacgaatcgcgccgccggggcacctcctctccccgcgtcgtccggatctgacctcgccaacccccctccgcccgttccaatcggggagagacctcctccctctcgctcgcccgcccacctcaccgcgcgggagatcgtcacctcctcgtcctcctcggcgtcacgcggcggcggcggcggcggtggccggggcggaggaggagatagggggggaatgggaagagatggaggggaagcgagcagcgtggtgcgtgcgccctagtcgagtcgaggagggtgtgaggatttttggcttctcctctctctctctcacacactttttttttcctgtcttttttttttgtttgagttgaataatcggatc

SEQ ID NO: 40505 - DNA, 2819 bp, Oryza sativa
taatctatctattattaaaatgatgttttttcatgttgcagtttcaatgcattctggctaggaatggatccaagtgtgcagaaatatatgacaagggaaaagactgacactgtattgaaagttctagtgaaacatttttttatagagaaggaagttacatcaaccttagtaatggactcactatatagcggactaaaggctcttgaataccagaccaagaataaaaagggggtgcccaagctagcagagactgtccagatggatattcgaagcactcctatggtgcttgttgatcaggacatgtttgtcttggccgatgatgtgatacttttgcttgaaagagctgcattagacactcttccgcatcaacctttgcctacaaaggatgataaaagctcacagaaccgcacgaaggtatgcatgatatcagcaaccctgtacagctagtttattaatatttcttattatggacaatcaatagatataagactgaaatttatttttcatatccaacttagaattaatagcaaattccttcatggttcacgctggtctcaattatttgcactcattaaattattaagaattccttcatcatactggtctcaaagatgtcttagtagctgtagtcttaaatgaggtatggactagaaaaagaaaaggttctctttactacttttggcttgatgagattttattttatgctactgtaataagtcaagtaaattgtgccttatgtggttgcaggatggcagctcaggtgatgatttcaacaaagattcaattgaacgtgatgataaacgacttgtagagcttggctggaagacactggaattttttgccttggcccatatattcaggtaagagatttgtttaatgtgtccatccagtattagttttttttttgctccataaacgttcaattacagacagtttgttaagaagttgatttctagcccttgatggtacagttgacatgctttatttctgttacttgaggctttagtgcataaatgcaagatgctatttcctagttggcatttgtggcaagacatgtcacttctgttatcagactcttttttaatctatatcttgatctgaattagttcttccttcggttgtcttgtattctcaccttataagtcttgtatcagccgaatagaagtggcataccaggaggcagtggctttgaagcgccaagaggagctcattcgtgaagaggaagctgctgggcttgcagaaattgaacttaaggcaaaacgtagtgctgctgagaaggaaaaacgcatcagaaaaaagcaggtttgtttctctttcttgtgcaatcttgctaattcatgctgcctatcaatttttttttcttgtgctaaatttgatgtaaactactttctgccacggtttaccctggccttgtgtggtcgttattttgtgtgtgaaatgggattatcaaagattgtattgttgtaaacattacaatagtattattggctgcatatgacataatgagcactattgtcttccactttgcctaggctaaacagaagaaaaacagtcggaaaaataataaagggaaaaatgagaaggttgatataaaggaaatagtaatagagagcagcagcccaccggatgataggatcctggatgatctctcaagtcaagcagaagaaataacatcaaatgcggacaaccctgaagaagtgtctgatatctctgataacagagatgatagttctgagttgcttcataacgaccttgaagacagtgaatccagtcctgttaattgggaaacagatgcttcagaaactcaagctactgtgcctgaaggtggtgaaatgaaaatgaacatgcaggaaagaggacttctttcctggatgatagctcatctacttgttcatctgattcagttccttcagttatcctgaatactggaggtgcctggacaaatgtcaaatcctcatcaaataggtatactttgatttttagcatgttcccacttctgtcaattggtatttatggcactgtattttgtgactcagaggaaacaacaggaggaataacaaggatcatgatgcacgaagtgggcttggacatggtgggttgaattcagtgccaaatggtattgccggatctagcagtagtacttctgttaactcaaaagaccaccaacatgaggtatgccatctatcttaaatgtcttacatagtgacttctgtgcattcattgggaaatgcgccataaagcagctgctatagaagaatggtcttttcaattgtacttatttctccatcaatgtattaagcatcgcaattgattgagtaataaacatataaaattactatttcaggatgacagagttgtatcacagaagaagcaaaatgcacatcggcagactgatgtcatgagtccgtccaagttaagaatgacagagtcttctgtcagccctattaagaagcaacacatcttttcgcagcagccaaaatcttcattagaaagcgccaataacttgagttcccgtgcaagtgaagcttcaggtgctgtgactgctagttcagtaatgggtgtcactaccactccaactgctcagttagtttcaaataaaggacctctgacaattcaagcaacccataatgagaggtcagttccagttgcacgacatccgcaggtgcctacggtctccaaatctgaagctcagaagcagacttccctggtaagcagtggtacagcaacccaggcaattacagtatcgaggcccttgagtgctccacaagtccctgcagcaaaacaaacagcacctgtggcttcagcagttcaaactgtac

SEQ ID NO: 40506 - DNA, 10217 bp, Oryza sativa
ctatcaccagagcacctgattgggaatgacagatcatcgttgcgacaagggttgacgtttggaactgtcaagcctgagacactcaaccagtggagagaagagagctctcagcaggcaagcagcagcagcagtagcagcagcaatgatcatggggcagtaagctcaagcaatggaggtgagtttgagaagttttatttgtttggaaagccacggagcaagcaactgtcagaaatttctgccagatctactccatttcaaccacaaggcctggtcagtgatgagtttccgcacctagacataatcaatgacttgctaaatgacgaacagtgtgaaaggcgaacattaaaggttcttcagcggagccaacaggcatttgctcgacaatactcgatgcccaataattccagcacacctgattatggcatgtttgctcaatctgatccatacctgtttgatcaacctgagcaatactatgacgaggaaatcccaaggttctataattctttgaacggtacttctcgggggctaagggagaggagttattcgcattttgatctgccttcatactccaacggccagtttgatgatatgatgatgaaccagtggccatacggccaaacagacctctccttgccaaattttggggcagatatgaatggttacccatatcagtcaagtgattatccgaattccgcaaatgggttaagcaggtacccaccctatcgacctgccaatgggcattgagcacctctaatgattagtgattgcaattcacaataatgtgttgtaatctcatgctgttttcttctgagctgagtgtaattgtaatccttccctatagttttataaagaacggctcctcagttccttattcaatagctatatttctttgctttctacattgttttttacccgtggtaaagaatctaaaatcagtcgtatacatgcatacaatctgggttagcctttcttcctttctatccatgtcctggagtcgatggcatatggtgaacacctcaatcgcaggcagactaatttgagcctttctttttcttcctatagttgcggtttagtttgtaattccaatctggatttcatggtctgcaaaagcatttgttcatggccagataaatttgttcacagtagaaaagtttagcaaaatttaaaatactaaattattttttattgaatctgcattcaatatattttaataatatatttgttttgtgttgaaaatgatattatatttttctataagcttggtcgaatttaaaataagtttgacttaaaaaaagttaaaacaacgtataatatgaaacataatatgaacagagagaatttcttttctagttaaactttgttaagtttgaccaagtatatagaaaaatttaggaacatttaaaatccaaattagtttcactaaatataacatagcaaaaattttaataatatgattgttttgtgttgaaaatactaatatagttttatataaatttagtcaaactagtttgattaggaaaaaagtcaaatgacttatataatataaaatggaagaagtattttaataccttttatccatccattaatattattttcctataaataagggacactttgtttattttatccctacaactaaagttgtcttgggatgggatgctaagagtggatttgttttaggagagaggaagtagctacgagctttcgtagttttaccgaaatatcagtaatatattttttttcattaaaccaaatgaaactattcatccattgacattgccaacatttctatagggtcagtttggacaatgaaacaaaccaaaacatgccttcttactcatgtgccctccaaatagacgcgattggactttaattgccgtcagggattttaattccgaaaaaaacaaaacaaaataaaaagagtttatcacttttccaaaaaaaccaaaaaaaggcaagaactgaaatgaccaaaatgcccccttacctcaacatacttaacattctcaaatatgctccacctatctgtggacacaaatatatcttgtgtgacaccagagggattataaatctcaactaagcaattttttttaaaaaaagtttctttttcttataataaaaaagggtgacaactgaaatgaccagaatgcccctccgtcctaccccacaatctgttctgtttcttctctccttccctcacctctactctcctcctcttcctcccccatctctctccaaatctctctccgatctgtagccgaccaccgccgccgcggccgccggccttctccccgccgccgccgccgccacctcgccctcatcgctgcgcgctcccatccccaccgccccagcgagcagctccggaggggcgcggcgcagacgcccctcccctctcccccgagcatcccatcccatcccctcccgaccgtgccctagccttctccccccatcgcgcttgcccgcacgggcggcgagcacggctaggttttggagtgggggcgacgccgacgccgacgccgacgcggcccgcggtctagttcttccttccatcggcgtccatccatctcgtctcgcatcgaattgaaggtattcatctttttcacctctcgtattggggattcatccgggcttgggaattgggttgtatacttctacccttccgtttgattcatccgggcttgggaattgggttttgcccggattactttgatttggtagtactgacataatttttttttaattttcaagagggatttgggggttcagctgaaccccctccatgccgcgcgacgctaggtcagtcactggttgccaggagatactcggagcagccgtgaattgctgatggccaaccacgacttggttctcggccatggcgaggaccccgagctggcgctggggcagaatcaccatgactttgggcaggaccacgggctagggctcggccacagccatgagctcggcctcggccacgcgcacgaacatgatctcgtcctcgggcagtcgcacgagcacgagcacgagcacgaccatgatctgggtctcgggaaccaccacgacagccagctggtcctcgcgcatgatcaccacggccacaccagtgagctcgcgttggggcatggccatgatgaggacccgcattccttggatggtcaggaccatgatgggcttgccatgacggagaatcacgtgctgacgctcacagatgcgcatcagcttgacgtcgaccagaatatggatcagctttctcttgagcaagcccacgagctcgctcttcagccagcccatgacttctcgcacggccctcttgcggttgcccctgttgttcagtcgcggaagatggtcgtcagctccgagtttcagcttgtggtggggcaggaattccctgatgtcatgagctgccgcagggccatccgcaacaccgccatcgcctgccactttgagatacagacggtgaagtctgacaagacgcgcttcactgcgaagtgctctgctgacggctgcccgtggcgcatccatgctgcaaagctccctggcgtgcccactttctccatccgaactatccatgacaaccatagttgtgtgggaataaaccatctaggccaccagcaggcatctgttcaatgggttgcaaatactgttgaggagaggctacgtgagaacccacactgcaagcccaaggaaattttggaagaaatccacaagtcacacgggatcacattatcctataagcaagcatggagagggaaggagcggatcatggcagcagttcgggggtccttcgaagaagggtatcggctcctgcctgagtactgtaggcaagtggaaagaacaaatccaggaagcatagctcgtgtctatggcaatccagatgacaactgctttcggcgactcttcatatcattccatgcatcaatatatggttttgtgaatgcatgccgtccgctcattgggcttgacagaaccattctcaaaaacaagtatctcggcaccttgtttcttgccacaggtttcgatggtgatggtgccctgtttcctcttgcatttggtgtggttgatgaggaatctgatgagaattggatatggtttctgtctgagctgcatgaattgctggagaagaacacagagaatatgccaaggctcactatattgtctgatagacgcaagggaataatcgatggagttgacttcaacttcccaactgcattccatgggcattgtatgcgcagtctcagtgaaactttccgaaaggagttcaataactcagtgcttgtcaaccttctctgggaggctgccaatgcactgactgtgatagaatttgaaaccaagttgctagagatagaagacacgtccccagaagctgtttgttggataagacgcctacctcctcggctttgggccacagcttactttgaggggacacgatatggtcacctgacagcaaatatcacagaatcactgaattcttggatactggatgcctctgggcttcctataattcagatgatggagtgtatccgacgccagctaatgacatggttcaacgaacggcgtgaagcaagtatgcagtggacaactatcctcgtgcctgcagcggagcgacgggtgcaagaagcaattgagcgtgcacggggctaccaagttgcccgagccaatgaggctgaatttgaggtcatctcgcctcacgagggaactaacattgtggacatccgcaacaggtgttgtttgtgccgtgggtggcagctctatggtgtgccttgtgctcatggtgtggcagcgctgctttcctgcagacagaatgtccaccgttatacagagagctgcttcaccgttgcgacataccgcaagacatactcacagacgatccatcctatcccggacaaaaccctttggaacgagacgtctgatcaaggccaagaagaagagaacaaggtggatgtgatcatcaacccgccaaaatccttgaggcctcccgggaggcctaggaagaagagaatccgtgcagaggaccgtgggcgaatcaagagggttgtacactgcagccgctgcaaccaaacaggccatttcagaactacatgtgctgctcccatatgaagaagccaatgtcggagttctgaagtagctgcagttttcctgtgaaaagttagaagttagagtctactccaccattcaaacttcctctttgcagatgggcacctttggttatactagatactgcttttggtttaggtgtaatttaataatgttgtgacaatactatgtgttcaaatcatatgccatggtggacctgcatgtcggcctcagctcattggatcagaccaaatcatatgagctggtgttgagtgaaaagtaattagcttaacctgctgcaaagtgaaattattttgttaaacctagtgcaaagtgcatgcaattttattgaaatatcatgtgctcaaacatgatgagtaccgcaccaaatatgtgatactcttgatgttacatcgcaagtatgactcatcgattaacctgttgtttatgtaatacctgttcactctgtacctttctgcactttcctttttcctgtagctgtggattgctgtaattgtcttgctctttcctgtagctgtgattgctgtgtactgctgatctgtctatctgtcttcctttttcatgtagctgtgattgctgtgatgctgcattttgccttgctcttgcctgtagctgtggttcctgtgcgatgctgcatttgcattgcttcatgtaattgtgattgcagcataatgctgtattggcattggctattttgttcatgaagtaacactcttattcgaagaaataatttcacaaggattttcctgggaacagtacaactctttcaagaatattatatatatatatagccttccaaacatccagatgtacttccaaacaccaggtagatgaaacattcgaagagcttcaaaaatttctacatatacatggttgatatacatttttgcggtttacaacatacacgttctgtgcaacaaaagaatcagctcatcatttacatgctacagaaattaccagtacagaactaacaaaagaaaaatcatgtgctcggtgttagctgagcttcagctacatgcggtttctgactctctaaacctgggaactgaccaatatcatgaccttcaacctggctcaagttctcatgcaaaccaattgcaaactcctctggttgttcaccactgcttgcaaagtagtcagcgatctgcattgtaaaattaggaacaagaaatcaccatttaaacgaaagaattcatatatagaatcgagttcataattaatttgttcactgctagattcgagatgtgctatagattgcagaaacaaagagcatatgaaggcaatatatttacatggtttgcaagagacattccgcttaacacagccgcttctatgcttgaacctgttagccagtcaccacagatgcctgctctcccttggggatcaaatatgcatgggactcctggagtgttcattggtagagctgcacccctgtgtttcaggcatttgaattcataatatgattgtgtttacacatgatgaaatggtaaacagatacaagaggctcaaggcatgcgttgttgtaccacaattgtactctcgtgtaaaatggttgctgaagagatcctcttgatagccctaaagcaagctctacacctctaagcatgtcttccttcaccttttccgccgtgatctttggaatgttttcctgtcatcagtgataaaatacattctaaagtattcaacagtacaaaaaaagggggcaaaaaggccttgaaaactctatcttgacatgtattcttttaattaatgtaacaatgcgtagttccatgcaactgatgatataacaaaagcgaaatccaaaataactttcagcaaataatccacctgcggaactttgtttctttttccataagcagcagtgctgaaaaatgtccagcactcgggtctgccagtctgcaaggggaaaagtttctgagtattgttggccatccaagagagagaatcaacatctttcacaaatgctccttcaaatgttccataagaatcagtttgtggaattggtagaggatcttgaaatgccgcgaggagcgcccagacagaacttagctgtaatctctgagcatagagggtataaaactcagtaagaacgaacttgtaagaagcggatatatgcctcatgagttcaaagtttgttccggcagtaaaccttcatttgtcttgtcagcagtggtagacctgatgtagagagcagacgattggcacatttccctgattagcgagtagaaaagtgaccggaaatatgatttagtccgaaagaaaagttagatatatgatatgcttcttgctaaaaaaagttaaaaaatacaagacaatgacatatgcagcgaaaaaaatgcatatggtcaggggcgaatccacgttagtccaacacgatgcacaggacaggttgaatttttcgttttcatttgtgatagccgatgtacatgcattgggacaccacctagccggacacccagagcccaagctagtcagcctgcaagcaacaaaataacaactttgtatgtctttttagtttttacgggatattgtagttggatacttatattttgctataaacattgtaagtaacattgataatcgttaaatacaacgctgctttttttattattattttgagcattgtatagatttggttgtgatatattatgtagtgtgctatgtatggacactgggtaattttttgttctggatttgcccctccacaataatcactttcttgtgcaatctatgatatctttatggcagttgcagtaaactgatactattactttcttcatctttcctagactttaccagcccaactagagaggccgcaaaaatgaagctctaatttaaaccacagtccatggagaaaagagcttgaaagagaaacaccactgggaaaaaacttgcactgaccattatgtgctatcacaattgcatcatattgaccatgtggcttctcattctcaaacaagcgccacaggccattgaacggctcaagcttgcttatccaacacggccggacaacttcaattaggtcactctgcaaaggttgaaatactactcagcaatggaatgagcagaccagaaaatgacatcaataaaagaaagttcggcatctgaatgattcggtcacacttcatactacacacttacatagctcgaactccaacaaccaaaatcacattttatcagattaatatgggaaaattttgggaaataccatcgcaaagatatgtgagttgtaaaatagtaccatcgtacgtgagaatgacatgacacgcggagcatgtcaatgacacatatgatggtatttttcagctctgcgacttttgcgatggtatcaagcggcccgagcaatattcagttctagcatctaacagtgggatagtatgatcctgcaacagtttggtactttggtgatctatgttccaagaaagatttgcaatgtgatgtcagaattgggtatacctcaggcagaatcgcatctgcaagcggccgcatcccgtcgacgccgatgtaccgcggcggcgaggaggaaggcataggcctgaaatggccgccggcgtcgagctcaccgatcaagcctccccactcgcggaccaagcccttgtccatccactcgtcgaccaccctcttgaacctctcgtcgctcgcggtgaagaactgcgccgcgtggtcgaacaccagctgctgctgctgctgctggtcgccggcggcggcgatagctctcgtcgccatcctccctcctagcccgtgcatcccctgcagtagtagcggcgagaaaggtgagtacgggatgcggagaaggtaggtgagtgagtgaggtgtgggggttaggtggaccgtgtcgaagacgacggcgcggacgccgcgggcggcgagggaggcggcgcaggcgaggccggatgcgccgccgcctacgacggcgacggatgggtcggggggaacaggcgtggagaacaccacctgctcctggtggaagctcttcttgatggcggactgccgcgagaacccgggcttgccgcgccgccgccgcggggccgggggcggcctcgccgtgcgcgcgccgctgctgctacctcctcctcctcctccggaagaggaggatgcggacgcggcgaagcgggacgccgccagcacggcggtagagcgtgggcagcgtggcgccgggaggaggagaggcggcggcgtcggcggcatcgcggtaggtgttcgacgaaatgcggggggaatggagcctggagcgggtaacccgaccgttatctgtttacgggttggatttcttttatatttttatattcctattttaactgttatttttctctgagagcacccgcaatggtaaagtaaggtgctatctataaaatatgtacatctcagcaatagactagattaatagtataccacctcaatagtatatctatacataggtatctatagctctctaatccattgcctcgtttttctctatagactatctccaggttagtagatagctttgctctctctctcttcatttaatctcttccaagtaggaaaatatgctgacatggatctctcgtagagagcctatagataaccattgtgggtgctctaatacgatagagaaaaacattactactctctcccttccattgtcagtgcagttgtgggtttccgtgtccaacatttaaccattcatcttatttaaaaaatttataaaaaaataaataaaataagttacacataaagtactattcatttttatcatttaatagcaataaaaaatactaattataagattgacggtcaaacattggacacagaaactcacagctgtacttaaaatgagacgaaaagagtatttataaaaaagtaattttaaaagaagacggattcagaatgtggtaggaaatgcgaatttatcactgggcttatttgagacaaacggatccaagaaaattgagggtagggcttatttggtttagtgccctaccaaaatattggtagtgccaaaacttaggcatatttgaaactaccaatattttggtagggtagcattttaagtgagtgggtttgaattgataccaattgaaagccaaatctcatgttatggtcaagcaggttctagaattatgccaaattaaccatgggcacta

SEQ ID NO: 40507 - DNA, 10344 bp, Oryza sativa
  unsure (1)..(10344): unsure at all n locations
atggaatgaagatcatacccattggtgatattctgcagaacaaagaagcagttgtacgtgttagttggtaaacatgttaccccacaaaaagaacataattagacacaaagcaaataacatgtttcagagattgccagccagggtatttggtttgtaggtggaaaaccctgttggggcctatagtacttgacctggccatgaagagtgaatcatgataagctctgctaatcatcagcttatattcgaggttcaactgttttgcagcaaattccattgcgctgatgactgatttgtcagatagagcaggtggatcctgatttatgatcttgaactctgataatagcacgccacggttctttgatatctcaattgcggattggtgaaccttctcaatgacattattcctcctcttctcatcaatgtctctcacatctgtacaaaagataatgagaagttcttagccggcagtcagaacacgataattctttttatctgaaaacagtctcctaccaatttccacatgcgatttacttgggatgctattgattgctcctggatgtagctgcagaatacctgaagaagaataattcattatggaaaaacattatcgctgcaaatatatctttgaccattttcttgaaattctgcttgaccacctactagcttcataaatatatttcatgattaaaacttaactactccctctgtttcaggttataagacgttttgactttagtcaaagtcaaactgttttaagtttgaccaactttgtaaaaaaagtagtaacattttcaacccaagacaaatttattatgaaaatatattcaattattgatttgatgaaactaatttagtattataaatattactatatttgtctataaacttagtcaaacttgaaacagtttaactttgaccaatgtcaaaacatcttataacctgaaacggaggtagtaacatattctagttgagcatctaggctacgatgatgcaaaacattagaaaatctttcttattgtttcataattctaaataaatactaaaatgatttcctattttggagttgttaactatcatggctaagtacaacaacattctatattggtgcatttcatcagatattcagacactttttatagtataagcagaagatatccaagaatggaggatgtagaacagaattgatctaaatttgaaaagcaggtcaagtttgatattcacttggttgctatacaaattggtaaaggcacatgtatgtcctaatttactatggagtattaaaacatcacagtcatgaaagaatgatatattcaacagaaaataaaatcaatttcatcaagcataccaactgtcccaacagtatcaattgatcctgattccaaaacgtgtttctcaactgctaatgccaactcagctgccgccagtccagcatcatttctgtaaaaagtttctttacccatgtaaatatgtggtggggacctttcaaaataatgtaaaccacatggatgaagaatgaatggaaatgctaaccttgcaggcatgagcactgctccagcatggcccccattcccttcaaactccaccttaatacttgcaggagcagcaatagcagtgacaacgccaattttgatacctgttgtaagaacacacatgagtataagaagaacaattttccataaacttattaattaactcacaatccaaccttctttttccaaaatggggccctgttcaatgtgcaattctacaaaagcaaaatagtcgtctttcttcaaaaacacattatgtagctcctcaggatgcatcttgtagccagcagagtctgcagcatcaaaaaatgacacattctgattgtcaactgtttctttgagggatcgagccagttcttcactccctgccattaggcggctgcacattttccagaagtgaaaagataataaccaacaaaacataattgtggcacaattagtccaagctaagcttcaagttagtgcgagtgaggctcaaccttcccaagcagctaattccaaatcttgtaggctcctccgatgtaaacataataacctccaaagatctttttggctggaaaccagacctgtatgatacaaacaagagtttgtttcatcacaaaagagcaaccaacctagcatatcaaagcttcagctgtttcctcaaatgtgtggcaatacagttaaaacatgcttgttgcaagatggaaaatataactatgcttaatacttatatggcctggaattgtgacatcaaaaggtggagaattagtcgtcttcttaaaatcagtatacatattcaagctgtatagtgaaactgtgaatgtctaatccccatgtgagtgttgcatacttgggtacactgtatgatgcactgagtcaaactaagttccattggtagttcatcatgatatttgatgaaagagaatgcatataacatgggcaacacaagcaaaactaaattctttgagaaatggtaagatacttttaggtagtatttacaccttttcagcattctaattgcctcaagagcacccaggacaccaaccaccccatcatatttgcctgagaatgggattgcgtcaacatgagaaccagttgcaaccgctcctagtcctgcctcagaaccctccctgcagaagtatgcaatgttacagtgatcagaaaaattccactacaatctgttccttttatacatagccatagaaacaccaaaatataatgagagatatgcttcagatatgctgttccttccaatatgccatcccatttgctagaattgctttgccatagataactacttgtaaaaccagatacatcaaataaacatggttccagaaccatccaataccaactcaccagcgcccaaaaatgttgccaacagcgtcttcacgaatggacaggccaagctgattcattattccctttatatacctataaacatttaagtacaaattcagcaaccatcatagaacagagatgcatattatcattgacaaatagcagagaaacaaatttgccatctgaaatgttatcatcgaatcagaaacatcaaattgctatcgggaagcagtttgacctattaattcaatgttcatgagatcaactcctatcgggctgggcgtcaaattaagcacgttttggttcgaagtaagcttggttcatcccatcggagtcttatcaaggtgaaaaataaactaagccatttctgcaactagttgctgaccaagcacagaagcactgtaatgagttcaaatccatgggaaatcacctcctcccacgaatcatgagagtagaacaaaaaaaaaaaaaagaaagaaaatcgcactgggcgtgagaacgggaaaaccttcgagcttgcacgtccttgtcgctgtacagaacgcgggtcaccgacggcaccggcgagtcggagaacgaagccagctcatcaatctgcgacgaggatcatcacacacacaaacgagaaaccatttcgtcactcggaatcgcgccacgggttttgcctgccgcaggcggtggaatcgcgtgcgtacgtacgtacctggcgctggagcccatcggagtcgacgtagaacggggaggagccgccgctgccgccaccgccatcgccgcggtagtcggacgcggggaatccggcgaactcctccatcgtccgccgcgccgccgccgcgtcgtcgtcgtgccccaccaccgcgccagcagctccgccgagcaggacgaggaggacggcggcgcccgcgagggcagcgaggaagcgcgcggcggcgctcgtcgccatggctgggtggaggcgaaggcgaggaggttggagacgacgcgacggcagtggcggctgacgaggaagacgacgacacgagtcacgggagtgtggtgtttcttcggtggggcccgcggccgcgcacggtggggagtgaggcccacctggcagcggtgggccggtatatggatgggctgggcccaggagtgggcgaacgtgaggcccatgggctggtgggagtagccaggttaaatcaaaccgaggaggcaaccaagccacacactctctctctctctttcctcccaaatccgcacggctcccgtgctctcctctcctctcctctcaaaaccctccacggcggcggcggcgggactccctctctggcgaggcctcgtcctcttcctccgtgaggtgagcgcgctttcgctcggcatctacttcccggtgaatccgtagctttggtggtgcgggcgggtctagcgtagctgcggcggagagctcgccgccgacccgcccggagattggttgcttgcgctgtaggcctcgttctcctgtgccgtgtggtactcgcgctgtagccgcgggaggtgtagcttggatgcgcccgctcgcgtcgtggtgggggcgcggctctgctctcgatttagggtttatggggctcgtggctgattttttcttttcactcgcttatgacgagtttgctgtggtgttaggggtttgtgcgttgcgctgagctttatctaggtggatccggagtagaaataacttgggggttttcgtgtagtccacagttagattggtgcaggaagcgggttgcccccatctggtattgttccgtgcgagctgtgcccctcgcaaagcattacgcgagccacctgttgctacaatttatgctgcacttctgcccgagaagcatctcaccttcagttttgtgttacttgacatggtctatgttgtgtgtttccagaaaatatggatgggaacatcgagaatcctgcggaggacatgagtgggattgccagtaatcttgataatgaggagcaggcgattcctctcagtgatgtgcctgagcagtacaaggaagatccagaaaatacatatgacgaagaaaccaaagactcaagctatgaagaatcagggatcccatacaatgaagatcaggtgaacataaatgatggaaatgtggggcatcagcatgaagaggaccaagctatcccctcagaagaagggcatgcctatggtggagaagctcagggagagcagcaggccaatgcagtaactgatgagaagaaatggccaggttggcctggagaaagtgtgttccgtatacttgttccagcccaaaaagtgggcgctgtcattggccgaaaaggggagtttatcaagaaaatgtgtgaggagtccagagctcgcataaaggtgcttgatggaccaccaggggtaccagatagagcagtaagttttttctctcttcttaagctggactagtttctactattgttgtttcagtcagtatgcgcagtagtgttgtaggctttgaatgcacggtacgcttgtttcagagaaccagtcaagtagatatttgtaatatatgggtgccatttttgtcctattttatagttgtattgaggaatgaatttagctaggaagcattgtagttacaggtggttacagcactatgcaatttcttgatcccccacaccatgtattatattcacattcaactgcgatggtctataaactgttgtattttcttttaccaatctatctgatagttggtgagcctgttgtctgcaagtaatggagttgaaaataaattgtgttttgacacaggagacagaaatgaaagaggaactagctggcatttttacattatataatatgatgccatttcaataatagtttcaaattaatgctgctctaacttgtgaccaagtgcttgagtaggcttgcttgcttttctttactccctgagaaggggatgcagttttattagaagtttaagaacatcttggttagtgactatggtgctgtaatgctcctaataagtactgtgttgttatcattactaagtcaagtggtaggtataatattttgcaacatgtgatcatctaggacgttgtagtgggttaaatgtataattactaataaaagatagtgctgtaactacaaccttcctgtatagaatggctatatggttgtttcaattggtgaaatctatctcagctttgaaacctcagtttgtagggaaacaaagatgactatagatttttgcatatattaagtaattttgacacaaacaaatattctttgtagaaaaaaggttatgactgaatatcagatcggaacactgattatggccaatcggtgaactgtatgtacaagggcaagagaaaattctaacccatctttcaaatttgagtttggatgctaatgttaataggttttggactgtacatggatcaagacatcaagtagttaatgcatatattataactatagatgctctttgcctctatctcagtaaatattctgaatgattatcagatgagaacaatgatttgttccattcaggagaatcatgtgtaaaggcaaataaaagaacatcaaatattgggccgtcatcccttgatgtacttcattgtataactattaaaaaatattcactctacttgtcttaaaagtttctccgcaactaaagaaattcaaactaatggattgaattatcaaaaaaatgaagaaactgacattcaagtacgaaacttaatagtgtcgtcgtgtcgatagcaataacaaactacctttgcaggttctcactgcagtgtaaggcctcaagtcgaattgtttatgtatcaaaaatagacgagccgtcatggttatcaaagttcagttttgtgctcctgtgctgcaaatactgttaagtcttttgattatcggatgaagatccctgtcaagaagcttcatatgttgtccggtaatttcatgacctgcttgattttttgaccaaacgggaatcagtttgtaaagttaataaaagattaaaataactaaaaaaaccttaaacctaatcggttcctaaataataaaagtgataactgcaagtgatacctttcaaatgtgaagtagtatcacatgcatcgatatttttggaattggttcatttgaagtagtgctcttaaatcactataatttatcaagagatgagtgagttatatacccaagtgaactgaaatgcaacagcacatttctatccctttcccggattataagattgcccccatttagaaaatgttagcgtccaacaatgggtcggaattttattacccatagacatcagttttgtgattagtgatgctaacttagatggataaacatgctaaccagaaaatgaggaatggagaacttgctggtcgtagtgtcacactcgttaaatgaagatagactactctatgaattcttgattttattacttaggcaaaaatagtttgtgttttgatggattttaatcaggattttattttaagttatgtggataaatatatcaacgataatgttttttggcaatatcttttaagagcattatcaaaaatattttgcgagaatttgtaaataatttgttcattatattccataactcagctcaacaacatcaaactagcactaattagtattagtatgcctaggatgagttgttgtatgataagaaggaagtggagagtatcctactatactttggcagtcgttgtcttggcaatgccatgctgaactgtttaatattttagtctttatggcagacattttttgggtgtgtatctgcaacgtttcaagtgaaggcaacccatgcataaatgaatgagttgcaaccccactaataatttcagaataaatataaccgtgcaatcacatctgtctaatgcggatcggacatatattccctgcccttgacccttttgttatcatgctagtaacattttttctgtgctttttgcacattgctgttattgactctccaatggttgctcatctgtatgtacctgcctgctgacataaataccattttctttcttaaaggtaatgatttcagcaaaagatgaaccagatgcaccattacctcctgctgttgatggattgcttagagttcacaagcggataacagatggtttagatggtgaatctgatcaacctcaacgtgctgctggtactgtagggccaacacggctactggtgccagcttctcaagctggcagcctgattggcaagcaaggagcaaccattaaatccatacaggatgcttctaagtgtgttctccgaattcttggtgagcttttacatttttttctcccataacgtacattatttctagtatattctatgttttgttttattctgtttcaaaactggagtactttttaaattaaacagtgatagatctactaaggctctttctttttttcatatcttatatgattattctcttaatgaattaggaaatatgcatttttaggcatacgttgtatatactcaatggatgtttttataacccattctctcaaggacgaatattttgcacttcatccaataatgatttagccacatacaaatctattcatggttttaatgttctgcgcttagcagactatataggatcgactattttcctttttatgtattaaaaaaatacattaatgcatgcatgtctgaggcaaaggccatcctttgaggactcaagcatgctggacatatgccatatagcattataattcccctttgattgttgggcttgttattctagcttgttcctgactttaccactgtttggtttgctgggtgatgtttggtcacttggttgtttgtctttcaatttttattaggctcctataactaccgcaactagtttcacaagaattcatgcacgacatattttatagagcatttaacattcagtttcaatagtttaacatttccttacatcttttacagaaagtgtaccacctgttgcattaagtgacgaccgagttgttgagatacaaggtgaacctctagatgtccacaaagcagtggaactgattgcaagtcatttaagaaaatttcttgttgaccgcagtgtgctccctttgttcgaaatgcaggtaagttcatttcttttatgcagtatattacatactcttacttttgcatgagtggtcgataatcataagttgctttccttgacagatgaaagtgcacaatgcgcacagagagcaacctatgccacctcctcagacgtggggtcctcctccaccgtggggtcatccatcaaacgttcctcctggtggcccaggttatggtggtaatccacagttcatgcctcctcggcctcaagaccactattatcctcctcctgatgtacctcctgtcgaaaagcaaccacactatggaatttcttcatatggccgtgatgcacctcctactggtgctcctcctgcctcagggaatcaacacccaccacatggttcttctcaagttagttgctaaaaatttgaccactgtgaacataatgaactgtttatgcgcctgctataaagtttcttttactgagttttcccccatatatgttgtttttatttgacagataacacacagcatgcaagttcctctttcctacgctgatgccgtgattggggcagctggtgctagtatcagctacattcgcaggcatagtggtgcaacaataagtattcaggaaggtgttcctggagaaatgactgtggagatatcaggaagtgcttcacaagttcaaactgcccagcaactgatcaaggtattcttttttgtttcgtaaattgcgtcagcattatcactgttttcacagaacaacaaagaaaaaacattatcacactgtctatgacctgcatcttggctaattattataatatgctgatgatctatttgcgagtctgatgttcctgagtctacctcttgcattaattagatagaagtgctgcatagaagaaactcggtaactcattggattgtattattagtaggataaaccactacatacgcagctcttttttcatcaattgttacaaaatgtgtatggagagatctactcggtattataccgaagtggtggggggaaatcctctgttcatatcttcatattgataatcaggctatcctcattttaatgatggtcactggttaatcaaaatcattgaacttaaaaacttaccgatacccagctcagacaaagaaggctatctacagtcctgcactgattgttatttatatttttttagaaaaaaaatctcgtattaacagcagcatctcttgcagaatttcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40508 - DNA, 857 bp, Oryza sativa
aaaaggtactagataagatgtcggaaaagcctagagaattctggacaaggccaaattagagcgggaaataatgaaatggtgcaggccatagggcggaagacaagccatggcagggaaatgactaaccaacggtcagatgttatttggagacatgtttggcaggaaacaatacaggaaaggaaaaatcctaaattaaagcatatgcggtatatagcatatccgaaacttagaccaatataatcctagataactaatactatttccatgcaattagaagcattcaattttgtccagtatagtcaaatagtctctagtgttcaattgctcatgcttcattgactaggcgcgcctaaatctgtcgcttttcaaaacttccaaaagagaagagcgcgatataccgaatcagagcaacggcatgcagcaccatacaataattaacaagtttgcaatcaatgcagacttacacggtcggcgaacaggctctccttcttgctggtcttgaacagcgccaactgaaactcctcctgcacaaggtcaacggacaaacacagtcagtgattgcatacaggttcacaataacatgccttcatcaatcaaccaatcaatcaatcccaattctacgatacaaaatcgtggcgcgaacagaggactccacaccaaccttgttaatcagcccgtcatcaatcacagcactgcttatcttcttgaagagctcgtacagcgcctcgacctcgctcacgctgactgcacaacacaaggccacaaaatccaacccaaccacacacaccagtcaaattcccccaatgagacaggctcagcaacaaaaggaaggaggagtacggcgccccaaccaatgg

SEQ ID NO: 40509 - DNA, 1748 bp, Oryza sativa
aaagtgatactagatacaaatcctatgtgcgcttcgtctccacagggtatgcgccatgtagctttctccacaggtgcagcatcaagatctttaagcaaccatgagcaggattcaggaacagtatccttctttctgtaacgtagaagcagatctgggctaccaaactcaaccgtcgcataaccactggcatcaagaggctacaaaataacatcatcatagtctgctaagtgtctttcacagaaatattctgacaaggaggcatataactaaaaggcagcgtattgtcagacaaatttgaaaattctttacaaaatctgcacatgagaagttgaccatgatataaaacctaaaataggaccagatcaagtaaaaggccacatgttttttgacatgcttcagttgtttatactaaatatgtaaaattatatatatatatatatatatatatatataggtaaattaactggtgctacatggagtatgggctccaagattcaaattgagtatatacccaatttgaatgagtatgaattttttttaaatgtttagatatgaacattaacttctttactaacaagttcaaacaagtttgaactgagtttgaacttttttttggttagattttggttctaggtatataacatccaaacatataattcgttaggtatgtaataatgaattgtgaaacaaagttgagtttgagttgttttgttgttaggtatttgtatgaatcaaattcatatacctagatatctacttacaatttgtaaatttttaaaaatttgagagaatttgtgtgttttataccttggagcccgggcaccatggagtcccatatgggtatatatatatatatatatatatatatatatatatatatatatatatatatatatgaagtgaccacaatatatcataggactagaacaattccaactattgcatgcatccaactttgaaaaccaattggacagaaacatatggtgggagaactatatattactttcattacaccatgtgagttataaggcatgtgcagcaaagagaaaacatgcaaatggcacagcagcgaacatggtcactgccagagaacttagcttatttgttttctttattttgttattccttgaaccatccactaattacatgttgaaatttcatatgcaagtattctgctacatattgatgttagaattccatagaaaagcatttttaagtgcactcatagatctttcttttcacaatctggctttgttgatcacatcctgcagagtgtctcttatgtatcctgcctttaaaaggttttaaaaattctcaagtatatgcgaaaatatatatgatagggatgtacagtttgggaaagtttcaaactcaactcccaaagtaagaggcagacacgaaacaaaaaatatagaacgaatggtgattttcagtgcttaattactaatcttctggcttgtccctttttggtatattgataaataatacatttgaagctaaattttgccaggatatgacattgttctaccttacttcaatgttctttttagttattctggaaacctattatgtctggatgtgcaagaatggtacataaaggtcactggtaatatatggcctgtgaattagaggggaaaaaaatgtagccatgatgtatttctcagtgtctatggaggcaaaatgttcccgtaaaacaaagatggagctaataaacacgtgaggtgttgaatatttcagattaaaaaaaa

SEQ ID NO: 40510 - DNA, 1329 bp, Oryza sativa
cacgatgttgagcaagctggccgatcaaggtatcgaggtatgaatcagcgacatatctcctagagcacggcatacacttgttgaatttctggctggtacctgcctgttcagtactataattagtactcacccatgcgtacatgaacattagacaactactagctaattaggagcaaaaatgtgcttaaatattcaaagcagcacttacatagttattaatagcaaggcatattttatattgcagacaatgtacagtgaactaccactgcactacataccatctaagtcacttacagcaacctaaatctaacatgggatagcttcaaagttcctgctcaattttgggactaactacatcatcaacgagaaagacactcccacgaagtaaattataccatttccacagttttctgtattctaatctgcactaataatacaatggagcagcagcatgccagcatctccgtgaattggtcaatcaattgacagtaaactaggggatttggcattcattctcaagtgcgcagccaaatccaattgaacaatttaacacaataactccgcataaatctgcagaaaaatcagtatgagccaagagcatccaccacaggtacctgcccaggcgatgacgacgacgacgaggcggccgcaacgcccaagacccaagccacgaccacgacgagcagccacggtccgctcgccgcggccatggattctctttcagcagcagggcctctcacacagagcagccgctcagagcgccggaggccgtggtggtcgagccggatctaactacggggacgcccggtcgcaggcggcggatcacaaacggtagctcctccctccctcaactgtagtacaaccggccaatcctccctcccacgatccaacggcagccgccggggggcagtgttggggatcgccgtcaggcctcgccggcggcgagtgtggtggggtagagggagaggtgggaggccgcgacggcgacggcgacggcggcggcggcggcgggagctcgcgagtcgcgtgaccgtttccggggaagacgacggagtgggtcacagataaggagggagacgtggaagcgctgtgagacgttggattttaatccgatggctgaaaaggttcgcaatattttgaggagaaaaattcttgctcctctagggattaatatttcttctatccacaaatataaggcatttctagcgtataaatttaactacaaatattagcattttctagtgtacttttgttatagttccctgcatttgtggacaaaaaatgtatttgacgttttggacgagattttatcaattttttgaaattcga

SEQ ID NO: 40511 - DNA, 1938 bp, Oryza sativa
ccatgatgagggtatatgtaactccaataatctccaaatatgcatcaatcctcacaattgaggaatgatcaatatgggaaagaccctgtcattttcatatgattaagggtacttctcaggccatagctttcgacagcccgattggcagctcgaaaaccatctccgtatgcctcagatgaatccgtttcgatctgatgtttgatgaatgctccgagcttcttctcgaattcggtctttgcgcccttctttgatgtggttggagttgaagatgacgacgacgaagatgccactgaggtggctgatatgtcgatactagaaccaaagatgatctctgactcgagccacatgtgggaaagaacttggcatatgccttcttcaacctgaggactaagagaccgaaatcctagagagagagaaaaaaaagatgttactaacactgattggaaagggaacatggaggtggcatgaagtaatggaagtgcacatgattgtttgccagaacaatgagcagagtaaatgtacctttcagacgtagataagcatgcatcatttcatgggcgagaattgagccagtttgtaatctgcatgacaagcacgttataacgacagtgattagtggtatgttccgttttttcggactctgatgtaacatgagttgattatgaaagattctaacaaaaactttggtcagtactaaaggaaaaactaaaacttatacaatgtacctcggcaacccatataatatcaggattgcagtcacttcacatcgtctttccagcttatatggtgctgtgatcatatctataattctgtttcccggtccaattattggtcttcttaagatctggatgcattacattattcatcacatgcatattttttgtgtctgccagttatcaaatttatgcagtaacaaggcggtatttaactcaccgttctgacaatttgctcttcagaaagacatagtccccttgtttcaggaagatgatgcccctgagatgacagaaattgaaaaccttgtaagttcaaaatatactaacattctgcgcaaaaacataacaaaactctcatgttcatgccacttacatttttctcagtttctaaagcctcatttagagcctgtctctcaaccaagagtattggaacttgttgctccactttcatgttcagaccttcaaaaaattcctgaatgtccatatacagctgttgacactctggtgtatccattattgaagaattgagacattccaagcagagtttcctcccatcatctaatgtgatgtatttgatgtccatcggctgaatttcagaaggatgaaaagaaatgaattactagttcatccacaaatgtatactgaaattcataagtgccatataaatgtcacatagttaatcacatctgatcactagagaaaagaagtaattacataattaattgaaataaccactagtgacacaggagctacttgctagctgttaggcagtcctatgctgagccagatattgacacagaagttacttctttgcttttagaatgcttgagaagtttctgttgaattctacattgagccagcttttcaagaacctatcactaattgcaagctattgctgagaaatgaaataataagaatgggaatatgggaaccccagttacagcactatctgcatctatataaactggtgatgaaatgatcgcatagattcaaaacaaatttaaattgttattttccaaatggtagtcaaaactggctggtttctttccaggaacaagaagtgacaagctggggaaactggtctcattgaggatctagatccctgcactgacctccattctttcacaactgcaacacctaggagtgccatcatcttcatgggaaggacagtacttttgcatccagaatggatgtgctcggtattcgatcagcccattcctgttcg

SEQ ID NO: 40512 - DNA, 1705 bp, Oryza sativa
ttaggtaacaacccaatatatttaatcaccaggcacttaacaagaggagataaaatattcgtgagaaattattcctatggtcatcctcctcaccgaaagagggcattaagagcaaccaagaaacacacattgagataaaaaaaaaaacaaggtgcaattctgtaagaacatgcattacgatttcttgcaactggcaagtaatgaccaaattgtcaagcatgattcctatgcagcagttatacatatttctaagtcagtgctcagtggcaaaaggggagcttttagtccctaaacttaccagaagacaaaaatctcacaaacttttcgccaatcgagaacgtttccagtacttcagaaaaccaaagctgaaaaggaagcaaagcaggttagcacaagaaagctggaaaactatgaagtctgaactgaaaaagagcaactcaaattgtcctagcatctaagaaatcaagaagcattcacagaccttgagcctgcaacaaactaggaattcagttcgccgtcgatcgcctcgcctcccgctcagtccgctgtgatcaaacagaagcaaatcaaatcaaatcactgagcccaacaccaagacagcataagaacacctaactttaccattcaacgaacctttcacctcgaagtgaccctgaaactcccacaagaaactccaattctctgtagtcccgattgaccacgcaccaagaaccgagacaaagggtaactaatcgagctcgggacaggcgaaccaccggccacggacagctccggttcttgatctctccccacccaagaacgccttccacaggataaagaaaagaagaagaagaataataagaggcgagaagggatgagacggagacgcgagagagacccttgagccggcgaggcgacaggtaggaatccagggggaggggaaagaggacaagggaggtgaaggaagcgtgacatggacgggaaggaggaggcggacttgctggcctggtgcctctgcgcctgggtcaaagaaaaaagggtgacgtccacctcgtgcccgcacaggtggcgcggtgacgtctcgcttgtgcgcccgcgcgcgcggcgggcggcgcgggaggcgtctgcccccacgtgggggcggcgcacgccgccgccgcgcccggcgtcgcattccgtcgaacgcctcgcgggcgaagcggggtgtgtgtgctgcgtagtaattggaaggaaaaaggcgagggagaccgtgcgagtcgtggtggagtgttgactcgcaagttgactagtcaacggtattaggaagtactcgtcacattcctcgtgatcacaatccgcatatttttcaaccaggttggaaaattgaaaattttggaatgcacaagttatcatgataataggttggttgcttatcaattttgaagaaaatttgtcaaagttcattggatttttttttttgagaattacatagtacaacgcagacactcatttgtcaaagttcattggattttttttttgagaattacacagtacaacgcagacactcataacgcacgcgcactcacccctatgaacccctacccctatgagcaaatcctggagagattgacgaagtcaccacaggcgcctcgctacgcacgcgcactcaaatcctggagagattgacgaagtcaccacaggcgcctcgctacgcacgcgcactcacccctatgaacacacgtacgca

SEQ ID NO: 40513 - DNA, 11829 bp, Oryza sativa
agctaagcatgcactcttatacaaatctctggtgcactttgcatgataactctaatctgacctcatgtccatcatcagattgaccaagacaatctcccaaagaatctacgataagctaaatgcactactcttccctatattttcaagatgaattttttgggggaacaccgaacacgcaaaaggtccgcttgtcttttcaagatgaacttctgtctgatcataaaacattaccttgcctgactgacataaggcctgacaaaagtccttctccaccatacttcaaatgccctctggagattagggcaattatcccctaacttcaagaatctcccaagccatgccagtaacatggaccgctgatcttccaagggaagtgtcaggattgtctgcccgatcccttcctcgacgagcttcctatcgaatgaccggcagctgcattgtaaccatgagtagtcatcaatgagtggttgcagccagacttgcaagaggagaagacgggtgttcttggatggaagcatctctcctcttccaattccgacaaaaagccttgctgtgatacagctaacagtgtgacgagaggcaaccggcaattttccatgtaattctgcaatcttgctttggtttgcccatagagccacaaaatcatcgcagatgcgctggttaaccaatatctcaaccaaccagaggagattatctgtctccagagttatttgccgtgtaagttcaacagaaaattcttgtcccgtcgcttctgaaaacagtagtcgaagtctgtctaagcaaccttggcatgaactgtacaataattctgaactgatgtctgatgatccatctgtgcaatggttgctgtctttcagaagattcagaacaagggctttcatttcccgacgcgccctgtcatcagtgctcttcaacaccatctccattataagagctaatgtatcagttggtgattttagattgtcagaagtaattcttttcagcagaggactaactccataagccttgctctgaagatgccgtatcgaggacacaacattgtcttcttcctcaccaacccaaggaacagcttccaaataatccaagcatgacttgacacatgcgtggaaaccaagcgactcggcaacctacaaaatttcccccattttaaaaacgatcaatatgacaaaaaggagtgcttaagatcactacaaaaaaaaacaaatttcaccctcaaatactactattcatcagaaggaaaacacataaccaaagcaatgatcagataatcagattgatgtgtttatgttctatttctcgcataatcgaagtctcaaaatttttagtaagatcgcgaagaacattttgcacaatgtctgaaacaagaacacacacagagagagttcactgcaatgtggaattcagatcatctgcaaatattaccttcatgatgcgaagaacacgcgagacattctgcttgagcagcttgtgcttggcctcgtcgcagtacatgagcccgacggtttccacatagatctcagcgtcgtcgcagtcatggatctccaggcacgagccatggccatggccaccggagccggaggaggaggaggaggaggagagcttctcggcgaagaaggcgctgctccggcggagcacgtccccgtgcacgctcatcctcaccgcgatcccttccttgccgtacagcaccaccgtcacgtcgctcgtctccggctgcccgaaccccacgcagatcttgtgcctctccgcctccgcctccgccgccgccggctgcggcggcggctcgtcgggagcgtcgccggcgaccggctcgctcaggaccgagggggccctcgacggcggcgcggatggggtcgtcgtcttgtgctgctgcggcggcggcgtcggcggcggaggcttgtggttgccgccgccgccgtggtggtgggggttgttcttgaggctcttgtggagcgccgccggcgacgggcagcaccagaatccctccggcgtgacggcgatcggcacggcccgcatcctcgccgaggcatccaccctcttcgccctcgtctcctccatctcacatccgattcttcacacgcacctcgaagatttttcttctcctgaaaagaaaattttctgcgcgagatcaagaacacaaatctgacaaaggaagaatattactccgaacgccaactgcattgcatggacgcgaaattgggagaacgaaaaaggtttgaaaggaccaacaaaaatccggggttttcgcatccagaaaattaaaagaacagaaaagatctctactactaattgggaagaacaacacaacagcaaaatggcagctcgaaataatacagattactgataacacaacacaagaagcaagatttcacctcgaaaaaccaccaccaccgcaacaacacaaagaagaagaagagctccaagaagcaatccttgtgtcctagtacgaatcaaggagatgaactgatgaagtgaacgaacgaagtataaattgcttgctttcagctcacagcagctactcgtagctaccacatcgggtacattccggtacacgctgccctagcagagcagcagagtggtagtactaccactagtggttaaccgaatccaatgccttgtccttactgttgtgtgttaaccgagagcaagcaggcgtgggtttttgtgtcctttgctgcaaggacactcacacccgtccccattttcactccaccttcacactgcagcttcactgttccagatggatcatggatggccaaggccaactcatgtttctttctttgcttctccttcagaattcagaattcagattgattcttggcatggtttactttcccaagaatggtgaattttagtggtaaacttagtactagcagacaagtaaggtttaggttggagtataatactaaaattttgtttggaagttgggcaaagacaaatgacactggattatttggagtgcaggaacatctttcttgagatgtgaatagaaaaaaaacagcatggattgctgtactgcactcttttgttagtcccaaaaaccaatcatgtgtgaaaagaaatgggagatggcaggaaaagatgtgggtggcatgcattatctatgacagttttttaagatacaaagatgagaggaaagtgcttgataattgtgtggtttgctttcacatcagatgagagtatgtgatgatgagattgagaggcccacagacacagtgagcaagaataaagtgtaaattgctagtactggattagtggttcaaaacaccagattgatgtccctcttaacatcagaccaggagattacacctcacaccaaccctctgcattatattgagtggatcataattcataccctcccacaagtttgcccccaatagaatttagtgtgccatttatggtgttgtttgtacacttgtactgcatcagatatctctttttattattggggaattatttgcggataatttttaaaaggtcttatttctccaaaaacttttctgcatcaatattgttcagaccacttgttcaaaagaacaagctatttgttaggttcataatatattagtatttaattcatccatgtaaagaaatccatcatctaccaacctttcaaccatatttcatcaaaagacctaaagaatttttttttctactatcattctcatgagcagagataaggagagagctgagatgacattactacaagctgggccatgcacaaggcaaggcatgggagtgactgactgacatgagtggcctgtaccagttggatctagattctgaacaaaccgcatcagggactgtgtagagctttggcttgttttcacatctccctttttcttttcttgctcttttttagataataaaattcctttccttgttcttgagaaaggcttgcttcttttcgcatcacacttgaattgcaggactatttttcccaagaaaacatgatgatggctcatctgattatttcaatcgagctgagttttttttttccagttcagaggaaaaatgcatagcatatggcctgttaaactagggcaatctgagagaaaggtacatttttttacagcaccctctgataggatcagaatctgtctcataatcactcatgaactggctcccaaattttccttttatactagttagaaatggaaaaaaactaaagttaatgataagttaatcataaatcagaagtagtggttactgttcttttaaaaagaagaacagaagtagaagtaagaatggcacacaaaagtaagagccgcgtgcaacactatcatcaaatccattgtcgtctagtccggttaggatatctggctttcacccagacgacccgggttcaaatcccggcaatggaattctttttcatgattttttcccctaaatatcacatttcacttgctatcattcttttgaaattgtgatagaatgaacaagttgtgcacttccgatccttttgaaattgcttcaccaaaacagctaccttatgtcatgggatttgtagaaatcttgtggagaacatgtttccggcatttcagtatgatgatgaattgcaaattaaaatatcatcgctatcaagcccatgtcctgatgagatgctcatcttacatttttgaagctttgctaatgagattcatgataagtcgcagaaatattatcgccaacctatagaagatgcaaaatggagtatataggtttcaatcttccaaacaagcaaagcataaaaccggtactgcgattttgtttactctccagcgttttcaacctgtcgatgagccaagtatgtacgtaccggagcatcacgtcgccggcagccgccgccgccgccgcctcgatctcgcgcggccatcgttccgctgccgcttgatgtcacggcgaagcggcggcgatctctccggcgagggattcggcgccgttgcaggtcctacgtcctcggggagggcgcgtgcgctgcggcggtggcggcggcgagggggtcgccggcggagaggcggagacggacggcgagcagacggcgccgcttggttttcctttttacccctcgtattgtttgatatttacgtttatgccctccaagaaatggaacgcgatggtagcgatcccgaaccgtccgatcaaaatcgtgcgttccagattcactagggaacaagagcagatatgccgtgttgatttcgtaaaacccctttgtgcatttctagaattctagctgagtaattaattcactttgatcatgtcaattgtcaaagttagagatggtcacttttgcatagcttctctgttcttgtatcattcttgcatgaaatgttttctctgaatttcctctctaatagtgtgtcatgcactgctactgtttctgattaactgatcctgaacttgaaaaccctttactatcattgagcatagtttttttccctaaatattatactgtaaatgtgttcttcactgagcacaaacttgcattgtgatgatggtgcatgttcctttcaaatgtttcaccggatgaactatcaaagatactgcaggctgatgcagataaattgtactcccaggctaagatgattaagatctctgctctgcctatctaagcctacaaggaacaaaattatggtggcaaatctgagcctcatgtacagggcagcttcttggttaaggactaaggagtaaagatgctgaagcctgaactagaagaaggttcctccactacatcaaccacaaaaaaaggttgggttttgatgcagctgcatgaatgcagtcattttgcagatgtatttcctagttctcctgtactcatagtaaggccctgtttagttcacaccaatcttctccccaactcccaactttccatcacatcacatcacatccaaaactttcctacacacataaacttccaacttttttttcaaactaccaacttttcccaaacttctctccaatttcaggaactaaacaaaaaagtacaaaattgaactacagtgattgagtattcagtgattgatttctcatggcaactcgttggagagtcgatgcagctcttactctgcatatctcagcgatggcatttcgatttcagttctgtcaactgcattcggtttgcaagcagctgtgcacaagacaagagccaatcaaactccaaaaaaaggtgaaactccaatcctgtactacaaatatgcagggaagaatcgatgcgaatttgctacatattccctgaaaaagaatcctcgcatccatctgaaaattcagcttattttcctgcattttcacatgttccatgggagtgaactgactgaattcaagctgtttgaatgcagtagagagatcaattgcgtgctatttttgggtaacaaccctgaattatactgtactaatcttaatctcttacacattacacccttccgggcttggatcgcaagcagattgcgatccacgtccacgccgtccgatcaacattgtgcggctccgatgcgattagatgacgtgtacacgggttaatgttattgcacgagttaaattctgccacgtgggctacgtacgtgtgtacacgtggtagttaatttacattttttttttacccccctccgccgcggcgcgaaggcggcggcggcggcgccggtcaccgcgcgatgagcgagccgatgacgccggcgatgagggcggtggggtcgccgagcacggcggagatgaccacctgcgccgcgaagccggcgatctcgcagcaccgcttcaccttccccttccttccccagtaggaccctcccctgctcgcgtggctgctcttcgccgcgccgcgtatcaccggcaccctgtacccgccgctccccgccaccgtcacgccgtcgtacacattgccgccgccggcgacgccgcccttgtggcggccgacgccgttccagctctcgacgagcatgtccatgacgcacgccacgtggaggctgtagctcttgcagctgctccggtacgtccagctccgcccccggtgcccgcaccggtggcacgccgccgtcgccttcgggtgcaggtacagcctcgcgcctccgccgccgccgccggaggcggccccggcggcggcgtcgaggacgtgtgggagcgtggcgcagcaggggtggaggtcgaagccgcaggcgcggcagtggtagacgaagccggcgacgtcgcggccgcaggcgttgcagtagcgcgtccccggcgcgccgggcgcccgcgcgaggaagacgaaggcgcagcgcgggtagaacgggtggcggagcggcggcggcggcggggacagcgggagcgcgcactggcggtggaggtcgtggtcgcagccggcgaacgggcagcggaagcgcgcgccgatgccgacctcgcggcacccgtcgcaccggaacggcgtgtcggcgtgctccagccgcagccggtggtgcgggtggctgaagtgcaccacctcgccgtacctcatcctcgccgccggcggcggcggcggcgggcgagttgccgagtttctcgaggtggtactattctgccactacgtgtacgcgtgagaatgtgaggaggaggtgaccagggggagatttatattgagttttggcgttgttgttactattaagcttggagaggaaggtgtcattggaatggaatagattctatctacttctctattggatttagatgtttgtctatttgtggtgttttaaacttgtagacctctttggaaatgagatgtttttttcttttttggaaacataatacagactctgaaaactgggctggcataacttgaaacttatgaaaccaccacacccctttgtgtacctccgaaaactgggctggcataccttgaaacttatgaagtcaccatagacatctcgttgttaacggatacatcacctaccattaaaaaaaattaacaataaacgcgagcacatgtgccaagtctagcacttgacctcgggtgggaaggttccaccatcataagcctaaccagttgaggtaggctcacttcacagaaaatgagggatttagatgaatttaatggaaaacgaatcgattttgctgaagtccctttgttagttactacatcaaaagaaaaaaaaacatatgtcaatttttttataagcaattaagtcaaaagcaaattttcccgcattagaaaggaagcaagtaaggataagaaatatactaaagacaatatgcatggtcaaatagataaaattactgggaaattttgtttgtcactgattggtgatctatagttctttttagtatctttgtttttgccattcagctctctcgcttacatgtagggtccaaactccaaactgttacaaatggtgaaatgagatgttgacacgagtcagtggcgaaaggcaaaaaaaaaaaagttccttctgtggtagtggagaaaataaatatgtgtcatgaaagattgtaaactaaagctgttatttttaataacagtttgaactgagaatattttggttcggattttggactgtttcatcaaaattcttgtatttcaacaaaaattaccacggaatttggagaatccatcaactagttcaacaagctcatagttctttacgccgagagtggtctgaacaaaaacttttcttgcttgatcatggcaatactctacgcttgtacagtctactctccaaatggctaactaggcctatggacaagttcatctgcaaccacaatttccagccacagcgactgtttgtcactgacaaagaaaaaaacacagggcatcttctcttttcagtgtgttggtgctggcatctgttcctcctcctcctgtcctccgacgtcaaattattccggttcttctcttaactgctaatccttcttaacaagttcagagaacatccaattctcaggtttagcttttctcctgggtgtttcttttctcttgtcttgatgatggctagtgtgtacaaggataagagcgcacaaattcttgattacgaatgagtataagattggaatgtctccaaaagcctgaaaagaaatatctcgtcacctgggatttgggtgctgcaagaatcacttgtgcagtcaggcaagaattttgctatggataaggggaaattatgctcagattattgccccgggatcggtactctaagttagaacctgagacatctttgttactctgaagaaacaatttttcctgacttgcaagtagtaacagccagcattgtctgaattgttggttttcttttctttcgctgtcgtgaaactgcgcaaaacaaagatttgcaatgacaggaagaaatgatgtaaaaaaaaaaactacaactaggagcaaattcagatttctgatgccagtttatagtgctggtgtagcaaggattcagtgttgatatacatgtgcaaattcagatttctcttttacacgcataaatattttacaggccagtgttgcagttcagaaatatactagagatcaaaacctgaacttttcaatctgaataaaatctgaaccgttctgtcagctttgctttgatcctttctcactgaaacagcgagcatctgatctttccctgaataaccgtcattctgaactttctgtcgaactgttcatgatgatatttggtttacaagattaagcaaggaatttggttctgagagtagaaccatcccttcatcaatcagcagcataacaaaaagagacgaaaaagagtaagcctatgtaataataatgcaaggaggtgaaattatggagcacaaagaacattgcaaagcagggttatatagctactacacctagtggcattgagactgaagctttatcctgagtctcattttcttctttatcaaaagacagaggccacttaccaaccagagaggcctttttcgtcaggaaccaagatgaacaagaatagtgttatgctgcaggcttccaaagtctgatctgatgagttcagtgcagcagctgcagcacaaaaatggttgcagattcacagggtaagtcagattacaggatgtattgcacatccagtgcttgatgcagatgaagcttgagagagctgagctgagaagtgtaggatgctctcattcttagcacatgacaatttgcaaagcatattcgactaggtggaattaatatggacataagaatatggctatactaggctactagctcatgagattgaataaaagtcagtgacaggttctctgaaggtcagatattttgagtgctgtcaaagcatataacattgcagtactacagattattgtttttttaggaaggaacattgtactcaagattattattcttgtcttaaaaaaggattattattgttcttctttacaccattttcacatgaaacagtgggctgtcttgggacagagcagcaatttgcctctttgttcctcatagtccagacacaattcagcagtcaactactccagtatgtagtactccatttctcagcagtctttgttcctcatagtcaagaacagatgtaattttcagagttttcactaaatttccaaggtgaattaatccatttcaaaacgagatactcctccaaatagaacactactaccgcataaaaagatttgtactggtacaatagtacgtatagttgattggtttgatacagccaaaaaaaaattcggttctgaatgaaaatcatgtgatatgatcagtttggtgtaaataccccctgttggtctctcttgtccaaaaatgaggaggagctttgcttgggaagtccaatgcaagaggagagtgcagttaatgcgctcgttggccgtttgtgcttgaaataataacacccttccaccaacccggtgagctcgcagctttccaccgcttcgcactcaacctcatgcagatgcagttcactctccatagctaggagtagctactagcctaccactccactagctgcttgagcttgagctgagcccgccattgccgcgcgccatgcgcccaccgagctgaggcacacgaggcggcgagaggcagggcggtgcaagaacgcgatgcgcgcgctccggccgccgccggcaccggctccggctgtgtcgccgtcgccggcgccatcgccgtatgctgcgatgtttgaagggggtggcattagctcgccgcctgctccgaacccggcgacgtcgccggtgccagggccggcgccagccccggtgccggggagtgtggcggagcgggagttcgcgggcggacggcggggcgcggcgtcgagcagcctgagcccgccgctcatcgcgatgctggcggtggtcggggcggcgctgctggtggtgctgtacgcgaggctggtgagccgggtgttcagggcggcgaggcggcggtggcggaggaggaggaggcggcggctgctcatgatcccgggctcccccgccgacgactcgttcgcgacgttcaccacctacgacaactactaccacaccttctcgccgtacggcctcgacgacgccgccatcaagtcgctgccgtcggcgcagtacctcaagtcgtcggcgatggcggcgcgcggcgggggcgggggaggcggagccgacaccgccgcgcgcgactgcgccgtgtgcctgctcgagttcgccgacggcgacgagctccgcgcgctgccgctctgcgcgcacgcgttccacgcggactgcatcgacgtctggctccgcgcgcacgcctcgtgcccgctctgccgcgccgccgtcgcgctcccgcccccggtcgcctccccgctccgcgccgcccgccgcgtgcgccccagcctcgacgacctcctcttcttccaccccgtcccgcaaccaccccacgccgccgccgacccctccgccgcgccggcggagatcaccccggcaagcccgccacacgtcggccgg

SEQ ID NO: 40514 - DNA, 2655 bp, Oryza sativa
gcgctccgagatccgatccgatccgggtggggtggcgaggtaggtgggcctgggtggagagcgaggcgcagtaatggcgagataaatgctcggcctgcacagctcgctggctctttaatggcggggaggacgcgcgcccaggcgcgaggcgcgacgacctcgtctcggattccgaggcggcgagtcaacggtcaacgcacgcatctcagccgtccgatcagaaaacgacggtctccgtcaggccacgtggaggagcattcgttttctcatcggacggctagcttctcgtactactactcccaatgtactactactacactattctgtacttctgctactacaagaagaagttttgttttgtcacggtgaccggtgcaattctgcggcggcggcggcgatcgccggcgagagccgagaggtcgccgcggcggcgcgatggagtcaatgggtggggagaagggaagagcagagccatgcaaattcatgcatggatggatggggagggtggtggggtcggggggggggtgcgagcgggatatgcggggatacgttaattgggtgtctccgaaagcggcgaccctgggtcaccaccgacagcgtggactggggcccactcctctgtccagcgctgaccagtgaccattggtgatatgctatgcatatgcaatttgtttctgctcatcgagaaaaaaaataaaaaatgaaagatgcaatttgttttcttttgaatcgaaaatgcgccttttctaggtccgggtaaaaattctactacgacgtagttgtataccaaattataaattgaatcgtgaattagtatatcttagttggttaagtttaagccttcgacgcaccaccgatgccctactacagttggtgacgtacgccattgacacgctagcagtccttaaacttgtcataagatttgccattgacgcgctagcagtccttaaacttatcataagatttcacttaggtacacaaatttgcaaagtgcacatcgaggtctataaacttggtttatcgtcgtttgaccgtggtcttgcctacgtcgcacgccatgtggataatgacatggtgttttttccttccccttttcttttttctcctattcttttatcttctttcttcactagagccacctcaagctcccccatgtcgaagaggttgcagaagagagaaatgaaagaagaagggagaataataataataataataataataataataataataataataataataataataataataataataataataataataataatatgatatgtcgtcgtgtacatgtcatgctacgtagacaagaccacggtcaaatgagactttagaccagaatgatacaataaaccaagtttagagacctcgatacacattttgtaagttcgtggacttggatgaaaccccacgatagtttaaggaccaccagtgcaacttactctttaaaatattaccagcctacatagtgattgatccatcgatccacctgtatctttcattgaatgaaacttcataattcgaagcgaaatgttttcacacgaaattcatatgaattttagacaaaaggctcaccttgtccacacgattttctttggaacaagggcaaaattagctatagctagggaacaaggacaacgagtccacactccacaggtgggcaccggctgagtaaatgcgatgcatgatcttgtgtgggaggaaactggtggagcagcatgcatgaacattttgtgcacaggcgaaggtggtccgtccatcgccatgatcgatcggcagtgatgaacgccttttagcgagtgatgagggaggggggagggggctccatgtgcccatgcttttaattcttcgagtaatcaacacgtccatccacagtcatcaggccgatctatgcggacatttgattacttgccgtcactactatgatattttgttcaagagacatacagtacaaatacatatgctcataatgctcgcgcacctatttttatgagtgtacaccctacccgttgagttgcgctttggcttcgatcgggtcggtgtcctgacatgatgtatcttggtgaagtcggagttgcccaatcatataagtgatggtatgatgacgataacgtcgcgtctttgcccgtgcgaggagttttgcttccttctcgtgcttttggctataccgtccttgtgttaagtagaattgttgagtgttgtgcttggttggtcttgcttcgttgccgtagtagtttaggcttcaggcttcttggagggtttattgtagtcgtggttttcacttagttttctttaattaattgtgtattataaggtttggtcccattttctttttaaaacgagacatcttcttcttatatataaaacatcggcaataactttaccattccgaaaaaaatgatagttgaaggagacaatttacttcacctgatggatacgaatcacattgagtcatagttgagagaatcgaaatggacatttttcgttatttctaggaaaacatacaccgaaggtccttggacttgtcatcgagttaaaaaacatccttaaaccgctaaaccagatatccagtgtcccttaattaattaaaaccggtcacagtatgtcctttaatggttttgaccccggttttgtccgacgtggtgg

SEQ ID NO: 40515 - DNA, 2820 bp, Oryza sativa
atgttttttttaactcgatgacaagttcagggacctttggtgtactttttccttattgttaatcgaagaaagtttacagcccacgtatctgctatatatgggccgggcttagtactgagcccaaattagtcgtctagtcgtcggtgaattcaacaccccacgctagacggccgccatggccttctcctcctcgcctcctcggtgactccgcccgccgccgctggctgccggcgcagcgccaccctacaagtcaccgccccaccgcgagaggagggcgggcatggccttgccctgctcctatggctcccactgcgccgccctgcccttccccgccgtggtctccagggcggcctcctcgccgccaccgcgctcccgggggagaaggcccagcctaccacccgccggatgcttccacgccgcgccaagggacgccgctctggtgtccggctccgctgctggtggcgtgagcaggaggaggtttggtgccccgtgaatctcctagtatacctagtttctttcgaatgcctaatttattgctccaaatgggaaggaagaaaccgtgtcagtgtcgttgtttcgattgtattagttgatgatgtatttctggtttatgatttgatttaaccggtcttgctggtcattcggttgaattcatcagcacgaacaatccacaaatggctttgttttgctcaaagagttgttctgtacaaactttagaactctcaaagcttcactgttttttgggaagcagcaaactgaatttgaacctgatgtgtagtagaattgtggcattctactagaaaattgtgttgcctgcttgccactgattgttctgactatgtggttgtattcaacaggtgtgagttatttgacctccatcagcacatcgttccatttgcggaatcttgggcttggcagcagtccattgtgacaaggaggaaagggttggtaggcacggatgaagatcactccgacaccttaatcgcgctgcagcatccaccagtttatacgctaggcactgacagcaccgaggactacctccatttcgatgttaaagatgctccttttgaggttcaccgtattgaccgtggtggggaggtgacatatcatggtcctggacaggtatgtaccataatgtcagtgaagctcatattgttacatatcacgaatcgtggttcatttcttttacttgtgaataagctgtatggttctccattatcatctagacatctagttatagatagttaaaacttcaagtataggcctagctgtgcaatctggttaccagaatgtgatgaaatcttgattttcactaaggcagaagattgtggcttgttttgctacaatttatgatgtattctacctagttaaacttcatgtatatccctagctgtggttaatctggttatcaaaatatgtgataaaatcctggttttcccggaagattgtggcttcgattcctattggatactcaatctttgcatgaaattcgtttatagctaatatctgtgcttctgacagtcattttattgtctccttagcttgtaatgtacccgattatcaacttgcgatatcatcaaatggaccttcattggtactttagatcacttgaagaggtgatcattcgtgcccttcagtccgcattttccatcaaggcatctagggtagaaggtctaaccggtgtctgggttggtatggtactatccttttggaaattgtgatattattttgaattttctgtgagatataatgacgtgttactaatatatcccctctatttactttttaggagataagaaagttgcagcaataggaattcatgtctcacgatggatagcatatcatggtctagcactcaacgtaaccactgacttaacaccatttcaactcattgttccctgcggcataaaagatcgtggcgttgggagcatcaaagagatattgcaaatagcatctgatggaaaagagatagacgaaacagcattgatcgataaagcctacagaaccctgcttaaagagtttgctgaagttttccagctctctttatatcacaaccctaactgggatcttcaggaaagcaaaaattttagttaactgcagaatattttattggattcttgaaattcaacttgcattgaagtcagaaaccagtacaggtggatagagaggcaaacataattagatcaaagtgaagtctccttcactctaatatcaccaaaactgcagaactagtcatccatgtgcgcaagctcaaacttttgcttcacctgccaatcagataacgctatcagttttgaagatgatggtaatatgtaggagaggtgagaagttcagccaagccaattaaccttctgttaggagccatgtgggctgcaatatgggctggatcagctactttccaaagaagtccaagcaagcccaagaggcaaccatatataagtagcagtagcacttctaggaggggacgaacagattgattggccaaggcggcgaacggcggcggcggcgacctggaggctggctggcctctttgtcgatctctcctctatctcccttcttctctactagtctagaagctactagaaccttctagcccttgtatccttccatcttccacctcaaaaccactccactattgtaacagacttggttgttccctgtgttggatttggcactgctatttctgaaattacattgttgggtgggtctctaacaatctggtatcagagccaacaatccccactgagttcaccaagcaagctgccatggcaagtgaacataagttggatatgattttgaggcgaatggaagagtttgaac

SEQ ID NO: 40516 - DNA, 3739 bp, Oryza sativa
acattttttggttggaaacaagcagtacaagatgacgcccactatgtgttcgacagaatgcttcagccccaatgtcgagcccaatctcgctgttgatgtggttgttacgtgtgccaccacttctatgacctctgttgatctggtatctgctgaggacgcaatcggtgcaacctacatctacaatcctgtacagcccatggtaacgcccgccaagtgtttgacaaattgctccaaccccaataacatcccagacctcaccgtggcagcagtggttacgtgcacctccacttctctggcctccatggacctggaagttggtaaggacgtcgcctgcaccactgaaattgatggccctgactgtcacaaggagacgcacaccaaatgttcgatgttaggccttgatgtcaagggtggcgcagaccacgtcgggggcgtgttcctgacaatgtcaggtgtggccaagtctgttccaatatctatcgagtcaattgacatcttctcagcaaggttggtcagcgacctcaagcaggacataccaacacccaccgggtgtttgttgagaatccctcgatatgacagcaagacacagttcaataaaaagctaaggctggaggggattgaattgaagccatggccacctccaacctacagtggagtgattagcggactggagttccgaccaatgccctggccagcattcatctattgttggcttgaagaacatctacttgatccttggccaccaccaactgaatgggctgagttggaactgtggcccccaccacatgagaatgacatcctgcccttattgatcaatggcttcacccatatcctggtggatcgaaaagcaatttcaaaattctggaaagcgatttggagtgagttaggtgaagaatggtcattgtttgttcctaagctatatgagctgcacttgagtggtctccttcagcattcagtaagcatgatatcacaacagcttatgtcaaggaggatatggtccactaaggctaaaatgaagatgttgaatggttgggattctaaacagtacctgagcattatgcggcctattccaggattgtttgttaaacttatccaagatatatctccaaagagccatcatcaagcttatatagaagctcaagttgctaaaaaattcttggaaaactttggtgaagataaggtacactttttggctcaatcaattgctgtacctgacactcaccttggacaaggctgtattggctgttgttggttgtatggcccaaatgcaattagcacattccatttactaatagccatactgcatattgtgagaccactttacatggaaaatattttcactaggacttcacatgtagcaaagaaatgggctaaagacttgaaaggtgttgtgtttgattggaatacactgggtatagtggttcaagaggtcaattacattgaattgatctgtgaccgggattcgtatggttgtagtgttcagaagtgctatcctcagtctattctattcatgcacaatggttggtcttttggtggattgcttgattggaactctaaacaatacaagaacagtatgctaattgtgaacccattggaactcatgcaagtactgttagtgccattagtgtgggatccagatgctgagatgggtcagattggtagctacgctctacaaccagaaaattgtcaattaactacctgcatgagagcacattgcattaagccaagtgattatgagatcatcactgccaaagaaaaccatgctgctgatgctcctagactgcttattgttgtaatggaggatgaaggcaatacagtttggactttagaattttcagtcagtggagtggtacagaagaagcgtgatctttggttgtgtgcatttgctgttaacaaggacatgaaggttgttatgttcctgcagcaatatggttatgcaaacttagtaattgtcaatttattgagtgttccatgggatccaggcggctctcatttggcattagctattaaacaaggaactaggctttcactgtgggctattacaagcattggctggttgtgtttcctatggtcatattggctacattacaagagaaatagtaacaggggagatcaagtgggtgaagcttgcacagcttcgagtcatcggcttggggacaagccgaatttcaagggaaggagaatgttaggagccatgtgggctgcaatatgggctggatcagctactttccaagaagtccaagcaagcccaagaggcaaccatatataagtagcagcagcacttccaggaggggacgaacagattgattggccaaggcggcgaacggcggcggcggcgacctggaggctggctggcctctttgtcgatctctcctctatctcccttcttctctactagtctagaagctactagaaccttctagcccttgtatccttccatcttccacctcaaaaccactccactattgtaacagacttggctgttccctgtgttggatttggcactgctatttctgaaattacattgttgagtgggtctctaacaccttctttggggttcgaagtggatccatctgcctttgtgtcaacacccggccatggcttgcaagtacaatgtttccccttctcgataccgtcgtaaacggatgcgacatgtttaccacatccattccaggtgaacttgccacatttgctgcattccaccttgaagcacatcctgtgctcttcttcaggtgctcctttggtgcgtggtgggcagtggcaaatgttgggatgttcttttggataggttcctctggtcttcatggatttcagcattttatagcatcatatgctgttcttcttctgaaggaacaatgtacaaataccctatatatgctgttcaatgtagtctttgactctttggtgatggatacaatgtatggataatgtgtaaaatcttgcagttagtgaaactgtagatatttcctatgctgatgcttggtatgttgccaatttgcttcatgtgtaaacaagtctgggatgttgtgttcttgttgccaagcaagatcaaaccacattttcttgtggttgtatagatggttcaacaacgaagagaccaaagctgtaaaaactatcaacttgaaatttttgtttctgtgctagtccaactttagctatacagcaaacgttttttcaattcggcatatgaaatactttgccatgtcttagaactaggctaagtagcacacatttcgacacatcaaaaaaatgttaaattcacatcaaattcagattcctctttgaattacaagtcaaatcgagagctaagcaaatcgcggcatggagccgttggtcgacggcgagctctggtcgctgacccacacgtcctgcaccgacaccggcgacccgaccttcttcaccgcggcgtcgacgccgtcgaagccgacgccgacgtcgatcaccatgggcgggcggctgccggctccggtccgggctcccggcacggacgccggcgcggcgtccctgatccgggcgagctcggcggcgacctcgctcatggccggcctgacgtccttctggaacgccaggcaccggaacgcgagctcgctgacatggcggacggagcgcatcacccactcgtcggcgcggtcgacgagcgccggtcgacaatgtcgtcgacgcgccccttcccgatgcggtcgagagcgagcgacgcgaggttgacctccgccgcggggcgggcgaagtcgacgacctt

SEQ ID NO: 40517 - DNA, 13059 bp, Oryza sativa
gcggtggaggatgggcggccgcttgacggcaaggtaggcgatagcggcccccgtgtccgccgcgacgccgagccgcgcgcgccatgggagccccccaccggcgaggtggtgggcgagcgtgccgttggggacgaactcgtagacgaggatctgctcgccgcggtctaggcagcagccgagcaggcggacgaggcccgggtggctcagcgacgagatgagcttcacctcgttgaggagcaccgccacggcggcgtcgtcgtcgccgtcgtcgtgccgccgccgcatccgcttgatcgccaccagcgacggcgagctcgccggcagcttgccgacgtagaccgtgccgtaggcgcccgtgccgaggcggtgcgtgtgggagaaggagttggtggcgcgcgccacctcgtggtacgagtacaccggcacgccgctcgacgacgccgcctccgacagcagccgcttcgccgccagcctgtcgaagccggaccggccgccgccgccgccggatcgccggcaacgcgcgcagcagaggaagagcactccggccgccaccgttcccgccaagacacctgaaattaattaattaattaattaacccaagcaatcatgataattagttggtcaaagattaaatagtactctcctaattacacttccagtccactgtaattatgctactccgctcataatactcgttgttgttttagataaaggtaaagttaaactttaaaatatttgattataaattattttaaaaatattcgtcttttaaatatgttaactacatgtatagaaaagtatttaaaaagtactttactaaaaccatatatttcttaacacttttatatatattataataaaaaaataatggtcaaaatttgtttttttagaccgtgctcttatccaaaataataagtattattaaccgggggagtaattagttatttggtcaaagattaattagtcctacactcctaattacacttccagtctacttagttcactgtaattatgctaattaatttggattactgcgagctaaatttgaccttttccacgaggtacatcttatgaaattctcatgacaattatgcgcttaacccaagtgtaagtcaatcttctcatgcggcaaaaacaaatacgcagaattgttggatgcaaaagggggcgttttttttttttgctccaaagaatattcttgatttttttccttagagtttccaggtcaggagtcagcatgcatggcagccattccacgtaagttgtagaaataaaaatttacgacaaacttgacttgatcgcaacaatttgactctacgcagcgtcgtacacgatactgtattgtgacagattaacgttatacggagtaaactccaacatgtattaaaaagaacagtaaaactcaagcataaggcaaggagtaacatttttttttacctccaactatgataaggattttcttcgtagagctcttcttagctgcaaaaatggagagaaaaaaaaattggtcagaccttcatatttatttcagtttgcaaaatatgggcagaattggccatgctgaacatcataaattggatcaggtttttggtagcagttggttggttttctgttaagagcaaaattgacttgatttatgacaaaattgtctctccacgtgaggatagctcccaccaaaattgtctatgcattaagatgagaaaattcaacagataaattttccaaatacagaccactgaaccaaaagaaggtggaattcaatttgagtactgatgcttgaaaatttggtgtttttcttctaaaaataactaaattccggtcaaagagtttgatgaggctatttattgccgtaggcattgatcggtatcatcagatgcatcatgtcaaaatgtgacaaactaatatgctgatttatgcagacaattcttgttgttcaaaccaaagtcgccatctttgaaaatcgcacgcttacagctatacaaaatcggcagctatttctctcataaggctattttgaagcacaacaattttactgaactattaactcattacttaaaaattgcagcaaaattcctctgttcctaataaaaggctttagttggtctgaaactcatttcttcccttaccaaatcgatcggcttataattttataattataaaatgtgggagtatctcaaaatactgctacagttttgagtaaaaaactttcagatgtaactatgatataatttaatgtaactgcattataatcgtattataactatattgtaactacaatataatttatataaaacttacattaaaccacggtttagttagttagcactagtatcttaattacacgtgacatgcgtgaaaacttatttttaatattttttctcttcctgtacaaatctcgagaagatctgattgccacgaatctaaaatttcttttgacaagaaaaacatacgaaagttttctagcaaatctgaaaaatgcaatccacttttccaatgaaattccaaacagaccaaagcaaagcagagcccctagattgtctcgcccgtgattgaccgcaccgatgactttcatgaatggagctgacgtggagcgccgggaagtgggccccacccacctacgacggccgaaagctatagagaggactcaccgggaaagtggcatccttcgccggcggcgaacccgtcgccgtccatcccctccagacacctgcactggtgtccccacgccccgctcggggtccgcacgtcgtggcacgtcgcgttcgccgcgcacagcccgacgaggtcagcggcggcggcgctgtggttgctgcagttcccgttgacccaccaccccatctccgccacggcgatctccagcgtgaacaccccatcgttcgtcgtctcgccgtacacggatgtcagcaggttgtcgcatctaggctcctcgaccttgtcccactgcgcgaacaggcccacacccttcgccatgtccgcctccgtcgacatcgtcgggatgcacgtcaccggcgacgacgcggttccgttgccgccgccgccgccgccgcacttggctgtggtgagcatcgaggacatggcttcggcggggacgctgcagctgttgttcttcgcgttctgacagccgcggacgaacaggccggtgctcgacgacacgccgtagttggcgccggtgagccacagcctcgcgtcggagacggtgcggttgcaggaaggcaggagggagacgacgaaggtggaggcggtcgagttgaacgacttgccgacgacggcgtacgacaacggctccatggtcgtcgacgtgccgttggtcgggcggagcagcgccgccgtggagttgccctcgtcgcaggccagcaggatggggcagtcgccggagaagccgaaagggtaggggacatccaacccaccgcacttcctcctgcaccgctcatctccgccggtggcggcggcggcggggctggcggagagagctccataggggagaatcaagaggaattgcacgccgacgcagaggaggaggaggaggcggccgccggcgaggtgcatcttgagtttggctagctcggcaggcgagcgaaactaatatttcagccaccgggaaggaattggctggagcatatatgttgaaatgtttgaatggacctggggttgcggtggctaaagctttgattagtcaagcaaaacatggtcaatctagagagtacgtaattttaagaacgaccatatccttgtgagtactacacgagggaggggcaatatggaaggtaattccatgggcctagcttctacaccttccgttcaagaaaaaccccaaatttaatcctagctacgaaacttaacacacatgtactcacattcatagttaggattgattttttttaatgggatgggtggaatacctctttatcttgagaaaaaaaactaatggttaacttaaaacctctttgtcttgaaaaagaataatataactgttaacttaggatcatgagagtaaatataaaatagatcaaaataaaaatttaaggacatgtaaggatatgattaaggaggtaaagagaaactctaggaggcgcacaaggaactttgtcttattttttattttgtcttcactattttactataacaactactctctcatttttcacgcgcttacttccaaaactgctaaacgatattatttttaaaagaattataaaggaaagttgttctaaatatatattttcaagtctttaagctaatacttaattagagcctgtttggcacagcctggagctcatccaaacagtttcagctccactaaaaataggagcagagttggatggagctctcttacaaaatgaattagagatgtggagctgggtttaggcagctacataactccactatagatctaactcctgaagctaaatttagaagttggacctctaccaaacatgttaattactcattttcgccttttcggtgtagagggaataacatcccaaccttgaggtttgaactgatctttagacatctttatacagagactgggtcatggagtgcctaaggcttagggtcaaaagcccatgggccacaacacttctttccattttaggccgagctcttcacaaattgatggaggctggctcgagtcttaactttaagctaggtcgatttttaatgttaactcatttttttttggcaagttacttttctcgttcattaatagacgcgtacaaaacatgcagttaaattttgaaaccaaacaaaaattatagttcaatatatgaaaatagaattagtagttacttcctccgtttcatattataagattttctagtagatatttgtaaaaaaatatacacattaatattttaaatacttttctgaacacatgattaaaaacaaaatgatcaaatatgtagatgctgtactgtcgacatattaaagaacgagtaattgacctatgatgtagcagcctagcaggttgaattcaaatgcgagaagccatgctagaaaaattggtggtttctcccaaaaagaaataatggcaggtcaaagagtttgatgtggctatttattaattttttttgacgtgagatgtggctatttatcaccgtaggcatcagcatcatcagatgcatcgtgtcaaaagtatgactagttgacaatcatatttttttgcaaacaatttctgttgatcaaattaatcaaatcgccatttttgaaaatctcacacctatagctctaaaaatttgtcaggtattttcctcacagttctttttaaagtatttctctcacaaaaattttacggctccttgaacttattttaaaatttcttttccaaatcgatcaactaaatttaaccttaacgttttctataaaatgcactccactgtcactctgtcagctagctttaggtgcgaaattgtgaactagtacatgattagattagctcgcgcgtgattgaccgcagcaacgactttcgcgagtgctgctgacgtggaacgcgggggagtggggcccactcacctacaccgcttgaaagcttagagaggagatatatcaggagaggactcaccggcaaagtagcatccctcgccggcggcgaacccgtcgccgaccatcccgtgcaggcacttgcactgatgcccccacccgccggtcggtgtctgcacgttgaggcacgtcgcgttcggcgcgcaccgccaggcgaggtcgccgccgccgccgccgtgggtgcagttcccgttgacccaccaccccatctccgccaccgagaactccagagagaacaccccctcccgtgtgtcaccgtacacggacgtcagcaggttgtcgcagctaggttcctcgagcttcttccactccgcgaacaggcctactatccccgaccccgacgacgactctggctttgctgggtccggcgccggcgaggtcgacgtgacgcaagtcagcgccgacgcggttgtgttgccttcggcgccgcagctcgccgtggggaccatcctggacatggtttcggcggggatgctgcagttggtggcgttcgaggcgctgctgtttctatggcagtcgccgcggaggaacaggccggtgcgcgacgacacgccgtagttggcgccagagagccaccgcctcgcctcggagacggtgcggctgcaggacggcgggagggcgacgacgaacgtcgacctgctggcgttgaagttgctggcggtatacgagtacgacgaggtcgtcgtcgtggcgttgccgccgccgccgccgccagggaggatcaacgcggccgtggagttgccggcgtcgacgcaggccagcaggatggggcagctgccggagaatcccagagggtaggggacaaccaacccgccgcactgccgcctgcaccgctcgccgccgccgccgggggccgagagagccccatcgggaggaatcaagaacaggtgcacgcagaggaggaagacgaagccgccggcgaggcgcatctctagctactagactatacttgagaggtagcttagctaactcggcaagcgagcctaatgtttcagccactggggacgaacgattttggctggagctgttgcttcttgaatgggctgagtggtggtggactggtgggtgatccggtgatggactgatggtggctaagcttgattattagtcaggcaaaatcatggtcaaattggtcatggagtatcttgaaaatggccatcctttgttatgattttgtgctctcgttttacttttacttttttcctttagctagattgtttttgttgctgttttgactgctggtgatttatgttcatacgtaaatccgtgggtttgatcttactctctcctgttgaccttggggtcatgtcggtattagtaattctcattacttcaaccttctagacttttttcttgttagtttttcttatatttgatcaaacttataaaaaaaattagtaacacttacagcattagattagtctcattatatattttgataatatgtttaatttatgttaaaaatattattatatttttctataaactaaataaaaaagtttgattagaagatagttaaagcgacttatagtgtaaaatgaatagaatacattttccaagtgtgtttctaagtactcccttcatttcatattataagtcgttactctaagtttgattaaacttataaaaaatatagtagtatttttaacacaaaacaaacatattatcaaaatatatttgatgttaaattttatgaaactaatttcatatgtccccagcggcggcggcggcggcggctggggacggcacggatggcagcggcggtggcggctgggacggcgcggacggcggcggcggtcgcagctggggacggcgcggacgatggcggcggtcgtgcctggctccagcgcggacggcggcagcgatcattgctggctccagcgcggacggcgatggtggtcgtggctggttccagcgcggacgacggcggctgtcacggctggtgatgcgcgcggacggcggcggtggtcgcggctggctccagcacctctctcctgcgtgccgtcgctgttcacgagtgcccctgccgcagccttcttgctctagccagggggagagggagagatggggtgggagggggagtggtggggcccacgaatagctaggcagagagagtctccaagtttggccagtgagggatgagatttggccatccggatgtcttggctagtcggatggagagactgttggagggtatttttctcccatacttactaaattttagcttggccagccatttagccattctagttgctctttagatacggctaaatagagacggcaccaggcctaggatcaaaagcacatgggccgcgacactttttcttaatcatagtggaccaagctcttgacaaataaatgtagcgtagcccaaatcttgattttagtctatgtctatatctaccattaactaacttatctatctactatatattattttatttttttagataatatctattttttatagttcaccgactacagtcctacaaaccttattcatcaaatccgatgatctaaattcatggagtccaatggccggctctgatcgcccacgtctcccccttagactcccctccccgcacccatcctctcacgcagacgacaccgcctccaccctcctctatcttgcactcacccgccgccgctgcctttgccctcttctctctcgcactcacccgacatcatcgacgccctacccagcgtagatcgccatcgcgcgcccctccgtcgtcatcgcatccctcccacgccatccctctacggtgaacttcttccgttcattaatactccctagacttgtatatgacatgtagttaaatttgaaaataaataaaatggtttaatatacgaaaatagcattggtagctagagacttgtaaaaaaaccattaatattttaatgccttttctgaataggtgattaaaagcgaaatgaccaaatgtgttggatgttatactattgatgtactacctccgtcccaaattagtggttgctttcactttttttaacgtttaaatattcatattatttaaaaaattagtgtaaatataaaaaaagataagtcatacttaaagtattttgttataataaaaacaagttacaaacaaaataaataatattttcataatttttttaataaaacgaatgatcaaacattataaataaaaactcaaagctacaaaagcgagacggaggtattaaacaacgagtaatcaacggagtagtagcaggttgaattcaactttaagaagcgatgctaaattatcacagtaggcatcagcatcatcagatgcgtcttgtcaaccagcctcatcgtttggcttaaacggccaaagaataagccgttaatgttggcttttaagtcgctacgaataaatctacaaaagttttacttataaattaattttaattttctaataagccaaataagccattttgggtaaaacgggcaaccgatgggagccaaagtatgacaagctgacaggctgatttttgcaaacaatttctgttgttcaaattaatcaaatcgccatttttgaaaacctcacacttacagctctaaaaacttgtagtattaatttcactcaccgtttctttttaaaagtatttctctaataaagattttagggccttttggacttatttaggttgtgttcttttcccctcttttccaactcatttccctcgtttttcacgcgcacgtttttcaaactgctaaacggtgcatttgttataaaaattttctatatgaaagttgatttaaaaaatcatattaatctttaagtttttttaactaatacttaattaatcccaccataatcgtgcgcttcgtttttcgtgtcaggagaccttgcctccgaacacaggctaaagttctttccaaatcgatcaactatatttaacattaacgttttataaaattcactccactgtcagctagctctaggtgcgaaattgtgaactattgattagattagctcgcgcgtgattgaccgcagcaacgactttcgcgagtgctgctgacgtggcaggcgaggccgtgggccctattcacctacaacgcccgaaagcttagagagtggaggactcaccggaaaggttgcatccgtcgccggcggcgaacccgtcgccggtaaaccccggcaggcacttgcactggtggccccactcgcctcccggggtctgcacgtcgtggcacgtcgcgttcgccgcgcatcgcccggagaggtcgccggcggcggcggcgctgtgtttgcagctcccgttgacccaccatcccagctccgccacggcgagctccagcgcgaacaccccctccggcgtctccccgtagaaggcggacgtcagcaggttgtcgcaccggggctcctcgaccgtgtcccaccgggcgaacatgccgacgccgagcgcctcggccgtggagttgggcgggatcgaggcgatgcacgtcagggacgacgccgacgcggcctcgtccccgccggcgcactgcgccgtgcggagcatcttggacatgacctcggcggggacgctgcaggcggtggcgcccgtcgcgttgcggcagccgccgcggaggaacatgccggtgcgcgacgacacgccgtagttggcgccggagagccgccgcctcgccccggcgacggtgcggttgcatgccggcgggagggagacgacgaaggtggaggcggtccggttgaacgaggaggccacgacggtgtacgactccgccgccgtatccgcagcggcgttgtctgggaggatcagcgccgccgtcgagccgctctcgttgcaggccagcttgatggggcagctgccggagaagccgaatgggtaggggacggcatccaacccgccgcactgccgcctgcaccgctcgccgccggcggcagcagggctggcggagagagctccatcatcgggaatagtcaagaggaggaggaggaggaggaggccgccggcgaggcgcatctctagctgctagcctaatcgacaagacttgaggtagcttagctaactcggcaagcgagcgagcgagctagcttaatatttcagccactggggacgaagagcccccatcagttcacccgataaaccaaagcaaaaagtcaaaatttaaatttttaaatttaaattttaagttagttttaagatattttcaatataatttgttttaacattgacttttaagtcgctatagatacatatataaaattttacttataaattaatatttattttctaatagattgtttggacttattacaaaatatataggcagctcgaacgattttagctcgagctgttgctcgttgaatgggctgagtggtggtgggtgatggactgatggtgactagagcttgattggcaaaacatgttcaaattggtcatggagtatcttgaaaatgaccatgcatcctttgctatcgttttactttacttttttttttgttttagcttagattggttttgttgctattttgactgctgccgatttatgttcatacgtaaatccgtgggtttgatcttactctctccagttgaccttggggtcatgttggtattagtagttcattagaacaatatactagttgttttagtactgttggaatagaagaatattcccacgaaattcatgaatcaaagttcaaactatacttgaatgaaaagttttctcgcatttcaaacaggaccacacagaacaaatgatccttcatttttgtatctgagctgtcatctctcgtcgtctctgtcgcccaatcactactcatcccctagtatttcactatcgtttttattttattttatttttaccgtgacatgaacatcacgcaaccgtgttgaaatagagataaataagaacaaactaagcatgtcaattaaggtggtgtttggatccataggcttaactttagtctctgtatttacatactaatttagagtattaaatatagactatttacaaaactaattacatcaatgaaagctaatttgcgagacaatttttttaaacctaattaatctataattaaagaatatttactgtagcatcacataacctaatcatggattaattgggctcaatagattcgtctcgcgaattggtccaagattatagatggattttattaatagtctatgtttaatatttataattagtgtccaaatatccgatgtgatagtgacttaaaagttttagtcccatttaaactgggtctaactaaagtcacacaagattttaagttcatggacatacgtacgagaagagatagaaacgtagtaataacaaaacaaaaaaagaagagtcgagaatctccctacagtgatttccgattgatgccatcatatcaacaaggtcgtaagtctcattaaacatacttgataaagcaatcaatcaattaactacatacaagtggttatatttgcgtcattagagactaaagaatattatttcatatagaaaagatagggacctacgcacctactagcttgacactcttgctctcttagggggtgttcagatggggctaaaactttttagcccatgtcacatcggatgtttagacgctaatttggagtattaaatctagactagtaaaaaaaactaatttcataaataagagctaatccgcgagacgaattttttaagcctaattaatccataattatcaaaagtttactgtagcatcacattgtcaaaatcatggcgtaattagactcaaaagattcgtctcgcgaattagtccaaggttatagaatgggttttgtaattagtgtatgtttaatactctaaattagtgtcaaaatatccgatgtgacagggacttggagtaagtctctagaaaccaaagcccttatacttccactcaatttctcctttttcttttaccttcggtttgcctaagcctagaagttgacagacctagttgactatcaggaaacagcttgtggtaatttttttttaccttttttggtatcgatctcatctcaccatagctgctcaaacatcttgaaatagcttggttgccaaattatcctatagttcacaaattaaattgttttagaaaacatgttgttaattaaaacctccaaattattaattcgctaatataaaatatgatatgtcaaaatagcatggatcataaaacactttcatacaattatatcttttaataatttttgcaaattaaagatacgattaaaagagaaatgatcaaacatgttgtatacaatgtgatattggtatatgccaaataaaaaggaacggctagtgtccattttttttcaccagagtaccaatacggagtaccaaaaggagtattctgtatcagcttttggtacttactccagcatagtgtagtgcacaaagaaacgaactgaatggcgtttagcaatgattgatgtcccattcactctgttttcttttttattaaatcatcccagggatagctgggatatatagcttggttgtttgatgtggctgaaaaacattcggcatatctctgtccgtgatggcaccct

SEQ ID NO: 40518 - DNA, 4756 bp, Oryza sativa
tcattttttttttaccgtaggtaatgataaatatggtaattgccttccttttcaactgtatgtcgattggaacgtttgcctttcgataatgacatggttgtcctacaacgactcaatgattcaatgaactatagttactttagacgacatagaaaaaccaatcaaatttatgtttttgaattaatataatcccaagccgtcagattatcaaacagctgctagatgagacaaagtctatcagtactgtgggcttacgtacttgggtgtaactaactaaactaagccgattgatctggtacgacatgctgccatatcgatggttcagattttggttagaattaattagcttaattgcatcggcacggacccaatcattgcgacatttatgtaacacaagatttctctccgtggcgtgcatgtgtcgtcactctcaatgtgtgtccatgtgattgatgtgtacatgacgatcgatgagcaattaagcgttgatcttggaaggccatcaacttaaggacatgttattttcctcttaatggattaataattcaccggcacactttgtaaactctcaaacagtacatgattctttcttttttttaaaaaaaactttaaccttatagatgaatttgttaaaacattaatttaagtccactttgtaacttaattaattcatttatctcttcagataattagagattgagatatatttgatagtgcagtgacaataagtatacggttttaattctgaggtccgtccctccaaatttctttatttttaatcttcatacaattatcacaaatcatatatctgaataaaagaacaccacccttaaattataaatcaaggtgggcacagccacgccattgtcgtgttcccgatgaggttggcgtatatacgtcatcgggtttgatcggtcggttgcgattgcatcatgcgcagtgtgcgacgcgctaccttgcgtgacggctccgcgcgcctccctcgccgtacggcacgtatcgagatgaacacacgggtcacgcttcagagttcacacctactacgaatcagcacgtacgtacaagagcactgttcacatttcgttttgggtagcctagtgagatggatttcacgaatttcaaacgaagttcacgtaggccgcggtgaatctgcgggtgcgttcagttcacgctaaaattaaaaatttggttgaaattaaaacgatgtgataaaaaagttaagaagtttgaagaaatggtttataactaaacaaaacctcgaatgaaattcggtaaaagtaaccgagggggttgatttgggagaggttctcagaatttatttttgtacggaccgagtggtaggttatttataatggaatatgttgatcatatttggggtatgtttagttcatgctaaaattagaagtttgattgaaatgaaatgatgtgattgaaaagttggaaatttgtgtgtaggaaaattttgatgtgatggaaaagttagaagtttgaagaaaaagttgggaactaaaccaggccatgaatgggtgcctgtatttatacctaatcatccattcggtaataagtgacgtaccaataagtaacgagacgtcttcgatgacttcgtcaatcttaaggtatattggtttagtcttcgaatatgtttattgaatagagtgtacctacgtctgtgtattcatacgtgtaagtgaccacgtgtgtatacgagcgcccacatctataccgtgtatcggaaaaaaataaaattctagacgacaaaagttaacatctaactagtgcttcttacacagatacagatggatgctatagaaatctcacgtgatggaaccaacccatccgagtccaagtctcagaggggggtatttggatactccaaattagcgttcaaacatccaatatggtaggggctaaaaagttttagcctatctaaacagagcctcagagttaatacatatatttgcatctacgattaattattcttttagtggtacgtgatatacatatcgacaacgagacgttcgtgacaatttcgtcgatcttaatatatgtccgttcatttttcaataatgtttaaaaggtaggacatacgtgtatatgtttacaggggacgagtatacgcgcgttattaccgctggaaaaaatcaatcaattataaccaggggaagaaccacgtcaagtagtgatcgtggggttgtttcgtggcccatgaacccacctactacgggcggccgtgggcccactaagttcgagtgggccatgttgggcttattatgttgttccacacaacttccatgctcacccaaccacacggtccacaccaacccacgcccttggacgcacttgcaggaggaatgatcttgtgaatgtgagatctcttctagaactgacatagatatatgtgcaacacatatgaacacaaatataccgatctacactttggaaacctcgaattgaaacatatccaatttgactccctagaatatatgtagaatctcgcatcacttaaccgtaaaatcaggtataatatctccaaatgttaaaaccggtatgaagtgactcccttgataatattgactgtggttttcgctgacgtggcacattgaccctagtcaaaccagcaaacgatgcaatgaatgcaaaaacaaaaagttaaaatgcattgtcccgcatgtaagtgaggtacccttcctttctactggccctctttctccccacgagtggcaagccagacataagataggcatgcagcatcgcagttggaaaatggtggtggtggtggtgacctgtgagcgagaacgaagcggtggcggacaactcggctagcgcggagggttgaatgcgggctagattttttgcggtggtgccatgaggccatccacaatgggtacccctgggtcgtgcccttgctcactgcgtccgtccgctatccgcgcgccgtgccctagaggggaacacaacccccacgagggggacgtgtggctttggctcctccaatccccttttcctgaggaacggctcaaaggaccccgttgtggcgacctcgatgccccatcccccgcctcctccccctgcattttcccttcttgccccccctctcagctgggcgtggtgaggcggagccggcgtagactgcgcggcctcgtcgatgtggtggacggcgacgggcggcgagagagagaggcggcgcggccagatctagcccaccgacagccggatctggagagagaggcaggagcttggacgccgtcggccaccgcactgtgctcttgctcccgcgctcgcgcgctgtccagcctcccgccgtcggccacatcgcccctcgcgccgctcgcccgccgaccagctctccggcacgcgcggagacgggcagccgaagggcggcggagggagcaacgacgagagagagggaggaaggcggccctcctcatcgcctcgcggctgccggcaacgagagagaggcgagcatcgagagggagatagagaggcgggcggtggcggtggctggggagagagggagatggatgcagggctggggagggcgaggagggaggcggtggcggtggctggggagggcgaggagggaagcggcggcggcgagcagcgggggagagaggaggaaggtggcggtggcggcgaatgggcgacgagggcgagaataagccataagagagaagaagcgaggaagaaaagagaaggaaaaaagaataatgggctggagaaggggtatttggggatttttcatctggggctactttgggccaagacacccattgtgggctataatacccttaccgggttgcttcagattttaaggagctcatccagggatacctcccattgcgagccgagttttctacgagtgtcctcggttagtgaggacactctaggagtgtctcacattgtggatgtcctaaggagctcagcagtggcgggagatagacgtcgtcctcactgcccccacgccttgctgccatatagattccaaggagcttcggaggtccatcgctgtcacatctgcatgccagctccgaaggcttgagctcgactagggaggtagacccggcaacatcacgacccttcgccactaggcggacccaccattcagttgttgttgcaaccgatgagaagctgttggacttgtgtgggggcactaccgagcctgactctgactttgcctcaccgtcgccatcgcccttgaccatcccgagtggtggactcctcgtggtatcgaccccttcccctccccttgaccatccccgccggctgaactgcaccagtcagattcagccataaagcgctaatggtgagccgacaaggacgggatgaaggtagaaaaagcctctcctgcctggggaagcaacaccatttccacccggtcttcttcttggcgcagaggatgacgctagagaaggtgtcagggataaagttgacaatgaagatggccatcgcgtggataaagcttagaagacgccaccaccgtctgctattgccaaagccaccctgttgcacacgagaagacgatatgagagacggagggggtaaagagggaggaatgacatgtgggggccactttttaaaaattctttttataagtaggtgtttttcttgttgattgcaggatcaaatcaactggcacgttcatacatctgaagacgagctttgaacctgcactggagtcatacatctgaagacgagctttgaacctgcactggagttaagcagatctcccaggcctcgtgttttctgtcaacagtag

SEQ ID NO: 40519 - DNA, 1467 bp, Oryza sativa
gcaactccccttggggtacgcgatcgacgccccctccattcgctccgcccgcaccttcggcctcctcgacgagtacgcgcgggtccacgcgcagcacgcgcggggcggccccggcgccgtgcccgacatcgccgcctgggaccgcgccttcatggagcgggaggtcaccgacaccgacgagctccacgacctcttcatggtaaaaaccttgatcgcctctcgcctgcttgattgatgcgtcccctcgctcccaaccccgttcccttgccaggccctgtttgatggattggttgattatatttgcttccattttgttttggtttaattgcctgcaccgatgatatgatagttggttattctgtttgtgtagtactacctccgtcccaaaatgtagctacctagtacgtgatgtcacattacctggtaatacgattcgtagtcctaggtaatgtcacatcccgtactaggtaactatattttgcgacggaggaagtattggattagaacagtggattccaaatgagtacctgtatgctttgttggattttgacaggaaataatttcagaaaagaatttctagaccgaaggtccaaatcaggcagggtttggtaaaaccccccaacttctagaggaggcatgtacttgattacatggaattaagcatgatagattgatagatatattggcgtgtgcttttggttgcaatcgagcgtgttatcgtaatctgttagtgctaattgttgttgattaacaataagatacctgcgcattgctgtggcaaatcttagtactacacaggcacagagcacagatcgagggtacgaacaatatcaagtaatatatgatatttggttgctcatgatccgaggaatggtgatggattcagaatgtaagattgtgtgctattgtagatttattatactatgaagaagaatgctgtagggcgagtactacgtggtttgccatcttctaaaaaaatgtactagtatataattgtattggtgagtgttaatggtaaactgtatgggatgctcaggtggtagttccggtaggaactgttagtctggccgtctgggattgatttcctagtgccatggcaaaatgcgatgcatgacatgttaatgataacaagtactaaaatagtggaaatgatgccatgcataacatgttaatgataataagtaggagtataaaatagtggacatgagcaatctctttgttatggtgggtggtcaaggcgacggcaggggaacgtgtatgctctgggtatgagtatgctagctccggtatttttataatgaactctgatggtaaggcaaatggagactaggccccggtgggtaggctgtggtaggctggatcacaaggaaggttgacacgacggaatggttctggttgcgggcctctcttacgaccggctctgccctatgggtagcagaggaggtatatgtatactgagcgcttgta

SEQ ID NO: 40520 - DNA, 17168 bp, Oryza sativa
tcctgcaccccctgtggttagtgcaactcaactgtatagaattatgtttgtactacagctaaatgtggttagtgcgacacaaccgtataggattatgtttatactacagcttgctgctatagataatgtaggttttcatgttttgtgctttggtagactggtagtcgtatacaatgtgagtctgtttgtggaaatgttgcagcataggcacctatctaacctgttccatagaaaggtatgaatgatgttgtgtgcaaagtgcatatgcatataacagcttcatgatggatggttgaatttaatgtgtttaaccttctgcctattctgttctgtccttagatgttgcatataatcttggtcatggctgatgtcccaatagagtactttctagcttggaatcatgcatgctcacaggtgcacgccacttatatatccatctgatgactgatgagctgcacagctgattgtttagtaagcagcacatgacaatatgacatcagaacctgtcgtctcacaaatctgaagattaatgtttagcttcttgcttctagtgagagattacttggtctgtggccttctgtcaagtgccttgtgcatgtatgcatagtgagatgactgactgatacatctgtgattctgtgtacatgttgatgatggatgtaggctgcgtcgacgctggaaatggacgggctgagtgtactgtgtgcacagaagacggcggacgtcgtcaagaagcgcaccgtggaggaggtcaaggcgctgctcggcatcgccgacgtcggcatgacgccggaggaggagctcaagctccagcacgacaacgatgccatcctctgcctccgttaactacccgatctgccgatcatcatcatcatcatcgctacttttgtcgctgaagcattttgattccatctcgcctactatatatgatgtactttgaggtggtattgggttctctacgtctagatactagatatacagttttagcttgatgcacactggtagtagcaattctgagagaagtttggagtaattctgagagaagttttgccaggtgctcctgtgaacagtactaattgagagaaactattatagtgtatcatattaccatcgaagaacatgagttaattggtcataaaatcattgtgcatttcgaatactagcaaggttatatatgtcttactccatatccattagcaaggttattccgtcccaaaataagtgcagttttgtattggttatgtttaacatttgatagttcatcttattcaaaaaaaattatgattaattttttattgttattagatgataaaacatgaatagtgattatttttttataaattttataaataagacggacggttaaacgttggatacggatattcatggctgcacttattttggaagggtggtagtagtaatcaaggtgataataatgactagtaattcttgtcgagagatactcaattccaatgtcatcacgccgttcgaaaatttaaattctataaaactactcaagtttcttcgtgcaaaattttttacaatgtttatgtgaaatgttattatcacaagacgataatcttgagaataccaaagtatgaagaacaaaaattgaatcggcaaatatccagtactaccattttctcctttatcaaaaattgaatcggcaaatatccagtactaccattttctccccaagatgccgttgggcccacgccctgacaggcaggggatcacgtggcgtagcgggagggtggtgtagggaacccgtcccgtggctgcaggtggggccaggtataatcctgggcccacctgtaagtgagaggagtctgtatcaatataaccttctcgtaccttcacctcttcaacattgcgccaccttttcacccacccacttcacccccttccgctccctctccctcttcctcctcggcgacggcgatggagggcgcggcggcggcggcgggggcgggggcgggggcggggttgcccatggtgaagttgcggggaggcgacggcgtggagttctcggtgcaggcccggcggctggcggagctcgcgccgcgacacgtatgggacctgcccgccatcgagtccggcgacatctacgacaccgtgcagctctaccgcaggaacgccgagcgcttcacgagccgcgccaccggcgggctgcttccccagggggtcctgaacgtgcagaccatcttcgcgcagagagtcaacgacctcgacaccctcggccacctcacaagggtaagcgcccctcgctcctctccctctcctctcctctcctctcctctccggcaatggaggcatcttgcaattattagggatgttttccggactgtgtggtttgcgttgcgattttgtgtgcacttcgtcttcaaccctctcctctctttctcccgttgatcggaaccttccgcggattcagcagccagcgtcgcatccggcgacgggttggggtggtcgggggattggggggtaggaggaggaggggcctatgctgttccccgggcttagagtgatggccggggaggtcgcggcttggcggtggaaggggtcgtcgacggcgacggcgagggaaaccgtgtaggcggcgggctgcgccggtggagacggggaaggcgcagttgcgcagctaatcgatcggcgaggggagggagagagagagagagagagagagagagagagagttcactgttctagaggtagaagatgcacagaacccgttggatcttagaaccaacggcccaaattttggctgagatcttgcgaagaaaacaaacaagtagcagcttaatttgttttgtaagatattagtattatgtaagatatagtgactaaagtacttccacttttgaaactttgtcctagatatgctatagtaggctgcctgatttctctgttcagacagatgtttatgtttctaatctgatttctctgtacaggctgcgattgttctcggcatggaagatctcaaggatgaatgctacaataggatgctgcaagatcatcagatgggaccacagcaagtgaagctgtttttgcagaatgtgctgggacacccgtgaacggttccgcaaatggcatttttcctagttatcattagcagatcatcaccctggtctatacctagctagtgaagtatatactgcctatgtttcaggataggttaagtcttaagtacatacatggctagaactctgttaagccgactgcgtgcctgcgtgcactttatcaggtctagatgtgagagctacttgagttgtttggtgctaaggccgattcgaattgctcttatcaattcagaattcacaagcttaccagctctaccatgctattctgctttacttctgtttggatacatacagctttggttttctgaggtgttggaaatgtctgataataggtgaggccttctataatcatgctatgtcttttgctgctgttgtagaaatatggtgcactgctgcataggaattatgcctgtttgcattgtcatttgccagtgattcaaaaatttgcttttatctcaatacgagaatgtgattgaagccctcttctggtagaggatgatcgtgtggatattttctttcctgttgtaaattggctggttattttgaatattttatttttttgatcgcctggtggatctctgctgcgatgatgtgggcgcgctgataatgaaaagtattaattatgtaacctgggaatcagaatttgtgttgctctttcattttgttgatctgcttgaaatggatgtattcgggattgtatgaacctctggcttttgctcatttcattaatgaaatgggagggctctgcccctctttcccaattttgctggatgaaatggatgtacagaaattatcctgatatcttgattccacatctgtatgtttcaattttgcttctcaaatcactgatgatctctttggtttctggtgatgtacgagacactactattctatggaagcagcagccgactgatggagcaattctggttggctgatcctggcaaagggacagtctcaggggatcaaataaaacctattttatgaaccgtcaaaatatttggctgcagtgagatggttattgaatgaaatggaacaagtctatactatgcttatgctgttgtattctactctgttgctccatgatgtgtattctattctgctgtctgagcaaacatgtcctgaactctcttacaatttttgtgtgcctgaccactgaataagaactgacaatagattgcattgtcacttttggaaccttaaattgaggaagaataataaatggatttttttattcattttgcttaacaaaaccatgagttgtctactatctagtgatgtgcaagtcttgtggaaaatgtgtttgtggcattacagtatgatatgaattgcagaaatcttatcgacaaaaatctcatctgctgatgagataattgagaatggagacacctgtcgatggcttttctgctgacgccaacttgccaagtccacggcgaagtgactgtgaggtggcgctcggtgagtcgtccgatcaacattgtgcgccgtagatttgctactaaccgattagttttattctgtatttccagaagaagctgcagatttttttttcttcctattcggaattggacccagaccgtccgatcactaacgtgcgcaccagattgacaaaaaaaaaaacagagaaaaactctctgtatgaatatccaaccccagcaatatcgaaatttgaaaccgcagagagagagagagaggaggacgaggaggcaccgaggcagcttgctccacacgcctccgccgtgactcgccggagaggaatggaagaggcccgcgcgagagtcgtcgcctccgccgtggcgagaatgaagccaccgcgggcgacggtgacgcatgccactccggccgccgtcctcgcgccgcccgtcggcgacgtcccgcacgccgggtggcgggggctacccgacgacgtcgtcgccagggtgctcgtccacctccccgtcgtcgacctgttccgcctcggctacctcttctccccgcgctggctcgacatctggcgcgccgagccgctgtatctccacgaccgccagttcgtgtctcctcggatcgccgcagccgacgtcgccgacgccatagccaacgttctcgagctccacgtaggcgacggcgtccagttcgtaggcgtataaggagagagcgggagcgacgacgacgacgacgacgatgacgacgacgacgacgacgacgacgatgaagacgacgacgacgacgacgacgacgacgacgacgacgacggagatggaggtggaggcaacgaggtagttggcgcggatggccacgacctgggcgtcgtcgtccacccatggagagaggatgacgacgatgatagcgatgatcatgacgggggccccgacgacgccgaagacgaggcagcagttcaagacgccggagtcgtcgacgattctggacccggggtcgccgtcgaactagaacacgaggcagcagatcaaggcggtggagtccgagtcgtcgacgattctgacggcgaaggcgccgccggccgctgccgcctccgattccctggaggcataggcgccgacgacggcgtcatcagcgacgacgacctctacggccacgacgacatcccagatggtggttacgagatcggccgcgtctacagcttccgagtggagaccacgcggtggcgcgccgaccagctccaccgctggtgcgccgcgctccagcgcggccgtgttcgtgaggtcaccctcaccaacctcaccatggaagggttccccgacctcccccagggcatcctcgattgcggcacaagcctcaagggactccacgtcttcttcttcaccgtggaggccgaccacatcgaccccctcgtcaacctccgcgtcctcggggtgtacggctgcagcggcatgatcacgcgagcactccgccccgaatcggaaatccgggtgctgacgatcgacttcaaccatctgggagacgtcgtcgtccagaccacgcgcctccggtctctgtggatgttcaacaacgtggtgcagggcacggtcatcgtgaacgacgccctccaattccgggacctgcacctgttaccaccgacgaggccatccaggatcttcatcggtgacgcgcccagcctgcgaagcatcggctctctcgatctcttcaacaccgtcttcgtgatcaagggcattgtgattcaggtatgatcaaatcgatcaaatcgaatcgtgtccgtgtgcactgcatctgcatgcaaatcgatcgatcaaattcagacccctgcatgctgctcatccgattaactcaaatccaaatccaaattggctaattaacaattctatactctgatcatgcgcaggctgggatggtgcagcgtcctccaaagatgcgttctgtcaggattctcggcttacgggtgaactacacagatatgggtcacagagtgccccgtgagatagagcagattctgaagtgtttcccatgcttagagaaactggagatcatggtaataaacaaccaatccaaacaatcaatcgtttcattgtcctgaaatttgctgttatttgctctgcatcagtattagactatgtctgaattctgatttctgattgggttgtgcgtgcgtgcctttgctgcagaattactatcaactgtctctgtagttcaatggtaatatataatatgtctgaattctgtttgaattgtgcgtgacttgcagaattatcatgtctgaattctgattgaggtgtgcgtgtgtgcctttgctgcagagagacgatgaggttacaccagaagaagggctcctcaaagctgatggtgaacacatctatcaagggaacaatttcttccgtgaccttggttgtttcagccatcacctgaggtggatatatcttacaactttccgagggggcaagtatgaacttgctctgggcaaagccatcctcgacgaagctcgagccgggacaattttcagaatggtacccccaccaggcagcaataccgacaacatagttaaccagctaaggcgggctatgcaacatttcagaatgaccactccaaatcatgctgtcagagatcgacatgtgtccgttcttctaagtttggatggaacttgaagaaggctactccagggtgttgttctgcgctgttgtactactgtcagagagattttaggctgggctcttttcttcagtttgtctagcttgtcaaatgagcgaattgtgaatgatgctctctttgagtctgcatttgaacaaatccaaatcttgatagcagtaaaagtagatacaatatcttgatgagatgagcatgctgtttgtgctttgcttttaccggaaaatttgatcaacataaaagtgaattatttttcttagatgctaaacaactgtagtctgtagtgtacatgtatatttgttgatcatgatgctagacaaaccggaaaattatttgactgcggctagatttttatacaactaagtgacatgcatatacttgggtgcaattgtacctggtgcaaaaagaacgttctggttctccactgacctgtcaagcttctacatgtgtatggattgggcctaaagttaggctctaaactatacatgtagatttgttgatcatggtgcgtattgatttgttatgcatgtgtcaatgtctgtctatgtcgttcattttctcctactgatgttttttttttaatatgcgagacgcacatttttgtattaagaggaataaatgtatttacagagtgggcctgaaaaataaaaagaatgcgacatggtacaggagaggggaaaagaaaagcataagcctaatctcctaaatgatttggcgacccaagaacaaacgaaggaactgtcatggttggtatggctgatctagccatccgtcagaggtccgcttcccccatcatagccctggctatctccatccaaggtccgctcttctggttgaagacccgattgttcctttccttccagattgtccacgctaccagtgtcgcctcctactgatgtgttgagagtttctgaaatataattacatgtatctatctgaacgaacatgtactgcgggctcttacaatttttgtataggctgtgatggtttaccttaccagaccaccattaatcttacaatttttgtaagattggcctggcacttacataatcatataatgtatgaacttaactgtcagaaatattataccactattaattgttttggagccttgaattgaggaaggaatatttgaacttttttctttttttttttgcttaattaacaatcaacataactactaactagtgttgtttaccgtcttgtgaattgtgatgtggaactgtcaaccgtgtaaagtcttgtggcacttcagtatacgagttgcagagaaatctcatctcccaatgagattgctcatgctgttgagaaactctgcatttcacttttctccagcgttggaggatcatgtcgacggcgagcgccacctcttgcgctgccgctgacggtgttcttcagccaccaagttcacgccgatcgaagcgccggtgttctctctccggtggctaatcttagtccgtccgatcaacattgtgcgccggagatttactaagaagcgatttttctccagaagaatgctttggcttttccgtatatacagaagaagccgcggatccactccaaaactggatacaaaccgtccgatcagtaacgtgcgtactagattgaccagaaaaatctaaagcgcaaactcctctctataaatatccaaccccgcggctacattcctagccgtagccgatagcgagatcaaaatttgaaaccgcggagaggcggcagcttgcgccatacgcctcctcctccgccgcgtggagaggccgtcgccgaccaccagccaagtcgccggagcgagcccggtggccggagaggatggaccacgagagcatcgtcgccagcgacctgtccatctaccctctgccgcccgggacgcgcaccctggccactccgcgcgtcgtcctcgcgccgcctcccgtcaccgtcgtcaaccagccgcacgccgactggcgggggctcccggacgccgccgtctcccgcgtcctcgaccgcctccccgtcgtcgacctgttccgcctcggctacctcttctccccgcgctggctccacatctggcgcgcccggccgctgtatctccacgaccgccagttcaccaccccaccgatccccgccgccaacgtcgccaacgcaatcaccaacgtcctccaccaccacgtcggcgagggcgtccagctcctacccgtacaaggtggcggcggcggagggggaggccaaggtgaaggagcgctcgtgggcggcggcgatgccgatgaggccgtgaccagcgacgacgagatctacgaagacgaaggcatcatccagaacgccggtcacgagatcggccgcgtgtactgcttgcgagtagagaccacgcggtggagcctcgatcacctcgtccgctggtgcgccgagctccagcgcggcggtgctcgtgtgctcatgctcgccaacctcgccataccagagcaccccgaacttcctcaagccatcctcaactgtggcgccagccacctgggactccacgtcttcttcttcaccgtggaagcctaccacatcgcggccctcgtcgagctccgcgccctcgggctgtacggctgcatcgagggccacggcatgatcgaccgagtcctccaccccgaatcaccgattcggaagctggcaatccacggcggcatggggcgaactttcgccgtcgccggcgccacgcgcctccggtctctggtcttgttcgacaaccaggtgggcacggtcgccgtggacggcgccgcccgattccggaatctctacatgagcgatacgaagccatccaggatccgcatcggtgccgcgcccaggttgcgaagaatcctctcccttgacatcttcaacaccgtcttggtgatccaaggcttagcgattcaggtatgataaaatcgatcgatcaacctgcctgctcatttggttgacaccaattctgaatctctgatcgtgcgcgtgcagattgggatgatggagccgcctccacagatccgttctgtcaggcatctctgcttacgggtgaactacacagagatggacgtcaggttgccccgcttgatggagcagatcctgaagagtttcccacgcgtaaaatcactggatatcatggtaatgctaatgaacagccaatcctatccaataaattgttgcataattctgaatttgctgcttattaattgctctgcactgatatgtctgaattctgaattcgctgtcaattcctctgtacaaaagtgtgtgcattttgattttttctgactgagttgtggtctgaattctgaatttgctgctaattagtgatatgcgtggattctgattattctgatcgagttgtggtctgaattctatatttgctgtcaatggctctgcactaatttgtactatgcgttttgattttctgattgagtcgtgttgtgccctattgcagagatgcgatgacgttacacaagcagaagggctcctccagtggaacgatgcacactatgacgggaacaatttcttcgatggccttgagagtttcaactatcacctgaggtggatatatcttgaagatttcagaggaggcaagtgtgaagttgctctgatgaaagccatgctcgacaaagctagtgtcctgagacagttaatgatacaatactcgacaagcagcgtcccccagctcaccctgaatcagctcgacttgtctctccagaatttcaagctgcacactctaaatggtgccatcagaggcaatcttgtgtcctttgttgcagccgatgcttccggaagttgcgtacgactagcagcgcaaggctaggtcaggtgttgttctgtctgtgctctgcttcggggagagagagagagagagagaattttagggtggctcttctcaatttcttcaggtgttgctagtcaaatgatgctataactgatattctgctaagtgagtgaatgatgctctgagcatcaatgcagtgaatgatgatgccctctctcagtctgaacaatatgttagtattgagcaaagtcaaatcttgatagcagtaaaaatgtacagtatcttagcatctctgcaatagggcacaacacaactcaatcagaaaattctaaaattctgattgagttgtggtctgaattctgaatttctgcagtaatgtgtgtggaactctacattctgcttttctgatttgagttgtggtgtgctgcattgcagagagacgatgaggttacagtagcagaagggctcctcaaagcgacggatgaacacatctataaagggaacaatttcttccatggccttagaggtttcagagggggcaagcgtgaacttgctcttatcaaagccatcctcgacgaagctcgagctgggacacggttaaggatggaatactcaacaagaagcaaccccgagctcaccatggatcagctcgatcaacttgtctctccggattttcgagctgctcactccaaatgatgccgtcagaaacgatcgtgtatcctttgttgcagctgataattctggaacttgcgtacgaccagcagcataaggttaggtgttgttctgtgctctgttttgtcgacatcgagagagagagagaattttagggtggttctgtgagcgtcaattttttctgtgagccttaccactgaacatggcctgacacttgcaattttttttgacatatgaactggcagaaatatatcgaaataggctgtgtttagtttaacgccaaaattggaagtttgaataaattggaacgatgtgacataaaagttagaagtttgtgtgtaggtaagttcgatgtgacggaaaagttagaagtttaaagaaaaaagttgaaatctaaatagggccatagacactttttggaacattaaattgaggagaagcaatctgcgcgggcctttgcccccattggaaatggattaggatggatcagctagcaagaactggcaagcagcgccacctcttacacgaaggtaccttcaaatcagacgtccgatcctcttaggccttgtttagatctaaaaaatatttggtcaaaaacattaaatcaaatgtttggacacatgcatggggcattaaatgtggaaaaaaaccaattgcacagtttgcatgtaaattgcaagacgaatcttctgagtctaattacgttatgatttgacaatgtgatgctacagtaaacatttgctaatgacggattaattaggcttaataaattcgtctcgcggtttacaggcggaatctgtaatttattttgttattaatctacgtttaatactttaaatgtgtatccgtataattcaaaaactttacacacaaagaactaaacacacccttaaaaaaatcggtcagacaaatgtttcagttgaccaccagtaaagcattaaattatacatgataaacaaatcaatcattgaaacatttgattttttttgcaacacagtgaagacacacgttgaaacatgttgctatcacatatgaaacattgagtattaacgaactgaaacatacatttttttcatcagaacataaacatgcgatatcatattgtgaagatttagttacaacaaatacaacggtgttattggattgtagattagaaaagtagtttaagataaaaattattttgaaggttgctaaatccacgcatgcatgcatggatagtgatgagagagagagagtagggcaagtagctaaataatttttgtgaaacatagtgaatacatactttaaaacatgtcgttatcacataggaaacattaagttttaactaggggtgggcatgtggtctaaccgaaaaattcggttcggttcctcggtctttcgaaaatctcggtcttccgaatcacaagaccgatcggtcttcaagaaaacttaggaccgagcacttcggtcttcggttagttcggttcggtctcggtcatagaccgaactaaccataacagtggtttaaacagcaaaaaaaaaataatcacaaaaaaaattattccatacaagatcaatgaatcgaagcaactcagatgaagaactacaatatgatgccgctagagcatgattcaggaaaaaaaagaagcaaatcaaagcaaatcgatcttgccatgacttggatcccgtcgatctccacaattccacctaaagctccagatcccgtcgatctcccaccgtcgctttcatccccgaccggcctcctcagccatctaggtctccggtgcagcagggtcaccggagggagcacgatctcttccgccatgacaggtgaaagggcggcgccgaggcggaggcgtcctggccggaggcagcgtcgacgcggtggaggctagaggcggagggcggaggcggggcggtggaggcggaggccaagcggcggtgagcgtgaacgcacgatggatggggaggaatgcggcgctgaggagggagtgaggggcgtgacgcgtgaggtaggcagtgggagatagggtgggattagggtttatgttactgggcttattgggcctcataggtctattaggtcacaattcggttatctcggttaattcggttaaccgagcctaatgaccgaaagacctgaaataaattcggtcttttgatggctgagaccgaactactaaccaaatttctcggtctcggtcttgatcttttcggttcggtttttcggttcggtctaattgtgcccacctctagttttaacggtctgaaacatatatttttattttatcaaaaatataattatgtgatatattattttaaatatttaattgcaacaaattcaatcgtacgattggatcataatcggataagtagtttaggaaaaaaatatttacagtaatgagaaaaaaagaaaaaaaaactagctactacttattttgcatgcatgcaacagtagcaaggagcccatatttttttttcattcagatggggctaccgaacaagatgattttagctcttacactgacgatgaagtaaggcctggtttagttaccccaaaatttttcccaagaacatttcatcgaatctttagacacatgcatacaacattaaatatagattaaaaaactaattgcatagtttgtggggaaatcgcgagacgaatcttttgagcctaattagttcatgattagccataagtgctacaataacccactgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcagacaaaactacgctaggaattacctcacatccgcccatgaccgtgggcacggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattctacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtttttacaaggggacatggtataacaattaacaaaggaaggatcaaatgcaacaaattaggtaggtctgccaatctgccttgcagacgggacaacagattaagtgtgatcctatcaatgcataatatttcgcaagcaatacaattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaaagacctttaagcgtgccactatatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggcccaaggtaaatggagcggctcggccgagcttaacgggccggccggcccaagacggcccaagcgcgcgcgcgcgggagggaggagagagagtccggtggaccgggctcaccacgcgcggtcccgggtgggacccgcttgtcagccgctcggctcaccgtgcggagggagtacgtggctcatgcgcgcgggcggggaaaggacgcggtgcacgcgcgcggtccgtggtggacgcaggtgcggcgggcccacgagcagcctcacggctcgcggtggaacgcgcgcacggggagggactgaccggggtcggctcgatccggtctaggctgagctggcgccgacgtggcgcctacatggcggccacgtgggctggcgggaggtagacgacgacccggccacgaatggacggcgggcggcggcggcgagcggcggagcgaaccacggcgatacgggcaaaagcgtgcacaccgggcggttgcacgtgacaaggggagacgagccaacggctcggattcgccggaggttgctcgacggcggcggcaaccggcggcgggagaagagggaaacggcgacgaggtcacgagaggtcgattcccggcggtaagagcatctatgcggcttcgggaactcgacgctagcgtcggattgggcggaactacgccgagcgaggccggcgacgagcgggtgctacggagctcgagcggcgacggcggcgaacacacggcgagcgacggcaacggtcggggcggcgccggctaactacggggaggctactcaagctactaccgaaagctagggggaggagatggagcgaggaggaagaacggagagagacatcaccgagaagaggaggggtgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgcaacggcggcaagggctgcagga

SEQ ID NO: 40521 - DNA, 4602 bp, Oryza sativa
acactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcagggagctcgcgcgaggggaggggcgctcggcgcgggcgactcccgcgcacgcgcgcgcggcgcgcgggcggggcggaggggggagcggggagagaggcgctcggggcgactctcgcacgcgcgagcagcgtgcgggcggggaagagagagagagagagagagcgggagagcgcccggggggagagggagagatgggccggggaagaggggaagatgggccgagcgagattcggcccatcgacctcgggggaggcaaaatagacttttgaggaggaatttgattgaaaggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacacccacatatgctaatggcggattaattaggctcaaaagattcgtctcgcgatttccagacgagttatgaaattagttttttttatttgtgtccgaaaactcctttcgacatacggtcaaacatccgatgtgacaccaaaaaattttcaattcgcaacctaaacaagcactaactgatctctctctagtgaggggtgcgacgtcggtgaggaagaggacaaagtgcgaagagggttaatcttagttgttcggcaacgggacattgtgtgaaagtttgttttgttttccgtgtgcacgcttcccgaactataaaatgtattttttgaaaacaaattatgtgaaagttactttaaaaaatcatattaatttatttttaaagtttaaaataatttatactcaattaatcatgcgctaatagctactgtgtatcttttcttctcttttcctctcctctcgagctcacctattattggtccattctagaagcaggagcctatctgctccggagttggatccgagccgcccgatcagtaacgtgcgcagcagattgaccagaaaactagaagaaaaactctataaatatccaaggcccggtactttcctagccagctggcagcctccaacccgaaagcgatatcaaaatttgaaaccgcgcagaggcggcagcttgctccacacgcctccgccgtgtcgagatttccgactcgccggagaggaacaatggaagaggaccgccggagaagcgccgccttcgtcatgtccggcttcaagtcctcgccgacggaggccaccgagtccaccccgcgcgccttgctcgcgcctccctccaccaaccggcacgccgactggcggcggctcccggacgccgccgtcgcccgcgtcctcgaccgcctcaccgtcctcgacctcttccgcctcggctacctcttctccccgcgctggctccacatctggcgcctcctcccgctgtatctccacgaccgccagttcaccactcccccgatccccgccggcaacgtcgcccaagcaatcaccaacgtcctcgagctccacgttggcaacggcgtccaattcgtacccaaacaaagcggcggcggcggcggcggacatggaggcaacgaggtagctgcccctgatggtggaggcggcggtggcggacatggaggcgccgacgacagcagcagcgacgaggagagcggcctctgcgacgacgtcatcgcccacgacgccgccatgctaaacggcggcttcgagatcggccgcgtgttctgcttccgggtagagaccacgcggtggagcctcgagcagctcaaccgctggtgcgccgccctccatcgcggccgtgctcgtgtcatcgtcgtcgccaacctccacctaccagggtaccccagatttcctcaagccctcctcgactgcaccagcctcctggagctccacctcttcttcttcaccgtggaagcctaccgcatcgacaggctcctcgtcctcgggctgtacagctgcgcctggggcctcggcatgatcgaccgagcaatccaccgcgaatcggagattcgggagctggcaatcgacggcgtcgaggggtcaaccttccgcctcgccgacacgcgcctccagactctgcgcatgtacgaaaaccaggtgggcacggtcgccgtcgacaacgccacccgattacggaagctgcacatgcaccatacgtggccatccaggatcagcatcaatggcgcgcccaggttgcgaaagatcgtctctcttgacctcttcaccaccgtcttggagatccaaggcatagtgattaaggtatatttgcaaatcgatcgatcaacctgcccgcttgcccaaccaatttgattaacaccaattctgaatctctgatcatgcgtgcgcaggctgggatggtggagcagcctccagagatccgttctgtcaggtatctcggcttacgggtgaactacacaacgatggtcgacatgttgccccgccagatagagcagatcctgaggagtttcccacgcgtaaaatcactgaaaatcctggtaatgccaatgaacggccaatcttatccaatcaattgttgcataattctgaatttgctgcttattaattgctctgcactgatatgtctgaattctgatttttcttgctgagtcgtggtctgaattctgaattcgctatcaattcctctgcacaaaagtgtgtgcattttggttttctgcctgagttgtggtctgcattcttaatttgctgctaattagtgatatgtcttgattctgattaaatttgctgtcaattgctctgcactaacttgtactatgcgttttgattttctgatttgagttgtgttgtgctctattgcagagatgcgatgacgttacacaagcagaagggctcctccagtggaacgatgcacactatgacgggaacaatttcttcgatggccttgagtgtttcaactatcacctgaggtggatatatcttacaggtttcagagggggcaagtgtgaagttgctctgatgaaagccatgctcgacaaagctagtgtcctgacacagttaaggatggaatactcgacaggaagcctcccccagctcaccctgaatcagctcaacttgtctctccggaatttcaagctgcacactccaaatggtgccgtcagaggcgatcttgtgtcctttgttgcagctgatgcttccggaagttgcgtacgactagcagtgtaaggctaggtcaggtgttgttctgtctgtgctctacttcgagagagatttaggctggagatggattctaatagctcgagtggatgtccacccgtttattgcatgtcaattagatgattacgaaaaatttttaaaaaaattaacaagatagatcaatatgtaatatatcactccacaaacatgtaagttcaaattcaacttctacaaattataacaaaaaataacaaatttaattgtaaatatacatatagtaatttaagttttgattgttatttttgttacaacttgtagaagttgaattttaacttgcatatttatggattgatatattacatgttgatctatcttgttcatattttttcaatttttttcataaccatttagatgacatgcaataaacgggtggacgtccactcgagctgttaaaacagttttccatttaggctagcacttcaatatcttcagtttgtctagctgtcaaatgatgctaactgctgttctgctaagtgagtgaataaagggtagtggtggtttttaagaacttttatcatttcgcacagtgttattatttgaactagaataaggggaagtgatgattttgaagaactgatatcatttcgcacagcattactatttgaattagaacatatgttttcatatagagggtagttgttggttggaacaatttatgagtgctttaatatatactccatagttcacgatatttacgaaatgtgtcagctgggaatatggtactgacaattggggaatcatgtagccttcattccccaaatagtttattagaatggtctgtctacctcttgcatatttccatacatgctgttgcatattttgtcaggtcacaagatagcaccatacccatctttacttaatcctaaagaattactcatttttgtgaattctcttggtttgcatgttgaagtgtacacaaatgagataagcatcatgcactttctttgtggacaaagaagtggaaattctttgcttgaaattattattgatgctcactgcctacatatgagaagcttcattagagtgcctacaaatgcagtatatatgtgcagtcgcaacaattttgtgtgttaagtcagcctaccaccaattctgaagacaccacttatcatgcttaaactctgactcaactgggcatgatcatcttccatataggttagatatctgaatcttgatcagatctgtgttaacaatgctatgagcatcaatgatgcattgatgctaagtgaatgatgatgccctctctgagtctgaacaatatgct

SEQ ID NO: 40522 - DNA, 6611 bp, Oryza sativa
cagtatcttcttcctgagctccggtcatcgccacggcgtcatctcacctcctcgccgatcagtcagtcaccctccggccgacggacaccggccggcgatgtcgaagaagagatagatcaatggagaattggaaatgagaaaacacacactggcaaatggatggcttcttcgttgtcccggccgcatatcctttcctatggctttctttagttagtgtgccaaaaattttattaaatatacggacacacatttcaagtattaaacatagactaataataaaataaattctagattccgcctgtaaattgcaagacgaatttattaagcctaattaattcgtcattagcaaatgtttactatagcattacattgtcaaatcattgcgtaattaggctcaaaagatttgtctcgcaatttacagtcggattgtgcaattattttttttcgtacacatttgatgcttcatatatgtatccaaacatttgatgtgacggaaaagttataagttagaagaaaaaagttggaatctaaacacggcctacgtaggcccaacagaaaattgaatctcgtatatctggttcttgggcctatattatccatcagtccatcacagttgttgaatcattcttgggctgttaggctaattgcctagtagaaataaaacattaatacctttctcaatgactcgatcacagtaaatcctaggcgaaatttggtatggtccactcttctaaaagatgtcttttcgagatatgttacctgctacctctgtcacaaaatatagctacatttttactacactcttatttggaccaaacacaatcattcaattttgtttcatcttacttctgtgcttgtattttagaacggagaaaataccttattaaacttaaatactactagacccaaatcctcgttacttttagatttttttaaaaaaagtttcctttttattagcattatccttttcatttaatttttcctcgcttcctgttctctctgcccattggaaatggatcaaactggtttatatcaattcgatcagctaagcgagaactggcgaaacaggtggactgaatgacatgcgggcccatcagttcttttatttgactgggatgccacgtaagtaacaggtggataggatgcaaattgaacagtttataaagttgacgagtaaatggtgttcaataaatcaataatataaaaaaataacactttctccccatataaattccatctagcgtaaggaggagatagggaataatcaaatcagcacggaacgtgcaggcataacttcaacttaaaagtcaaattatatgcatggatattcaattcagtccataatgtgattaatcaaataattcaatgtgtgtagtacattgactatgcgttggacgcttaaattcattgcaactaatccaatgtttatagaaaatcaatacctaatataacccatttttgttgatttattttcaaaaatataatttcaattattcttcttctttcttttttccattagcattccaacttttcgaaaaccttcatgatattttgaaagtagaggtcatagcaacttttttacgagtcgggcacacacgcgcacacacattcacgtggttaggaactaatactccaatatggagtatctctaaagatacccctaatctgtgttcttctctcaacttttccaaacctctcgtctctcaactttttcaaacctatcatctcttattttccatacgtatgtttcccaaactactaaactgcgtgtttttttaaaaaatttctatagtaaaattgcttttaaaaaaatattaattcattttaaaagttttttttaactaacgcttaattagttatgctctaattctttgcttagttttctgtgtcaagaggcctcaaaactcagctctaaagtctaatattttttagttgatcctttttttaacaaaaaagaaattaaaaatgcattttgagtttcctcccccttttaatttgcatttgcatatttttttctaaaaattaatttatgcctcccacatatttggactagtggcgagtagacaaaccattttgctgtttgtttacacgtcaaactcgtcgtcggcctccccctcaccaccttccgattcccctttctcccattcgcacggcttcttcgtcttcttctcttccctcctctcgcccaccccccctcgcagatctcgccgcgctctcctcctcctcctcctcctcctcctccgccgccgtctccgcgaagtcgttcccgccgccgccgccgcgggcaccgcccacgcgctccgttccggcaggcggcgcgcgctcgctcgctcgctcttggtgtctctggagaagaagcggagagagagagagagagagaggtggagaggagggagggggtttgctggggtagtctctagaggctccccctgctgccgccatcgccgtcgacggctcctcctcccctcccccggtggagatccggggtggtgttcctcggtaagcgggattggttttggttccggattcgcctcgcggtgggggctatccgtttggtggggcgcggcgggatggatcccgtcgtaatccgctcgcgagggtagagctgttcgtcgtcgctaatgcggggggtttcgcgttgtttgcagggttcacgcataggaggtggcggctgcgcgcgcagaggctcgggggcgagggcggcggcgcgggcgagatgaaggggtcggccatcccggcggtcgcgatcatgccctcgccgctcttcctctggcggttcaaggtatcgtggccttcttcagctcaactcatggtacactgatacggcgaggcgatggatttagcgccgatttggttgcaagtgccagttgtctcctttgcttaattttacctgcttggggttatcgcagcgcgacattgctatgtagttgtaaaataatcaatcatgttatgtgtttgtcctggagtatagtttggtcaataccttgcaactgcggtaaagggtatcacaggaatcacggaggaattacttacctttgctcaaagctaatcgcagagatgactactactcatagttgggaaacattattggattgaggagaagtgatcttacttcatagggtctagtcttttccagatatttgtcctacacattaatatttccctccttcctgctactgatgcataaaccccattttatctgtaccattaattgtaataaaaggaaatcgagaatcatgatttatccttttcttctaaatgaaaactgaagaagagtaaaactcatctcatgtcttattcttggcttcactgggatgtgcttttatccttgacggaccaagataatagtgttgacttcccttgaaatatatggcaggaaatagcattaatcttggcatgcataatgaaatggtctttcaggaatgccaattttcacttatgttttcttctacagcttaactttgaactgcatctgagaggcatgatagaaactacacattagtgcagtgtacaattctttactcccgtgttattatgtaactgaatataaggagtatttagtacaaaagttatcctaagctcttgattctgcatttacgtgcatcaattttacttctctaatcactgataaacccatccatttttcaggttgtattgtttctcctatggggtttatgctgttgcaaggtattctcgctttgatctaaccatatcttttttcttgatatgatctgaatctcttgttgtagttctaattcacatattattttggtgttacagataggttgggactctgttatgagaatgagtgctgatctgcgagacttatttctttacgaagctttcttatactacaatccgcttcttcttgtggtaagtttcttttgtgaagtatgtatgacaatctcaagggccattactgtagaaaagacagcaaatgaaggcacttcctgatcgttttgtacttgtggttcatgtttttgttgtaggctctgatgatttggttatggggagtaaacctgtgggtctttgcacaatcatcagtgaattacgcaagggtgtttgatcttgcacaaacacatttatcgcatcgagaaatatggagggtatgcttatctgattctcctggttgcactttctgtttatgagcttaacttgatttggattttcataagttttctccctttcaaaatgcatctgctctgacatagtttgctatgtacaaatttgtatgtctggcatacagttgctgtcatgacaatgaaagggttcaaagtttgtctatgccatgcccatgtttgggaaaagtttgcaatattttatttaattgtcaacccatcaggatttattgtgctagatgcattttacatttgctgcttcatattcatatgtgcacttttctctggtgttgtgttattacttgattttgtcatatttttggctaatgcaatcttcatctttttatttcattaacagtgtgctacttggcttactttgattgttcccacgagtatgacagcttacctatatttgtactcacatggagaagtgtcccttgctgcatctcaaccagtgtaatatctaacccattaattagttcatttcatgccttgttcctcttgtgtgcttgagctcatgattttttttttgtgtacttaatgtttggttatattgttggtagtgcttaccaatagtcaatttgtgtgtaagagtatcgcgttcccaaagctctcaaaaggaacactgcacctttctttagcatcaactgttactgtacttgtgctttgattttccttagtcaaataagtggaaagtctcatctagtacaataagactttttatgcaagacaaacaaattttatgagtgatggatggtttaattattagaatgaacctaaaggtttgtacgcactgtttcttttttacttgtcatttacgtcatcggcatggtcactaatacacgtatttaaccattcttttactaaccatatgtactgatgagtgatgacattctcagtgacaagtcctagtacttctgtatgtacttgaagttttttttttaccctgtatatacttgaagtttgtctgcatatgttttaaaacaaaaccaatttaagaacactaggtgtagggtatattgccttcttgtttgttcaccatgttgaagatgaaactatcatgcagtgttgtcatgtattgtatcatgccgtgccaattccagggtggtggaactaacatatctttctgcctattttcaggttcttttatatgctatccttcttatagtcctcttatctccttttgatatgttttacctgtcgtcacgcttttactttctgaggacagtgtggcgtataatgcttccattgcaagtaagttgtacaatttgttagtaaggggtgtggtagtttttgtttttagctgtgcaacatgcactatgctactgcctgttgtgactaagcatatgccttttatgtccttgctgtggagccagcaattagatcagactaacttttttgatggtttccttcccccctgttctgcaggcaattacattccccgacttctttttggctgatatttttacatccatgtcaaaggtatggagcaatttatttaaaattgttggttgtggattgttttgtgtacattatttctgtatagagaatatagggaaagacttactgtctaatactatatgattctctgtttggcctctaggatttaatgtgtacaatgttctctacaaattaaaaaagcactacatgacatgctatattttagtttgtagagaactgtttcttgcttgtatttggcctgagttagcattcagatacttggtattttaccattttgcctaattgttgcatttcttcacaggtcttctcagacttggaacgttcagtttgtcgcatggtcaatcggcaggttaatttcttatacttactttttttgtggggaatttcttatacttgctgttgtgctatgtgcattatgtcctcaatggtctctaagtgactgtcaaacgacatgccattggcttatattgacagttgtaaattattggtataactcatctcgttcctgtataatgtgttcattattatgatattctacaggttgcaacgaccgcttggcttgaagcagattcaatttgtggcagccattctgtagctattcctctagttcttgtgttcccttatttgtgtcgactcttccaatgccttcgacaatacaaagatacaaaggagaagacttgtcttcttaatggtatttactgattgttacttgttgcaattatggcttgctttaaaaaaatgatctagaacgcattcgtcccatgtttgctaccagttcctctaaccaacaaacatttgtctcaaatccagcactcaagtactcgacagcggttccggtgattttcctttcagctctcaagtatcatgtattccctgacaagtgggttagcttttatcgacccctctggcttatgtccagtgttataaattcgctgtattccttttactgggatataaagcgagattgggatttgaggtgtgctatcttcacatgatctttgttttagagcttcagcatgtgttttcacatct

SEQ ID NO: 40523 - DNA, 10719 bp, Oryza sativa
  unsure (1)..(10719): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaaaactgaaatggctatgggaagcaagcacggtcgtactttcctaatcactggtttccatgcctatccaatgatcaaggactggataaggatgactcgaaagaaaacaaaattagggattctggccctatttatatttcaattttttttcttcaaactttcaacttttccatcacatcgaactttcctacacacacaaactttcaatttttccatcacatcgtttcaatttcttcaaacttttaattttggtgtagaactaaacacagcctctgtttgaagtatacaaagcattttgaatttcaggcattaagcactaacatcagttgcacaagcccaaagccccaaaaccatcatcgaagtttcacacaaattgtactgctcacaggccccatggttttcaactaaactgcgactgaaaattgcgagttattcactcgaaacaagccgcgcctcagtaatcactaaaactgaaactgataaaccacatggcacatgaaagcactagcttcaatgggcaaatgctcctgcaatttccactaaactactaatgaacagaaccctgtatcatcgatgtgagtgatggatggactcgagcagttttcattgaccgagaagcacttcttccttctgaatattcctcaccaagaggccaccttggacgcaggtcatactgtgttaagacaattatcaggcatgataatagccagtcagtcttataaaacatagaacttacactgtattaacgtcaggagtagagtaaaattaccaagtacaagattccttccataacataaatacacaacaggtcgatctgaagtgtgttctattttaatgtaagaaaattagacggcctgattctgagttctgacaatgtgcgaattccatcttccatgatattaattataggaaaacatttggataaaaaataactcataaactgatcttcgtggtggatctgccaccatcacatggctactgatatcataaatattgactagctttgctcacaggccaagcttatttgatcaatccccccagagtgtcaaactgaaggagacatgaggaatataaaggcagctataggaatggggaagatggtgaaaatgtggattgtttgactggcttggatgcaattttgacataacacaagctcacctgttcgatgaccatatggctctaagcttataatatggtaggccgcaagatgaaaataccaccaaaaccaaatttggcaggtaatttgctagttttgagatttgagtattgaggtttgggagtcgtgggtgaaaaaaaagactctggatgacttgatgtaaacgaaattatcgaacttcaactatagtgccaaatgcagttacttgggattaaaaggacatatatgccaaatttacccaaattaaggtcaagaacacgatataatctatccaagtctcacatttcaatgttcgttgaaatgccatcggtttagctttacactcttcctccttatcagtagcaacaccaactgccttttaacaagacctttttttattgtagcagcaaagagttgatcatgtatcaatgcatttttaaactaccaagttataagaagcaaaaaaagctttctgtgcttgatggtgcactttgttttgttcaactcatcaactgagcatattaatttgtcatgttacctgcatatcatcaggctcatcaacagcaggaggatcatcaaatctgcctgcaatgaaatgctcaataccagtccaagcaatcatgacacctgcaaaagaagatgccagaattatgtgcaaactgcttaagaataactaagggaattaggaggaatctgtaccctgtatggaagaaacagtcaaaaataagttctcaacaagtcaaaaggacagaaaataaacagtataacaacaacatagaaccaagacacaaaaataaataaataatgtagagtctagattgagataaaaaatgaagatatgaaatgagtggcatgaaaaatggcattaaatcataaatacttctgttaataatatgattgaatattactgatttactattcaattgatcatgcaaataaactttttaccattgtcagtgcaaagctttgggggagggcatacgagctgtaggccattcttctcagcgatctgattcaaatgagttctgacatactggtttgatgcaacacctcctgaaacaacctttaataactgagtcaataacacactggatgaactaatgtaaaaatgtaaatattctaaaatgaatcaacatcaagatatctgaattacaaagtatttaatagaaggctccatcttcaatgcccattcaactgctcgctggcatctttcttccaaatgtaaaacagcaactcgctgcagaggtcaacatcagaaaactaccaaaatcttcatgaataatgaaaatacattgcctatgatgtaaaaacctgaaaagaggcagcaatgttcgcccttatttgtctgtcatcttttgtcgcggatgaaataggaatatcatctgttgatctaccatagcacaaaaacaacagaagagttacgagaccaaatgtcactaccgatgagactgccatgtctgtttcatgtaataattaaaaatgttccttcgccaataaagaaacagaaacattctataccttttctaacaaccagttttctagcaacttgcaacctcttgctatttgttaaacattatcgttcccactttgtcgttcttgttatttgatctagcgcatttcaagcacaggttattgtatatacgctatagcataatgcctgggtgggtgttctttaattaataaaaagaacaacgaccttgcatggttgcaatagtttcatgttaatttcctagtgcttgacataaaaaaaatttcagtaaaattaaaaaacaagtattgtagattattgagagttaaagtcaagtctctgcttgttaatctagaatattatagtcaaggagagcaaacagcatgccaaaatacactatttatttgacacaccagcaggcatattaatcttacaatgaagacaatggcacaaggactaaaacagccatacatgtttctggattcaatagccaatcgaacttgagtcttcagaccagcataagagaaattgcaatctttgtgttgtcgcattggaacctggaagttcacaaaaagagaaggcaagcaaacatcatgttgacctaacagtcatgataggtggataacacaacatatctacccagtggatgcaaaatatctacgtcggcaaacttacactaaacttaacagcatttggatcaccttctagggcaagctgttcaagagcaggaccgccacctttccgcatatcaagacctaaccatctcgctgacttgtcataagcctcaccaattgcatcatctattgtagttcccagttgaacatattgaccaagtccatgagcaagaacaagaagattgtgtcctcctgaacatattaactggttaggtagctgcccgaacgtcataaaagaaaattcaccaaacacgtaatgtttcaacataagtatatctgttgtattagcacatactccctctgtcccaaaaagaatcaaaatctagggtttgcgatggaatcgatttactgcgagtggccttgtggttggtttgcaccggacccagtcgagttaaaataagttcgaccaagggcaaacttgtctttaatgagtatttctctctccaattcctccaaaaataataaaataagaccgcgagtgtccaacagctaattacaagttttttatggtgcccgatagaatattcgtgttcttgcggtgtctaccagctaattgcacgttttttggatgccctgtagcaaatttttctgttatgtttgggtattactccctccatcccaaaatataaaaagttttaaggttggacatggttattaagaaagtaggtagaagtgaatgttgaagggttgtgattggatgagtagtggaggtaggtgagaaaagtgaatggcggagggttgtgattggttgggaagagaatgttggtggagaagttgttatattttgggacaaattctgagggctaaaagttgttatattttgggagttaggacggagggagtatttgttatcccattttctatttgattgagcttattccatactcgcatattgtatcaatgattgcaatgggccatcataagattgattttgcattctgaaaggaggaaataaatgaaataaaagtagtttttcaaaactggatataataaagtatcgagatgtagcaaatggagttgcctgccaactagcactgcttaaaaatgtttatttccctatattgtagtttgactatagagacataaattaaccatgaagattgttcattacacacctcgtatatttgtacatagaacataaaaaactacatagtccttcgaaaagaagggtatggtggtggagcttgtgaatatctactccacctcctttatgttataggttttatgaatttcccctagtagttcttcaatatcatatgaaagttattctacatattgttatcttattatttggccttctaaaatacaaatttaacatggaagggtccaagattcacatgtacatgtacacaagctaatgttacaattataactgtgtgaacatgcgaagggtgcctttatgaagaaaatcacattcatttatttcacaatactagggaatgtatgattagtgtttatccatataaagcacgggtgtttagatagtacttccaaactgtggcagggacggaacaaataccccatcaggtcaaaagctgactgactaggtgtaaggacaagcctaatagggttcaatcctagactaggcactgttgtccatcaattttatgagtacagctacgtctagtggtaaagcgaatggtcatgcttagcggactttgggcaactccataattttgaagcgtgtagaggacatgcacacaatcatggggtcaattgcttgacatttgaagtttttatgtattttagtgaaaatattagcaaaattagcactacatttcaaaagaactgcacaacatggtggcactacttccaaaaccatgtgattgatgatgtattcaaactggaaatataaataaatttatgcaagttccaatggaatctatgttatacattcaaagtctaccaaacatcaaatatttttcaaaagagccttattgttactgtagagatgtaactcaacaaaaaattgatagtgccacagaatatagggataaagtcataaaacactttgattagtatatacctgaaattaggagggccaaaaatgggaaatcaagatccttgttcactaacctgacatcaatagaactacattaatacaaatgcatcgattatagcaataacaataggttaggtggctatgatagcatttttaggattatataattactttaagtataggcatgattacaatagtcttagggcttagggtcttagcatttctggtaaaaaaagctcttctgtaataataatttaaatttcataccttgcatttcatcacaatacattcattttgcaaaacatgtagcactgaaaaataatttatagttgcaaatttgttcctgctcaaatatcgttatgtggtttttacatagcaagatgttggtcaaatgttcggaagtaataccagtagaaaaagaaatcattcacttttcggttcaaaaattgctaatttaccaacctaatggacattacaaatatacaatagaaaaaaagtggaagtgcaaaagtacataacagaaaccagtcgtgctctagaactaaatccacaaaaataaagagaaaaacataaaatcccttacaaatggacagtaaaaaaatcatcgtttcagctaaaaaaatctactattgcttggcagtgaactgataaaggaacttatgtttcatcagttgagaatgtcatcttcataactcagaaataaaaaccaaggttggatacctggaaactaatgcatgtgcctccatatgatgaactccaacaataggcaggcgaaatgatttcgctatttttcgagctttgtgaacaccaactgcaatttatatggttcattaaatagccttcaaagaaatgtaagagagactcagcgaggttaaaaagtaaaatcaataaagttcactctgactgtgtaaatagtagtatatgcaatgtatcatttcaacaatcgattactttacaggttgacattgcgagtgactgcacaagataaagaactactaacaagtaacaccatctaaagggcaaacaagttaatgatgagaaatgccctgcatctaaaatactcagcgaactaatagtgagaacacagggtttggggtggggagaatgattgaaagatgcaaacaagattctgtaacaaactgaaaattcagaactatgccagcatataagatataataacagtaaataccagctaatcctattgatcaggagtaaacatacaaaagctgatacctctgaggcataaactaagtcctggtcctacggtgacagccactgctgaaagatcattttctgacacatttgcatcatcaagtgctttctgaacaacctgcaaggaaaatacaaaatctataacataaatgtcaaaaacagcaagattgaacagaaactctgaaactgaaagccaaacctgatcaatcgcaagagaatgagcttcctcggccatcttcggagcgacgcctccccacctcacgagtaaatcttccttccaaatgttgtaagcacaaaacaatacaatcagcagcgcacagagcatagcatgaccaataatacagaaacaaagtgtaagtgggctgaacagggaagcagggggcatagtatagtatctcacttgggaagataccacctggcttaggatctcgccatcgcctctaacctgcaaccaaccaaccaacaaaaacaacaaagagccaggcactaagcacaaacaaatcctacacaccgactccaccactgctacaagcggtctgaaataggggagtgagccgcgcgtaccacggcggcggcggtgtcgtcgcagctggtctcgatgccgagcatgaggaggtctgcggcggcggcggcggagggcattgtggcgagggagcggaaggtaggagaggaccgtagcggaggggagggggcgggggcgaggaggagtcggaggaggggagcgggaaggggtgaggggaacggtggggctcgccggaagaggagggcggcggcggcgcgggaggccggcggcgataaggtggggagaagagtggccgccattccactctagctcgggttacactggggtctctcaacaaacaccgatctttttgcatccgacgcacatgtgtgcctcctttttccaaaagtctaaagaaaaaaaattactgacgaaaatgcatgatggcatttggttgtattattactatagtagggtacacaaattctttgtgatgttaagctcataataaaagtataaaagtgcatactcctttgtcctttaaagggttaattggatccataccattgcaaatttatctattcagaaaaataacactacaatttgtctatttgtagccttgccactgaaatttcacaaaattagaaccgtgtcactaccgtcacgttttccatctattctcttcattttccgtttcttccttccttccttcctgtcttccaatttgtgcggtgcggcagcgacactggttcgtagggggtaggggtgaaaacggtacggaaacggacggaaaccatctttatcgttttcgttttcatattttttttcggaatcggaaaccccggatacgaaaacggaatcgaatattatcgaaaccgaaaacggagcgaaaacgaaccggcgcgaatacggtaacgaaaatttatcggaataaaaaacctctcaaactgataaatccaattgaataaattatctatgtttaaaagagtaatgttgttgataaatcccaatgtaggacaaaaaaatattcttatgtaattttagatttgcataacaaatattttttaaaaaattaacagccaaacattcactatttagtgcttaaaaaaagaatccagagtatttcagtcacgaaatttctactaattccaagaaaatttccagaaattccgagaaaattttcggaaagtttccgaccgatttcgagttccgacggaaactgcccttatcatttccgattccgttcccaagaaaatatttccgaattcgtttccgtttccgaaaaattccgaccgacagattccgttttcgaaaataggtctggaatccggaaagatttcgtaccgttttcaggcctagtagggggcgatggggtgcacggcgtccaaggtggagtagtgtcacgcccagaaatttagcccaaatttcgagactattttgtgtattaaatccctgtctaggaccagccagggtacacaaaacgacaagtaatatacagttccaaacgtaaataaagcgtaaaatacttacaaaagaggcacctagtcctcacaccgaaacagaacgacagcagcggaaaaaggcgatcctagcggagcttcagctccactccacaggcaaaactcaactggggtctgagcattggtcctctaactccatcttcagctcagaagcactacacttctaaaaagggggaataatagcaagactgagtacaaccaccgtactcagcaagccacaccaacgatgcagatgtgcaaggggatacaaggatggtttgtggctatttgcataaagacggttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgttaccgtgcgccgacatgtcaccacgacataccgaaaagaggccgtgacaggacccttcgcataaccccctctaaccaagcacaccacatctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccacgaagcatggccagatgtctcgagcacgcagctcactctgatactaaaaaggtctaatactgtaattatcccatcaactgagctagtggtaattaagcatagctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaatgcgatcttccgaaacgacgggaactacacgctggcacgcaaaacgaggaaaaactctaataaagaccaagaaaacagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaaggaaaaggctgtgctgacgtcagcaaaggagatgggcggcgccggcaagcgggccccaccggtcagcggcacaagggcgccggtccaccgtggaccgggaccaccgaggcggtccaccaccggtccacgggaaccgacggtccggatcggcccaagccgatcgggcggccaggggcggcgcggctggggcacagcacggcacaaagccggctggccaaacgacggcgcgcggcggcgcggccacccgcggcgacggccggcgacagctcccgcgggcgaaagcggcgcacgcgcgagcagcggcgcggcgcggcaagggggaggcggcaaccggctgcccggcaccaccggcaa

SEQ ID NO: 40524 - DNA, 7911 bp, Oryza sativa
gctacggaggtggaaagggtaaatggatcggtggccaagcttgcccgggctgcggcaaagctgacggtggcggcggagcagtgcggcggcgaccctagcgacgggaaacggcggccggagttcgccggagtgtggcggcgcgcgggagcggcgtggggagctcgagagagcgcgcgggagggggcaatgagttgggggaaacggatgaggggaggtcggggtgcatttttataggccccggagggggagatcgtggccgtggcgggcggcaacggccggcggatggagcttcgacgacgtgggcgagtggggctcgaacggcgccgattttttggggggggaaatgggggagaaagtggaggaaggggaggacgtggggtggaccacgtctgcacgcgcgcgggagcgtggaggcgcgcggaggaagcagcgtcgtggggtggctcaggcggccatggcggcagttggagctggaggaaagggatgacaggtggggtccacgggtcccacctgtcggagagagagggagggagaggccggctggggaggcagaacggacttgagggagagagagagccgagcgggccgagggaggaggccggcccgagagggagagaaagggggcgcgcgggtcgcaggagagaaaggagggattgggccgaaaggggcccaaagagaggaaggaggattttatttgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttccagaaaatgtattattaattgatttttattcccgaacgaaaatcggggcgttacaagtaggaggacatggtgtggtggtgcgaggagcggcggtgacacatgaaggacacggtggcgtcgcggtagcagctcgcctcggcccacgccgactaactccgtgtcccaccacactgcgccagtgctcctcaccacaaccacctagcctcctctgttttcctcgctcccgtcaccgacgccgctgctctccaagcaccacccggcgctgccgccgccaccgccccatagtcacaatagcagcagcagcagcagcctcgtcacatagcggtgagggctccccgcggcgggccgtgttgcctcaaggtgcctcacatcctgtccgactccagcattgctcgcccaacacggttgtcgttccggaagctagtggtctagacaccgtcggcagcggcatcgtggaactgggagaaaaggggaaataagaaggaagaagaaaatgacaagtggggttagggcatttttgacttttcacgctatttatctctcatattcacctgaaaattaataatttaatgggcgtaatgtctactagcaaataaccacgtttagatagtgtttttccccaaaagtgaattcgtgcggtgtccgactggtaaaatcacaaagtcttgatgtcctgtagcaaagtttgcctaatttttatgtttttagtttcatcatgagaaatactttcataacatatataatctacacgttgttaaactatacgaacttttatatcgatgattaaagataaaaatgttttaacttataataaaactaaaatgacaattaatttaaaactgagggagtaaaggtagaagtagctcggacgtccttgtcgagcccaacgtaccccaatagtaaccggacaacggcgctgtgcgtccgtgagggttgattggccacgagccaaggacggaacggaacggaatggaagaaatatgttccctttgcttgaacccaaagtgtcacagcgctatacaattcatcccatccgtacacattttgctgccctgccacacgtgtgcgtcgtaggattacgtacttgtaccaccaaaaagttggttggccagaagaaaaaatttttgcacatgaatcctctcaaaagaatacaaatatattaatggccgatcgatggcccggcgtccttggtagtcgtcgaatacgcgatgaaattttggtattattgtaggtgttactaataagacacatttcctctatgatgcaggcctggtttagtttccaaatttttttctcaaaaacatcacatcaaatacttggacacatgaatagagcattaaatataaattaaaaaactaattgcacagttaagggggaaatcgcgagacgaatcttttgagcctaattagtccatgattagccataagtgctacagtaacccatatgtgctaatgattgattaattaggctcaaaagattcatcctgcggtttccaggcgagttatgaaattagttttttcattcgtgtccgaaaaacccttcagacatccggtcaaacatccaatgtgatagccaaaaaatttcttttcgcgaactaaacaggcccataatatgatttgtctggtctctaaaatgtttttaaaatgtcactaaatataagactaagtacaatagcaaactataagctagctataaatatatgtggaggggataaaacaaagagagaagagaaatgaactatggatcttagcacgttatgtgtataagaggtgggactagttattaatgatgtaacatatatttataagtaactactgtaaaaatagattattagattactataaatgatttgacttttgaaaaaaaagtagttgattataatattaaacttgctctatagctctgtagttagtgggactgtttctaaaatagaaatggttgaccgggggacaagcgctactgatgtagtgatgtgcccctgacttatagggaattgttaatgatctcaagtcttaaaacctctatctcctctatttacagcctcatcgctaggcttagtgagaaataaaaaaaaaagcatacttgtaaacgataatttatgaataaaacttttatatacgtgttcttatgatttaaaagtaaatgatttaaaagtaaatgatagaaaataaactacgatgaaaattctcaaaatcaactctaaatttaaggtaaaaaatttaaattttggctgataaggataaatataaatgaaaaaaaagacgttaaatatgtgttagatattgtgcttgtgaatgtgtaagtgtagtgtgtgtatactgtatagatggtgcatgtaccaatggatcatccacgtaatcgaaagaaatggcttcatggatcttataaactggagtacatagcaggagagaggatagcacggatcaactatgcttgtgttgatgtcgccatatgaacttccagatcaaaccaccatgcatgctggtttaaatagttgaaacttgtctttcaaagaaatgaatgaaactgagagatggcccactcttcaaaattatttagcaggttaattaggcaaaataatgcatatttttctagagaggaaataatgcatgttctcacctaatatttttcttttctgtgtgtttagtgggaaagctacagaatcaaatgcctttggtttcggaaacatatgttatactcaaatatatttggctgataccaaatcatgtaaaatacatccacatcaatccaattatatgttacatagtttgttttttttttcataatggaacattgcagcaatttttcacttgtgttaaatatagtaccatatatacaactctcctaacttgataattttggcataagagaactcatgccaagaaacagaggtagctacccagtcctaatagcagcaactactactaaacatattttatactataattaatacacatcaactacataatcatcatcaccaccaaaagaattaagattaatttaagttaaaattaatgtaaacacatatcaacatcatcaccagcaactctgttcagcaacaaccacacacctcgcatcgtcgtcgatggcgtcgtcgtcgtcgtcatcatcgcatcgcggccgtccgttgctccacgtcagcatcagcgccgccgcggcctcctccgtcagggactccagcacggcggcggcgagctcggcgccgacgcgccgccgcgcgtcgccgacggggcacacgctccacccggccgccatctcggcggcgatgaggccgtgcaccttggcgatctccgcctcgagcttctcctcctcctcccagtagcgtgaggcggcggcggaggaggaggaggaggaggaggagctcgtcgacggcgagcttgctgtgtggttgttgacggggtggtcgggtaatgccggcgtgtaggccgccgccaggagctccctgaagatgactatggcctctgcgatggacgaagtacgtggagcgagtgagctctgagctatccacgtggcggcagcaatggcgccgccgcgccggagacgaaggagacgcgaggtgagtgtacacgtttgcttacttttcgagtaggcaggcgacgctggcggctggaacgggctctgctccagcacggagacggggctcagctgcttctcctcctcctcctcctcctcgtcttccatgtcgtcctcgccgatggccgccgccgcagccggctgctgctgctgctgccgcttcccgccaaccttcttggccgccgcggcgccacgcggtagaaacttggagaggatgacgctgagaagcgcgctcgccggtcgccgtcgccgccgcctcatcgcccgcgcggcggccggccagcaggcggcgtcgaggagggcgggggagcagcccttgtcgaggagaaagaggtggagggaaaagggctcctgctgctcctccagcagctctgaaaggcggcgggcgccgccgccatcactgctgctgctgcttcccgacgccggcgacggcgagaggagggtcgccatggggggtcggaccgtcggagagaggaggtaggtggacggcgccggatggatgaatggaggcttataaaggtgggggaaagaagattgaaaatctgagactctgaaatgtctactttggttaccaaactatatatctccttttgtcatgaaaatatactttaagctactgaacttttttaaaaatatgactatatttataaccctataaaattatgaaaaaaagttcaaattaccaacccaaactaatgtgacagtacgaattacctcatcaattcaaaattagacattcttcaccctcaatttttcataccggacaaattgtccccttagctaattccgaagcggttttggttttacgtggcataagtcaacataagaaaataagtagtgtggcccacttatcaattctgcctcttctctcggtcaccacatttgggcccttaacttttttttatatattttcttatgttgtatgaattgccacatgtgcatcacttaggattaaaaccgctctggagtctatcaaatgagtaatttgtctggtataaaaagttaagagtgaaaaatatctggtttttgaattaaggagggtaattcatattgccacaatagttcagtgggtatttcggacgttttctcaaattattataaaaatgatttatagatacatcatcctttcacaacttagatcactaatacatttagaaaagaaaagttaagatttcatttgtaaaaattatattagtagatttatcatggatatgtggctagtaataataaaatgggtattgctatgtttcagaggtgcaattttagccacctaaaaattacactttcctacgcctaaaattgcagaagtatgcaatgtgcaattttacttctttttagctttatttttcctgttctatatggttttgctttacttttagctaagtttgaatattgtgtgcatgtacttgtgtaatatgaattgtaatttcttttttttagttatgtgttttttgaaaaattttgcaggttagaataatttattgctaaactttctatgtaagaaaaagggaggagtgatggaaaccagtggactgttaccacagggataagaaaaccgactaaaatttttgaaaatcacagtcacgacacttcttagtaaaatatatatattaatgtactaagactatggcaatatcctaaacgataagtaaatctctactacttaaaaaataaaaaataagatgcttccttcgtccgtcaaaaacaaaaaaaatagcagaaaaataaaaaaaaggtctctactacttaaaaaataagatatgcttccttcgtccgtcaaaaacaaaaaaaatagcgaaaaaataataaaaaaaaaaggtccgactcctattcctctggtccgactcctattcctatcagaaaccaaaaaaaaaaatccggctctatccgattcccccttataaaaaggaaaaataaaagtcaccactcctctcggtttgagtctgagatcacaggcaccctcctttctataccatgatatctcatacatcttggtgaaaaaaattgatgtgccgaattaaagatctgtttgcaaaaatagaacctacaggtcgagagcattccatttttatatgattttaatttttggatttgtacttttgcattcgagtccctgtaatttttatatttacatttgagttcctataatcttgcaaaaaaatgaaaagggcgaaataaagtccgatttctaatcagtatatatctcttctctatctctaatctaatctaacaatttaaaaatagaaaatgcacgagaaaataaaaattgttcaaataaaacgcgtgagaaaaaagttagaaaaaagcgcaaaaaacacgctaaaaaggttttacatcttccataaaacaaaaaaaaagcgcgagaaaaattatttccatcgctggtaaaaaaattttaaaaaaacatgcgaggaaaaaactgtaaaaaaatgcgctatttctaaaaaaaatggtttgaaaaaaccacgcaaggaaaaaaacaccatctattaaaaaacaaatcgctctgacaaaactgtcagaaaaaacactaaattgatggacgcttgagtcggatagaatccatcgattttttgccatctactacacggcttttatttcatcacatattctcctgtattggaaaaaagcaaaaaaagaacatttgaaaaaaaaggaaaaaatgcgcgagaaaattattgttagaaaaaacatgcaaaaaacacacgagaaaataaaagcaaaaaagggagaaaaatatggttttcatcgtcagtaaaaaaagcaaaaaaaaaacatgctaggaaaaaactattagaaagaaatgcgccatttctgaaaaatagtttgagaaaatcgcgcaagaaaaaaagcaccgtttataaaaaaacaagccactcatcaaaatacaaacacatattattattagaacttttttacccgttacaacgcacgggtatttttgctagtaaagtataaagtcaatctatactataaaaggttgaattttttggttttgcccttctattttgggaggacggggaccaatcgaaccgaaattttggaatattttggaccgaaataatttaacattttatcatattttgatcaaattttaataaattgtgctaacataaaaaaagtggagtgggttgaaactttggaaatttcattccagaattttggactatggttactagtagtataaatattaaaaagatactaatggtaatggttttaaaaagtttaattaattacaaataccccataggcccagacaacctgcttttcgtgatcggacaaatgagcatcatatccgatccacaccctagctttgcttctgtttcacgtaggtatttatggtggtcatacccatatatacgatcatacgtacatagaggtgagaaagtgacactggggagatcaactatcacttttaagatcggtacaaggtactgg

SEQ ID NO: 40525 - DNA, 3413 bp, Oryza sativa
  unsure (1)..(3413): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgctgttcagagtaatgatccaatctgtgccttctgcgagaaaatgacagtaaaaatccaatcaccacgcgcaaggtcatcttgtgtctcctgaaatcatcagtcgccttcatcaaatgcgtcgtctacaatttgtgcaggtaaagcaccactgctgctgagtttgagcaaatagtagattatgtgcttcacaatactatcgaattcacctcagaagtttgtcgccggtgaaatactattgcagcttcaagctaaccgatttagtgacgcatataatgcttctcactcatttcccgatggcctctcattcttgcccaaatacctctaattctaatggcgctctaacttactcaaggtaattctagcatatgccccaattttaatttgtggacagtctaatgcatgtacaacttcagaatttcacgaataatcttcattccatccttgttgtttgatctttcttgcttcccttttatacaaggatggattgtcaggcagtggaaagtttggtgggtttctattttcagtgagaagttattgttcagtaatcatgttatgcacttaggtcccatgttgaatgggattaaatgtgaatttttgcaatttatgcatatcagggaagctggaaaggggtgctcaaatgagaaaccatttttgcttcttcagaagatgacgccggtacaacttttgttattttgatgaaaatttgtggcatgaccttcagaaatatcagaatgggaaatttaggtcactgccaccaaatggttctctgctccacctggattctgtgtctggtacttgacaaatgatcattctgagtcgggtcgtcttgaatccggaagatcggttcatcggtgacctatcaagtgcctcccacttctctccggggactcctaactagcgcgtgctcgctgctagcgagcactcttcccctattaactacctctattaacactattacttaatatacttaactacctctattagttaatatacttaacactaaagatagtaattaggaaagattcaggagatgtttttactaatagattgaaaattttttaagttacatttgaaaattttcgatttaaattttaaagtcaaattttaaaaactttcaactcagatttgaaaactttcaactcaaattcgaaaactttcaactcgagattcgaaaactttcaagtccagatttgaaaaatttgaaaactttcaatttgagatttgaaaactttcaactcgagattcgaaaactttcaagtccagatttgaaaattttgaaaactttcaactcgagatttgtaaactttcaagtccagatttgaaaattttgaaaactttcaactcgagattcgaaaactttcaagtccagatttgaaaattttgaaaactttcaaatcgagatttgaaaactttcaagtcaagatttaaaaactttcaagttcaaatttaaaaattttcaactcaaaatttaaaactttcaaactcaaaatatgctaaagattaaaaaaataatcacaaaaaaaggaaaaagcgaaaaaaaatgggtaaaaaatgaaaaaaaaaaaaagagtgggaggcgcgcgcgccggcgctgggccttatgggccagaaatgcgcgcgcggcgcgcgccgattagcaatcgcgcttttctcctgactcctgactgcatctcattccaacatggcactctgatgcttgcaaccactcctcgattaatcctgttccatctccattattatctaatctttaatctctctgatttcccttttatagaccacgttgaatcgtccggcattggagagtttgatgtgcgtgtgtttagaatattatgaaattattgttcagttacattatgaagtcccgtgttgattggactgaatgtgaacctttccttttatgcacatcaggcaagcggtgttcaaatgagcaatataaaataaaatataacacactaacacagatctttctatctgtgacggcctctaacaagcctagaaatagcgggccatcacaaggaagtcatctcaatcggaccaaaaagtgtccgattgagatatgatcgcacagacatattagatgggcataaaacttaaacccgtcacggataacacctatcagtgacgggccgtagtttagtcccgattgagataacattccacatctcaaacgggcctaaagttacggcccgtcacagatgaccatcatatgtgacgggcaccaactttaggcccgtttgagataacattccatatctcaaacgggcctcaagttgggacccgtcacagatgaccatcatctgtggcatgcaccaacttgaggcacgtttgagataacaattaggcccgtcacagatgactcatcagtgacgggctatatactaatgtccgattgagatgacttaatctctatcgggcatgaactaaagcccgtcaccgatgagtacttttccatttttcatatgaaatgtttatatttataagctgaactgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacgcaggccaaccatcccatattttagttgttgagcaaattttaagaattaaaacactgacttggg

SEQ ID NO: 40526 - DNA, 8213 bp, Oryza sativa
atggcccgcgggggaagagagagagggaggggatgggccgagccggcccaagaaggaatgggggggaaaagaggacttcttttagggtttttctttttataaacctttttaactttgtttatttcttttcaattattatttgtgctctgaaaattccactaaaatttgagggctccttttagaccaaggagaatttacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacaaacttccagcaaaacttcaccactcggaactgcttggcttgacctcctgttgaggatggaatcttctcttcacctgacttggaccagggtgcaccttttggctgactcagactaggttgcggtagtgcagtgatgcttccgttccagaacttctcatgattcctatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttctccaatggctgtattgctggatttgttattgtctaatcattaccctgtcaaatctgaggcttcgttgtaagaggtgattttaatctgacctctatagactatcttcgaacatatcactggttctataactgggaatggctctcacgaacaagcagctcggattcactttctttacattcagtttacttcccattattatcttcaggttgtcctcagttagtattcaacgtattcctttacacctttaaccttgatgtgttctttcccattggatcatctcccaagacttggcattacctggtaaccggtgcttgcacttttcacttcgtgtagcatctgataccgagtggaagatttcactctttgccttcatagaaacacttttacctaggtcatcttgctgacttaatgacaaggtgactgttgcggggcaattacaatcaggggtcttccgtgagcgatgcagagcatgtttctgtttatcaatcacctttcggcctacttcttttatgctggagaacatctttgccaatctcttttatcaatcatctttcggcttatctctaacaggtggtattctttaatgtgggttgcggacgcttctggggacgatgaggtcctttggcttgctgcctttcagtgaaaccttgatgtggtttgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaactaccaaccattgactattatgttctcgaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcacatatccgcatctttcaaaagaatcctcttagaacttgtctgcattacacatttctcccttattacacgaatacaaggcactgccttaaacaaaaagagacggtgcttaacatcggtacattgtatcctcaacatgaatcatccataagcatagcaagctcactgtttatagacatgaatatattcatgtattacatgattgctgcaaactttcgattacgcaatgataggtagcgaactgaaaaccacaaacacggctgctcattttgattccggagagatatagctggcattgttctagtgactgcatccttgattggttctgtgatgatgtgataggactgcataatgctatcattcacaggagaagattccttctgattgctggttgaagcggatgacggtcttctgcttggtatcgccttccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctataggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacctccaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggtgcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttgaaactggcgggttggttagccatcttcttcgtcagcaaaaaactgaattgacaatcttttggtacatgatcagttccttacaaaaaaaacaagtgatcctgctcgttggacacctgtcgggtggatggtcttcctcgcaatgaacgcatatagtggcacatgacctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccattctgtgctagtaatgatcatcttacggacttcatcttcggttcgcattggtgtttttcttttctgctgaggacgctcccttgcatagtgcccttgctcctcacacataaagcaaatgttacttgcttcttttgggtcaacatgtggcacgtcaccatgggtccttcgggatgctggcggcatgctgacttgtggtgtgagtgcttggactgcctccaactgcacttgaggtcgtatttgactcgggttcagaattggcgtctgatgctgctgtagtatctctataagcaatcggttctggttaatcaggtgttggaccagtgtcacacaactggtgtctggtgcttcattcactcgggagcttaaggtactaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcgctcctgcttcacagctggcttcactgcttcctttgcttcgctagcggatcctgcagccttctggagcgtcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaatacttttatttataaaatatgtccttaggttttatccacttggcttatcctacagtcgagatggctctgataccagcttgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccatcccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctactttccacaactggcatgcacccaaaccccaccgaaaacaggttttaggggttttgaaagaggaagagaggtgtgtgtccaattccaacataagccaaccattccatagtgtccaaatgatatgagaattcccaaagtctaaaattataaaaccacctaatgttgcctaatgaatcagcgaagcatctacctaaattcatactagtggaaccataaatagagtgtccactagatggggttttgtttaatctagggtgaacaaggtattaatatcaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcgacttccacgaagaacggatcttccgaagctgcagcgtctacacgaccaacggaaaagaaaagggcttttactctaataaactccaaataacagcataaacaaagcacaaaaatgggttctttacatcttaaggaaaaattagagacttgaacggtccaattccgagttcaaatggccaagatatggccctttgaagtttatatgctctttaaatggatatttacgaatttcttcatttaaattttaattaaaaaatcggattattgcgtcagccgagggggcgggcgcgcggaccgggtccacgggagtggggcccacgcgtcagcctctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgatgagaacggcggccggagcggaagaagacggcggcgcggctcgggatgacgatggcgacggcgctccgacggtcggcgggcgaagcggagcggcggacggggtcggcggcaacacggcgaagcggacggaggggtcgccgagtcggaaggaggaccggagcgacggcggcggcggaacggagctcggcggcgacggcggggagagaggagcacggcgcgagcacgattccgacagcgagagcgagcggcgagcggcggaaacggaagagcggagctcggggagcaattatatagcaacgggagggagagagggcggccggagagagaggaaacgggcgcggagatctcggctccattgaatacgccggcgaggtttgcgggattgattccgagcgaatccgagggagagagagaggggaaagagggggaatcgggagaggggattgcggggaataattcccccctcattaaggcgcgcggggaaggcgggatgcggcggattccgcggcggcggcggcgctagggcacgggcgggcggcgggcgcggcgcgaggagggagatgacaggtgggacccacccgtcagcgagggcggcgggcgggcccgcctgtcagcggcgcgcgcgcgcgggggagaccgatgggccgcgggggaagagagagagggagggactgggccgagccggcccaagaaggaaggggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacatgaactatagcgaaataattaagtgcagtataataatttattttatgagtcaaaataattttacgggtagtaaatgatttcaaatggaaaaaatgtcaacaacaaagttgtctaacttatcaatatttacaacttttagtttggtcatttttctatataatattttttgaacagtttgaatttgaatttgaaaatatgacaacttcaaacaacaatttcaaatactaaatgattccaattgaaaaagtcatcaacaacaaagttgaataactcatcaagatctaaaacttttatttttgttatttcttcatccaacaaaatgttagtaacattattcataaattttacatatatgtgttataatttataaaacagataagagatatgtcaattttgtgaacaatgttactatcactttgtcgtatgaagaaatgatcaaaataaaagttttagatcttgatgagttattcaactttattgttgatgactttttcagttcatat

SEQ ID NO: 40527 - DNA, 1799 bp, Oryza sativa
ttcaaaaaatattatatagaaaaatgaccaaaataaaagttatagatcttgatgagttatacaactttgttgctgatgactttgttgctgatgactttttcagttgaagtcgttcattgatctaaaattctatttgaatttttcaaactttgaattttaaatttcaaattatttaaatagagtcagatggagaaatgaccaaaataaaaattttgcacctcaatgagttctacaactttggttttggtgacttttcgatttgaaatcatttaataaccccaatttttgttcgaagttgtcaaattttgaaaattcaaaatttgaatctttcaaatgaatttatttgtacagaaccgatacaatagttttagatctcgatgagttatacaattttgttgtttatgatttttgcatttgacacacaacaatcggcctaaaattaaatttaatgttctcatctgtgacgggctttatttttgacagatctcaatgagttctacaactttatttttgacagctttttcatttgagtttttttagtattataaaattcaattcaaaattcattttttctagaagtctgatttgcttcctcttcataataatacttgctaaatataatatttgatccaattaactcggttttgctaatataatatgtgaaatatgtgaatggatatgaaatatatgatcaaaatggatgttatgtgaatgtggttgtgttaaatatattgatggttgtgtatatgaatgaatgtatatgaatgggggatgttggggtgtgacatcctagcctagggcttaataggattaatagaatactcataccaagaatttacaactattttttcggaagccgatctccaaagaactttgatgttaagcgtgttagccctggagcaatttcgggatgggtgaccaaccgaaaagttcatcccgggtgcacatgagtggggataaaaaagtcacccaccggaaagttcttctcgggtgcacatgagtgaggataaaaaagattggcatgggagaggcgggatggcatggcatggctagccaaaaaatgaaatttattttttttttattatactcatctgtgacgggcattaacttatgcctgattgagatgagagtcatctgtgacgagctatagttaatacccgtcacagataagggtcatctgtgacgaacgctagttgtggcccgattgagataggtcatctgtgacgggctatagtttgattagtcgtctgggtcaaagctatcggtgacgggctttaattagggcacgattaagatagattcatccgtgacggccgtttgcccgattgagataactcttcacagctgtgacttctaacctgtgacggacgccatgcccgattgagatggggcttacggtccgattgagatgatggtatccgttctagtgacactttgttgccatatcgagtgactactagtgcttctgattctcatccgagaacctctgtatttgggatgcacctagtgcttctcacttactacctccatcctaaaatgtttgacgccgttggcttttttaaaaatgtttgaccgttcgtcttattcaaaaaatttaagtaattgttaattctttttctatcatttgatttattgttaaatatacttttatgtatacatatagttttgcacatattacaaaaggtttttaataaaatgaacggtcaaacatgtttaaaaaagtcaacggtgtcaaacatttagggaatgagggagtatttcctaaaggcctctcaatctcacccgaatacctctcattt

SEQ ID NO: 40528 - DNA, 1806 bp, Oryza sativa
cctgcaccccccctcgctctttttgcttctttggatgatgactcttgtgaaatttctgttattttgaaaaaaaaattgtggaatgaccttcagaaaaatcaaaatgggaaatttaggtcattgccaccaaatggttttaccatttgactagtttgggagctcaattgtctctgttacgatagtcaggagattggttaattggtcgcttggaattctacattgtcatattctcaacatttttgagaatattctacattggtcgcttgaactcgcatcacaagtggatccatatcctcgaaattcttgaataacaacagagttgcaaaaaaactgagttgtactgttcagaaaacatcatacagctaatcaaaatccacgcaaatttgttgcaaaagcaatgagtttcttgcggacttgtgattgatgttgttcagacttatgaacccaaattgcacgacaaaacaattgaaaactgcagaggggagtcgtagaaactacactcagaagtttcctatccccatcggtagcattttttacagaacagaatggatccaccatgtaggcggttgaaagcacctactgctggtaagcatgaggctgtgtacttctcaccatatgttggcaatcaatcaggtcatgttgaccttccgatcctacttgatccacaatgaatcttgttcttgtcacctgtttcctgaatacatctcattcccaccctcgtgtacctctctttttttttcaaggcattctgattttctttagataattctggcgtctccaccaactatatatagatgcagataacaatttgatatttgtatatgtggatgcttgcacaacttctcgattaattaatctttgctacctcctcagccatgttttttgcttccttttttagaccctgacgaatagttagacagtggaaagtttggtgggtccattgtgaagttgagggtctatcaattaattgccagatttttctaatatccgagtgtttgagagaataggaaaagagaagattgagaatatgcgtaaaaagaaggaggtgaatcatagcgcatgattatttgagtattatttattttaaattttaaaaatggattaatatgcttttttttaaagcaacttacctatagaatttttttttttaaaaaaaacacaccgtttattagttcgggaagcgtgcacgcggagaacaagagaaatcttctctctttcacctgctgctgaacgcagattagtcgatatagctggtatcttactatgcatcagatctgatacccatcgatatcggctgatacccatcagtatccgatcttgtacctatcggacatcggtaccagacccgataccctcgttaccagctcaacgatgtcacctcctccagtaccagctccttgttgtcgcccgcacgtgtagcattgcgtgccttaggctacaaaattccaatcaataccgccggcgaagaggaccatcaggactgcctcgaacaaggccttgatcatctgcccctccaactgcctcctccgatggaggtgctaattccaactgcaaaatcgtgaaacatagatgtgtaggcgtgtagctgccatcttgttcaactccgatggacactgtgctgtccttcagcgtgcagctgctccattacggagcttgagataccgcggagttttagttggttatttcctatttcaatctttacataattttttgaatttttttctaacaaaatctaacatttaaaatcttttagtttctactgaaagttctcatagaatatttttagaaaaattcccatgcaaaaat

SEQ ID NO: 40529 - DNA, 13775 bp, Oryza sativa
aacccaaaaaccataacttttatcggaattaaaagttactctcgaatttgatatagatcgatctgaccggagtatatgcgtcggtttgaccgctcgaagaccttcgatctgaccggtataattgctccggcctaaccacccgatgcgtcgaagtcgctagtcgtcgccgccggtctgaccgccgtagtgttgaggtctgactgcgccgatgtcgtcgttctgaccgccagtgtcccatcggttggaccaccactcccatgcaagatctctcaaagtagattgaaacttcattacttctattcgtgtttataaagtacaacaacaacattcctgacaaaaatctcgactaaactcgaaaccctaacttttctcacaactcaactatctaaaaatcgatatcagaaggcgtcaccctccctctctatttatacccaaggtaagcacaaaaggcacaaaccaaccttatacaagaagttctaatcccctagaaaaacattcccaaataagaaacaaacttaacaaattccaattgtaccaaatttggactccctccaaatttaaactcctcatcccatatgcacacaatatctctgtcgtttgccatatgaaatattcatcaatcacgtgcattgatctctagcctaagtatcccacaagatatcccgatcgtccggacgtcatcatatcccaagttgactcccgatccatctccagcaatgctcttccaaggcatcaagactcacctacacatgaatcaaacacaaaaccatatccgagcacaagttctctgcaatttagtcacaaaacatgaatgtttagagctccatcataataatggtactagggatttgaactctaaaagctatagttttgtgataactttgatattaaagttgtagttctatgataacttcaatattaaatatgcagttttatgatacttaactttaaatctatagttttgtgataaatatggtgctaaatttgtagttttatgatacaacaccttaaatcaaaatacatgtagttttgtgaaatttactcaactatatgtaatacacattctttatcagttttactctctaactaggaaggtggcccgcgcgtatgcgcgggcacatatattattgaaaggttagatttttattgtttgttaaaaaaattatcacatagattaagggcaaactaaagttcggatactgttattttgtaataatttaagggttctattttttttgttaaggtatcttaaaagtccattcgcaagcttttgagtgggagatggattaagtacttacgacttttgaatcatatttttttcttaagtaaatagattaaatcgtctcgtgaaggtgcatgatatagtaagaaagggagggaagcatattcatggagaaaaagaagaaagggaaaaataaaaaaaaagggtggggaagcgtaggtacccacgtacataggtgcgtaccaaaggtggagaggtgggacctcgtagtatttagtttgttctaagatcaatttaatctaatggtttataatattggacccatcgattcaagtgaaaatcaagtagtagatactttgctttttttcttagaatttctaatattttctctaatttattagagcaccacgtgacatcttgagggcattttaagaaattttagtggacttaccacatgtaattagaatattaagatgtaatatatatatgtatgggatgtatgttcatattcgttttagcttcgtccatgtttatatacatgtagagaaaaattaaatatgttgctagcaagccattagttgtttaattaatagcaattaattttgacacctatttacaattggtcatagttgttctaacagatttatcttacgactttgattatgcgttgatcaccaatttacttatcaccatgactcgcatgaaaaaaatatgtactttaggggataggacaactgaaattgatgaattatctgatttatgtgatagctatttgagattataaacgaatgaattgacttctgaaaagttaaaaagttgtttaagaaaagcaccatttagtaacttggaaagcgtggagcgtgcaaacgaaaattcaaaagatggaatcagggaaaaaatagggccttaaactcccttgtaacactcttatcctagtaagagttctgttgatattcgttaatattgtgctcacaattataacataatgatttctttcaactgtacgaacaaataatacaaaatgcaaatacaacataacacaatacattatattattatttaatcaactctcgatttcagcttaaacagagttaagtgttccacggtacttaattcttctctcgctacatcacatctttaattttattttcatgctattaacaacaacggtagcgctgcagcggtcgtgatcacccaagatgcctcaaacacgacactctgtcacatgtgcgaaaggcaaaggtgcagatgtgcattgtggagtgggccaaaaagagaactttagacattattaacaatagatccgatgatttaaataatgggtccaccggttttagtgtaaatgtaacttagttaatatatatgtatatatatatatatatatattaaattgttaatttaatgggtacacaacattatggtgatggtgtagattttattttaaaacactgaattatttgagaataataatccaaagtaataaaaaatagatccgatgatttaaataatgggtctatctgtttaagtacatgtatatattagttaatatagatcttaaattgtttatttgataggtacacaatataatattgtgtaagctttattttaaaatagtgcattatatgaaaataatagtatttagtaaattatcttacattattgattttagagctaattaacatataatatggtgtaaattttattttcaaagtctgcatagctaatttagttacctgtgtttataaagagttatatgatggtattttctttttttctaaattattattatttaaacaaatatatatcagattgtataaatggaaaaaagaagaaaaaaaggaaaaaaatggagggaggcgtacgaacaacaggtccacatgcatgtacgtacgtgacctatacctatgcacgcgggagaaaaaggagaggtgggacccatattatttggtttgttttaagatcaattttatctaacggtgtataatattggacccactaatttaagtgaaaatcaagggtagatgttttgcttttttcttagaatttctaggattttctctaatttattagagcgccacgtggcaacttgagagcgtttgtaggaagtttaatggacttttagtatataaagatagatagatagataaatagatgatagatagatagatagatagatagatagatagatagattgtcatccatgcatgcatgcaagcaatatcataggctcaaattatccttgatgcatgtgcatgacacaagaaacggtgttgcatgttaatcgatattaattcaaatcgcttgtgagggtgtattggtatcgatacacaaatcatatactccctccttatcaaaatctaagacctatttatttttcaatcaataccaaaaagcaattaacttaattaccaataccatgtggcaaaatcaatgaatatacaaccaataagtattagaataactttttatttccgatcaacaatttaatttagcacacaataactataaataggatttagaattttaaaaaaaccaaagaatgaaatgggtgtcagattttataaggagggagtactgtatatgctgataatgcatgtgtatggaggggagtatgtggttcctagctgctgccttgatccccgacttccacctcgcgtccaaccacctcgatcggtcgggcctccgcatcagcggttggtcggccaggtggaggagctgcggcctgcgtaacctctctctcacctcctcctcagccaagattaatctctttttatctcccccttctctgcacggttagagcaagcttaatattataaccaactgctagctctaaattatctttggtcaatctaatagctcattcatataatagttatttttaagcattaatatatagtcccacatctcatacacacaacgtattagaatccgtgttacagttggctataaatctagcctgatttccttcgctccagccagcgtttctgctacagtacgtctctagctatgtcgtcgtctacaacctggccggtacttgtgacggcacctgcacctattttcattgatgcagtggatcatacggtagtattgattactatacccaaatacagtactattttaaggggtaataaaagtataaaacacatgattgtaggttttagtgaccgtcaaattacaggtggaaagatttttaccagtgaaaagaaataggtaatctccaaagcaggccctataatacaaactgtgcgcatcacatgctcatgtttcttcgcgtggtaactagagcctgccgacaaagcttgatagaattaattaataattttaatcaggatgtgcagagtcacattattaattactgggtcgtcacgagcctcttgtaggagtagtaacataggttttcatggcagcgtccaatgcgtgtgcaatattctttaccaaagctaattaccttaatttaacaattctttattttgcgcggatctagaggtcagaaaacaattaacccactgctggcggcaagacactcttcttccttgaaaaacaggggccattggctgtgccatatacacaatctgaaacctgtaccactcccacagcaccacctcactccagggagatcatcagcagatgagcaaaaatggttgcaacaacagctattgtgggtgctaccacgggggtgatgaagcccctcctgtccaagctcaccaagctgctgggcgaagagtatgccaagctcaaaggcgtgcgcaagcagatcaagttcttgatagatgagttgagcaccatgagtgctgcactcgagatgctcgcggattcggaccagcagctcaacccagaaatgagggattggagggacaagctacgcgagctggcctatgacctggaagattgcatcgatgattttatgtctcgtgttgaccatgatggggaaaagatgggcttcaggaaattcttccgtaagttgaagaaactgaaggcgcgccatgagattgccaatgagatcgaagagctcaagatccgtgcgatcgaggcaagcgaaaggcacaagaggtataattttgaccaattagcacacaactctagcacttttggcattgatcctaggctgtcggcgttctatgaggaggttgataaacttgtgggcattgatggtcctaagaagcgtatcattgagctgctagctatggagatgaaagggtctctaaaagtggtctctattgttggttgtggaggtcttggtaagactactcttacaaaccaagtttatgacacaattcgaagccaattttcttgtgcagcttttgtgtcagtttcacaaaggcctgatataaagaagattctaaacgatattgctgaaggagtagggatctcttctcgtactccggttggtaatgatgaaaagaaactcattaatatactccgagagcatctcaagaataaaaggtaagcctagttatattatcaatgataatatatatgaatgcatgcgacttaatacccaataaaaagatttggtaactgtggaatgaaattacaaatactatttcttgatgcaaatgagatgtgtatatcttaattaggtaaacattaacaattttcttatctataggatattcgcaaacaaattaatggtgttttttaggtttcgaaatggtttaagatctagctttgactactatatctgttactatcgttcttaaatcatagtgaaattacattaggtcatgtttgtttcatcttatagattgtataaaatagcttgcagttatctgaaatttactcttgcatgaaacattagcacgtactccacgtcagccctcagcccactactttggtccagccatacactgtggtgatctgatttggctggaataccgctcagccaatgcacgaatcaaaaccaattctaggttagggaaaacgaccctctcgtgttgcccttagctcttttgaagcttgatgagtgttgactcaagtgcaatgacaaagtatgaggggtgtttcaatcggaccatatctctacagtacagctagggcacagtggtgggcttagcagctgccaacacagaatgccgctacaatgcatgtgctaacttgttcctcgccgtctaccacctctatgacatgtgggcccaatgtgtaagtaacattggggtctgcgtgaacttgcggttttgtgacaattttctccattatcattgcaacaaactgaaatatgtcactaatgttgtaacaatctgataattcagtgactaaatatgcgattctctgaaatttactcttgttacaatgaaggtgggaagcttctttaatttgtttgtttgctcggttactatttagtgattgtggcgatccaagaagtattaaataaatatattaatcctggttaccatctaggtctctgaactattatatttgagtctacaaatttattaatcttgcagacattgtccaaatattggtgatcatcttttgcttgagccatctctctatataatccatcacactcaaactcttccatttcaattctccagttcttgtcataatgatctgatttgttagcattttcttcgctaaccacagttaatattgccaacattttcaattattatcaacttcatggccttcaagaacaaattactaaatctatgtaaaaatcttgtgacagatactttgttgtgattgatgatttatgggatgcgaaagcatggaaaattatcgagcttgcattattaaacaataattgtggcagcagaataatcactacaacacgaagcgttacagttgcatcatgttgttcttctcaagttggttatatttatgagatgaagcctcttagtttcaatgaatccaaatggttatttttgaaaagaacatttgattatgaaaattcacattatcctcatccagaaaatattttggataagatattacgaaaatatggtggcctaccattggcaatcattactatatctagcttgttattagatcagcatgaaattgatgaatggcatagggtacttaatactattggttgtggacttgcaaatgatcctaatgcagagacaatgtcaaatatattatcactgagtttcttcaatctccctcactatctaaaaacttgcttcatgtacctgagtgtatttccagaagatcgtaagattaagaaacggcatttggttagcaaatggattgctgaaggattcattcatagacacataaaggtgcaacttttggaggggcttttaactatttgccactcttacaaatggtgcttaacgatttgccacaaggcccacatgtcatagacacatgagggcccacatatcatagacacggtgtggcaaatcgttaattgccatgtcacaagagtggcaaatagttaaatttcccacttttggaagccgggttttacgcgtaaaaccaactactaagatgcaacttttctctgagacccattccaacttgagaaaacaacagcagcaacaacaacaactcctcctgagaccgcacaacaaaaacgacggaagtcagccccgaccccataggccataggcgctcgatcgtatgctgcctcgatccggcctcgatcgatcggcgcctcagcagcagcagcagcagtagcagcagttggtcggcctcggccaggtggaggaggagctgcaggactggcctctttactcaggcaagaatcctctctttttttatctcctccttccctctctccgcacgattaatcgtcgtgagaattgagattagccagcgttctgctacttctcgagttaacgtcgtcgtccacagcctgatctagcagctcagcacggcagcacctgcttcttgcgcgggtaatcccccctaaggtgaaaaatggtcaataggtgctggttttaaataaattggcacatatgagccggtacagtagtgatgggactgttaatatatatgcatgcgtgggaatgccctatagaaaagtccggtaaccttggaatgaaattacaaaaacttctttatacaaatgagatgtatatatcttaggctatgtgggaggtgaggttgggaactcacctcccgcgcacgcaaaacggagcgacacatttttttttgaaaaatagattaatatgatttttttaaagcaacttttgtatagaaaccttttgcaaaaaaatgcaccgtttagcagtttaaaaagcgtgtgcgcggacgagggaggtgagttgggaaaggtaggggaagaacacagccataattgtgtaaacattaacaattttcctatatataggatattccctccagttgaaaataaacgatgttttgcaatttgaaatgatgtaaaatctagctttaactattatatatgttactatatattatttgcaaaccataatgaaattatattaagtcttgtttgtttcagcttatctctactattataaaaactgaagatgtttctgccataattttggtgcatcatccgtgtttgaatcggttttaattttatgtttcagttaaatcctttcctttttttcttatgccagagtgtccctcttatcagagacgtgcgcgaattaattgggcttgcaccttttcacgcgtctcttgccacaagcagcgatcgggcccacgcttgagtctgtattccacacgcgcctttgcgcgccgcctcgattgggcccgcaatgccctcgcacgtgcaatttttcgcatgcccaattgggcccgtgaagccatcatgcgcacaattttcccttgccgcgtgtccgattgagattgcgtcgtcctcgcccgtgatttaaaaattgaagatgttttttttcaaaactatggtacattatccgtatccgattcctgtcacgcgtaacaattgttgactctcgagcgaattgcgaaagacagtatatgtgatatgaataccaagcgaatgaaactcgcagagtctatgtggatatcacgtacatcgttgctcagatcatccgattctattcgtattacacgatacgattcttgggacatgttagcacgatttcaagtcagtctccacacatgctcgtacgtactaccagggataacgttacaataattcataagaatcagttttactttcaaaaagaacatgccaaatgaaataaagaatgatcgaaattgctgaatccgtccgtcatcaattcttgcctgacttaagataaagctagacaacaaatcgagctcatgtttgaaggcctcattatttggcttatgctttcctgtaagcgaaactttaaattttagaacttaattttaaactcgactttttggttttttatcgtactttattttacatcatttacttctgaatcgctaagaatatgtatataaaagatttgcatacaaatagtcttttgtttggtaataagtgatttggataagcacatgaataaacaaaacgatggtatgtgattatttatgcactgacatatatgtacaaattaaattggctctacccgttgcaaagcacgggcaccttttcttttctagtagattgtaaaaagtaagcttgcagattgcaacaatccacaagctggaaggaagtacattgtttcattgtagcaataatatggcatgtgtgtatcgttacaaccaatgaaggtgggaagctgctttgtctgtttccttagttactatttggtgattgttaccatccaagaagtattaaataaatatattaatcctggctactatctaggtctccaaactattatatttgagtatataaaattattaatcttacactcgttgtgtccaaatattagtaattatcttatgcttgagccatctctctgtccaatccatcgcactcaaatcatcatttttaattttcctgttcttatcataatgatttgatttgttagtattttcgtcttagctaactgtaattaattctgccaacattttcaattattatcaactgcgtggatttcaagaacgaattactaaatatatgtaaatatattgtgacagataccttgttgtgattgatgatttatgggatgcaaaagcatggaaaactatcgagcttgcattattaaacagtaactgtggcagcagagtaatcacgacaacacgaagcgttgcagtcgcatcatgctgctcttctcaagatggttatatttatgagatgaagcctcttagtttcgatgactccaaatggttatttttgaaaagagcatttggttatgaaaaatcacattatcctcatctggaagatgttctggataagatactaggaaaatgtggtggcctaccattggcaatcattactatatctagcttgttatcatatcagcatgctattgatgaatggcatagggtacttaatgatattggttatggacttgcaagggatccttatgcagagacaatgtcaaatatattatcgctgagtttcttcaatctccctcaccatctaaaaacttgcttcatgtacctaagtgtatttccagaagattataatattgacaaacgacgtttggttagtaaatggattgctgaaggattcattcaggatgaacaagggcgaagtgcatatagaactggtgagttgtattttaatgagctcatcaatagaagcctgattgaacctgttgatgtaaagtatggtcaggcaaaggcatgtcgagttcatgacatcattcttgactacatcaaatgcaaggctactgaagagaactttgtcacctcattaggatctacagtgcctggatgcactacagagtataaggttcggaggctgtcagtcatcaacagcaatgaagaagatgtcaacataccgacaagcctagatctgtctcaagtacgatcacttactatatttggaaatcgcatgcaaacttctgtatttgatttcaagtttcttcgtgtgttggacctagtatatagggacagaatgggtgacctttttgcaaatattgaaaaattgtttcatctgaagtacatgtgtatctcctcatatggagtggattatctcccagaaaaaattggagaactgaaatatttagaaacgctggacataagacaaaccaatgtggagatattgccatcaactatcacaaaccttcaacgactagctcgtctatttatcaatcaggacacgagattttcagatgaaacgactattggacaattgaagagcctggaagagctaaaagaatttgtagtgtctcagtctgaacaagtgacggccctccaggaagtcagtaagctaaccaagctaaggacattaaaattaacactgcagtcaccattgtcacttgatgattaccatagttgtgtgggaacattattgcaatctttatgcaacctttatgatttgtgcatcatggaccaatcttatgaaaattattgtcttacgttggattcatggcacattgcttctccttgtagccttcgtaagcttgtaatcaaactagtactcaccaaggtgccaaattggatgggtgtgcttggaaatattggagtactagttctaggtatcctgtgtatagcaccagatgatattgagatacttggagcaatacccagcttgctttttctcgagctacaaacttacggaggcaccaatggaaggatcatcatccatggaaacaacagattcataagtttgaaatatttctccttggttattcatgcttgtgggactgcattggagtttgaagcaggatcaatgccaaaggttgagcacctcaagcttcagtttcatctgcatgaattggaatgcctgaatggttcttctgactcaggcatccaacacctctctgctctcggcaaggttgaggtcaaaattatatgcaaaccctcttatgtcattgaattgaatggtttgaactatgatctgatggaacaaaagagtgattgcatcgtcagatgtgtagcaagaaccattaaaactgctgttgagacactccccaaccatcccactatcagtttcaaaacatatcatgtcgaggaatgtgaacattttgaaacagtaagttctccctcagaattgcaggcattaatattgttcactgtatcgcatatgcttgaccatccaaataaacaatttcgatgttattctgatgcacacttttatgtgccttgctttttttgacttctgttctagcgtatcaacaagaaagtaaaggcatgttctgactgagtgaccccaaaatcagaaaattgaagagaagcagacagcgcaagcacagcgggaccgtcatctaggaatcttatgtatggcaccagaagatattgagatccttggagcaatacccagcttggtttttctcaaactagaaactctcggaggcaccaatggaaggatcatcatccatggaaacaacagattcataagtttgaaatatttctccttggctatcggtgcctgtgggactgcactggagtttgaagaaggatcaatgccaaaggttgagcacctcaagcttgattttcgtctgcacgaattggaatgcctgaatggtgcttctgacttaggcatccaacacctctctgctctatgcaaggttgaggtcgaaattaattgcaattgcttcaagcacacgtccaatttcttcgatgactttgaattgaaatgtttgaactatgatctgatggaagaaacgagtgattgcatcgtcagatgtgttgcaataaccattaaatctgccgttgatacactccccaaccatccaactatcagtttccaaataaacatttcgaattggtaagttctccatcagaatggccggcattaatattgttcactttatcgcttatgcttgatcatcgaaatgaacaatttctaacttattctgatgcgcacttttatacacatttccttttccacttctctgttctattttatctagaaaatgaagacatggacagtgacggagtgacccaaaaatcagtaaattgaagagaagcagacagcacaagcacagcaggacagtatactcatcttcatttcctctacggtatcgccaacaagatgaaacaaattaatgaagatgagcaccggcgctgcctgggattagttcttacccagtgatccaggcgaagccgacagcaaggtctaaataactactggatgtttctacagctgggagtcatagctctgctgatgttgttgctggatatatatgttgcagtaatgtagtttcgttcttctttctttggacgaatctggtgtgcttgctgaaataatttagtgctgaggcgcatgctgttgtttcactgattctggacccaacagagattgtagtaattaagattattcaaacaaatattcttccgttaaaagttctatgagcttgtttctcactgtggtttgtttgtacaactcagtacacatttggttactggttagtctcatctaggtgatcaatgaattttacatgaaggttcatgtcattatcttgtttctagctatgaggacgctcatgctagggctatgttttgtctccaacctaggatggaagcctttgtgagatgacaaggttaaggaaaaagaaaccttttgtctaacaacgcgatgatttga

SEQ ID NO: 40530 - DNA, 18133 bp, Oryza sativa
tttagaacaagcttcaacaatagagaaaataatgcgcattaccagtgagaaacaaattatcccattgttactgatattatcaaaactaaagtggatattacttagtacatccaccttgaccaccacagtagaacatgatatcctcaaatgggcgcctgataggcatttcttggattcaatgttcaaaaccatctgtgtttggatttaatgtgagatcaatcgtataagaaaatgtgaccaatccataagacccaaccgaggtcaaaattgcatgttgcgcacaatataattgtatccacagactagctaacatacataaactacagaacaaaactgcagaactacagtgctaaaagactggggaactggtcagataacaataccattggataaagtctagtgtcaaagatgtatggtacatagcacgtaacatggaaattcaaccagatttgccaaaaataacagcagaacattggatcatgcgtgtccctataaaactggactcaaaagggagaaatttcagtttataaggaacaatgtaattttatcacttctactgcccagaggcagggcctacaagaacaccctgcgcagatccttccttcatgctgccttcttcctgggtgtcactatctgctttccggattctgatcttgtacttgagctcaaactccgtgatttccttcttcttcttctccagtgcctcgttcatgcgagcaacaacttcctcgaggccctccttgttgcgttgcactgcaggcaagacctccttgatagtccgttcaaccagcactcccccaatcattctgtagcagcgcctcgaggggtcaagtggctcgattgcaccgatcacgagggagtgctcactgacttccatttccagctctgtgatcttggagtagagttgattcatttcagagcgcatgttggcatacatgtttgcaaccatttgctcgttgatgacttctttgtcagcaccacttggttgaccagccattttgcttggaatccactaaaacataaatagattacaaaagaggcctgcagagaaagagcagttagcttactaacaaaggtaggtatcatgaagttctgtgtaaacaaattcatgggcatattttaaaagatggctactgatggatatagtaattactccctctagtaataaagagctcttttaccttaaatataagaagctactttgatggctagaccacaatatgcagttatcatatatgaagaaaggttacaaaagcgtaattctatgaagtacttttaagaacaaaattagtgcatatgtcacttttttactggaggaagtaccaagcataaaagtaaggcaatatatagggaactttggtagtggaattccatttggagttacagatgaatatagatgactccatgtaccatgcaaaggcacgaagcaaaggaactgagacatttcataataacataataaccctcagtattcaaggcttttctgcatttccatctgccagggtacaactcattaactaaaccctatagtcccattatttctgtaccatccatcccatcactgacataaaactgttgacccaaatcccttatctagaaagggaattatttcggtagatcacaactcccctgatcccctcttaaccatcttgtgatccccacaaggcccatttaaaagttagtctgccttttaggacagcttgcccctattctggtagcacactgtccttgtaccattactctggcagatcggatagatcaaagcctacacaaggaaggtgcccacatagcgcataattgaagttatattgccaatgactccatcagctaaaaaaagctccatctattacagtttgctaactgtttcaggaatatttatatttccgaaaatgtggtgttagggatgcaatatggctggtcaaataatgcacatctaacacatctaccacgcaaggtgggttggaataactataaatttcaaactagcaaagacgtgtaaaatgatcatgtggaaatacatttgctcattctaaatgggatactgggattcttggacacgctgtccaacaaagggaacagcccactcaagtttgttaagcaatgagcatgccatcttaaggacaattactcagatgtgcaagtgcaataaccaatcaatatcagtatagcatgctgcatcctaatttgagattttgctgcctgaacttagcccaaggtaaatttgacttcacaacggagataaactgtaagcaactaattgctataaatacaagatagataatgcgagcttggaccaggcaccagctagaaggaacacaccagcttagaagggaatcacggtggtgaccacactaaggtaccaaacgcatccacctaaagacctcatttggaatgcatgaatattacaaggaaaaatgcgatatatatctgtatactacttaaaattttagtagtggtggtggtcgttctgccacaccacccttaccactaatatttgggtctcacaatctatactttgcaccaccacaaccgacctaacaaatgggtcccatttattagcccctactctccaatgatttttttccgtttcagtgctggctctcccaaaatttcaaaatcacctacttgttcactaaggaaaataataaaactactacttattagactaaatatgtgctcaatcgatttaataagttagaaactcaattctttttccgttgcaacgcacaggctcttggctagtatacatgtaacgcatgctaccatcgacaatcagacgaagaggatcaaaagaatatacagatcgccatgggctgatccaacttgggacttttgtggggggaacaaacaaagtgttaactgtattaaggttaaggctctgaaattaagagcttcttccagatctacagaagagaagctagggttaacacaagcaagcaagcaaattcgagggtgtgtgagatgaatcagaaaaagatgatgtggatgctcaccaggacgcaggaagaggacgcgacctgctccgcgagatgggagatccgcgcaggccgcagggagcggagacgagacggggaagattttcgacgcacaatgatcttggacgctaagattatttcccctctctctctctctatctatctctctgaaagaaagaaagaaactcacccttgctgtctcagcggatacgcctcttccggctgccgccgcggcgggcgaactccggtggacggtggtcggcagctgcgcggcggcgcgggcggtggtcggcagcggtcactgcccctccgccatgaatcggggggtctttgtcgaaccattttcgtttttagatttttttttttaatatttacagaaataatctatcgaccaaaaaaattgcagaaatagcccctgccgcccaaatggtgggcagcaagctgacgtggcagacggtgggtcgaccgcgccgtctgccgccgtcggccaaaattgcgagagggcggcaaggggctaattgcaattttggccgcccattcagagcttgcggccgtacttttcatctgggtcccgagggcggcaaaggacccagatgaaaaaagtacggccaaaagacttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttacattgcggttacatagatgatattagattcgaactaggagggaggtagtgcaatagttgaacacaacgacgatgtaataatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaagatttatggaacgaagaacctgacaacgatcaccacacctgcatcttggacgggcttcccatggagggagtgccgtaattagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacgatcatagttagggcacctaaaaaagcgccttcctcgaatatcaggattcctcgaagtcattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgagggctcactcattaaggcgacttatataggcgcaaaaaatcgagtgatacccctgacatgtgaacgtggtggggtatggtgggtatgcctgattggcgccgaaagatacatgcatgatcagtgccgaaagttacattggtcgtatgcgccaaatggcgggcaaatactcgtatcacacgcaaataaaggaggctgcatcggtgcggcagaaagtagtcatgcatgcgccgaaaggtattgtgcatgcgccaaaaggtatcgtgcacatataacaacaacgtagtcattacacaagcatacagtactggaaagtgaagcaagtaaacaaaaagaagactgctctactggccctgccccgcgccgcgaccacgcttggtcctccgggcctgtgctcgcacgtggtcctgggagaaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcgaagagcacggtggaagacaggaaggggtccgacgaggtcccagcatggtccagtggtggaccctgactcgacgtgccggctgcctgtgacgctgaccctgcagcctgggagaagtgggtggcctgcgtcatagcgaagtgggcgaaacctacacatcgacaacgggacccttgtaagctaagacataaaatgtatgtaaattgattatggaagtaatgttgtttttttaagtacctgtggggggcacaacagaaggcctagccgaggaaggcggggtgctgaacggtgcacgaaaccctgaagcaataagcaagtaaaacggctcacttatatgtgcgaggcatgtatagaagtagtaataaaaatagttaccgccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgtctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagagcaagatcttaccggtgaacagcagctgggacggtggtcggaaacggtactggaaagggctgacggaagccgaacaaccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagttgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtacgagtactcgtcggcctccgcctgtagctgctcaacctgcaagcagtcgataaaatgttaggcaccttaactgcggactaaatatgtaatacgattgtcatttcggtacaaaaacactcatggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccgtggtcactggcccaactgcgtctcccgcgagcggtagccccaacaagtacgatacgtcctgtagggtaggggctacctcaccgcacggcaagtgaaaagtgtgcgtctctggcctccatcgatcgaccaaagctgctacgagggacctgtccacagtccatcatctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcactgcagtaaggtgagaccggtgtcggtaatctatcgctgggtccaacaactgaggtgtatcctgacgtgccatctctgaaaaatatagtgtttcgagttagaacaattcaaaaaatagtactgtaaaacaaaagataacttgcaaaattatgaaatagtaataaaatcatgagattaattatgtacaacaagagtacaggctatttaaatatagcaaatgttactaatggtacataacgatgacgtgcaatttaacatatatgtagagttcaataatataacataacattacgtgtcgaagtccgacatacatcagcatacataaagacgttaggcgccttagtccgacgttacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctctgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttattgaagtactgtgacacatatactgtatgtggtatgccacactccactgcggcagcaatgacatgggtgcatggcctgtggagcagcttcggctttgcacaagagcaatgacatgtgccgtcgtctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctctaatctagttcttctaaccaatgttggactatccgttgggagaggtccaagagcttgaggagggtcagcaacggcggtcgatggagccgctgcacgctgatcactgcatttggctgtcaactcatctaatctcttccaaaactcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgctaagggcaatacctggttgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcagattattgaccttggttcatatgtgagattatcgatgacatgcacatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcggccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcagccactccacctggttgaatgcccactggagctactacacccccatcctctcgtgcgttgacctcctccacagaagtctcgtttacttcagcattggtccctcgccatcatccatgttcgtctgcacacctggatccttcgggtgaacaaacggaaccaaagctagaggccacccacgttgcaatgtattttccaaataccatctccacactcgagagttttgaactggcattagttcccaataaaaactctcagttgcccgacttactataacattgattgttatgtcacttgtctgtggatcaactctcaagcccctcattaaccatccttttatagaaggtacactcctctcagccggtctctcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagcccaatgcacggtgatgtattaattccaaactagcagatctacgtagttatcgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggcctcttgccgccccaccagagggcggcaagggttttcttgcaaaaaaccctccctccgtcaccgcccgttcctcccccgtttgccacgtcagcttgccgccccagaggtgggcggcaggggctatttctgcaatttttttggtcgatagattatttctgtaaatatttaaaaataaaaatctaaatccgaaaaaaattcggtctttgtccatgagcaagagtatacgggcccattttgggcccagttgggctttcaatcattggaggattaggcccaaaccagctcttatccattgggcccatggttaccgtcatccacctggcctcatcccataaagggcatgcttgattgcgtactttatcatgaaagtctggcaagtgatcgttcaaggctgtagttgttttgtgttagttctgtgagcattttatgcttaataatcttatagacagattgctttcctttttttaataattgaatataacatcccggcctttactcaagagagctacagccaataattacatagtactccctccgtttcacaatgtaagtcattctaacatttcccacattcatattaatgttaatgaatctagatagatacaatgtaagtcattttagcattccccacactcatattgatgataatgaatctagatagatacaatgtaagtcattttaacatttcccacactcatattgatgttaatgaatctagacatatatatctatctagattcattaacatttcccacactcatattgatgttaatgaatctagacatatatatctatctagattcattaacatcaataagaatgtgggaaatgttagaatgacttacattgtgaaacagaggaaatagcactcaaataagagtgtagttcaacaaatcattgaaaacgcccaatgaacaaaataagtaacgaaactaaaataaggagaacacattattgaagtctatttgtaaatctccatccataattgacaaaaagttgtataattgtcatctcaagtttgcaacatgcaacttttataaactctttgtcgtcttcaaacttttgtagttgcgcccagtatcgaaaccaatatgttgccctaaaaattacctgcatataagagatgtatggtgatttatcaaaaaccaaatcattcctgctcaaccacagagtccaacatattgcataagctcctacaagtacaaacttgctccttttcttgtccaccccaaaagccaaccatcaaaaatgtgggttatgctactaggaaggtaaccaaaagagaattgaactgctctccataaaaactttgcataatgacaatcaataaaaagatgttggatagatttaattttcatgcagaaacaacatctcaaacaaccattccaattccgtcttgccaaattatctttagttaacacgacacctttaagcaaataccacataaagatctcaatcttaagcagcatcttgagcttccaaattatcttatttttctcaatatagccattattaattaaagcaagatacattgaccttaccgtgaacataccattctgattaaagttccatttaaaacaaccagatgagtgattcaattggatatgaacaatagaagcacacaaatcatgccaagaaacaagattctgacccactaatgctcttctaaaatacacattaagaggaacagaattcataacactagcaattgaagaacatttccttcggacaatggtatacaaggaaggatacttatctttaaaaggcaaattaactaaccatttatcttcccaaaatcttatttgttccccattattcagaatccaagaacccatattcaagaaagtctccttaactttcattagaccggaccaaaaatgaaatcaccatgtttcctatcaacttgggttatagacttattataaagatattttctcttcaacaagtcttgccaaactccttcctcatttattaacttaaataaccatttactcaacaagcatttgttttgaatttccagatgctttcttttttttgaaacacataatagtacataagcatgtgctcctatgagcatttcagaatactagaccggtctagcctatcactgaaagaataattaattataaatatgagcacatgtgctaagtctaaaaattgaacatactccctccgttctaaaaaaactcaacctagatagggatgtgatatctcctaatacaacgaatttgaattcactatactagaaggggtcctagattgtttttttaggacggaggaagtaggtcggtaggatcaaccataagggaccttaccatctaagctaacctcaattcgccaggcaagcaattagacattctgacgatatgtactaacctctgttgtacgagtaaagaatttccttctcactgataatatgaggtgttcagatgaggtgaatcccacccaaccaatcagatccatggtgggaccaattcggttcatagatcatgtagtgtcccaagactctcctttcctttccatgcagtaaggccttgtttaattcgcgaaaagaaaatttttaggtgtcgcattggacgtttgaccggatatcgaaaggggttttcagacatgaatagaaaaactaatttcataactcgcctagaaaccgcgagatgaatttattaagcctaattaatccatcattagcacatgtgggttattgtagcacttatgactaatcatggactaattaggctcaaaagatttgtctcgcgatttccatacaaactgtgcaattagtttttcattttatctatactagaaaaaaaatccccgtgcattgaaatgggtgaagtctattttaatcttattattgtcatatggtttagctaagataaaattcactgtgggagttcgcttggatatatatttttttagaaaatcatgagctgtagttaggagtccgatcgtctcaagttagcatgcaagtttttttaaacagattccttatatgattccttctgtattaccaaaagtgaacgatcttaaaaaccgactcaaatattaatatgtatttccaaaagtaaacaaacttaaaaattgactcatacacgaatgacatactaaaataccggcaaaaacatctttaatttttgtaatagtagagatagagaagagatatagattaaaaccaaaacataaaattaaaaccgactcaaacacggatgacgaacagcggaaacatcttcaatttttataaccgactcaaacatggatgacggaccgcggaaacatcttcaatttttataatagtagagatttaatgctccatgtatgtgtccaaagattcgatgtgacgttttttggaaaaaaaattaggaactaaacaaggtctaaatttcatatttgtcgattgaatattgctaaaaagatactttgaccattaaaatttagaaactactaggtacatatctggcaatgaattcaatcaaaatttaggacactacgtcataaatgtgtatgtcttgaatgttacgtgtgcctcgcgaccacgagctttttacttaattaatccctggttgattcaaacgaaagttagggtgtatttagttcacgtcaaaattaaaagtttgattgaaattgaaacgatgtgatgaaaaagttgaaagtttgtgtgtataggaaagttttgatgtgatagaaaagttagaagtttgaagaaaaagttgggaactaaaccaggccttacataaattttggagaattttatttctatgggatttttttcctagatgatcctttcaataaaagcaagaatgctctgtatcggtcgacagggggaggtgggaaaatcggtcgctccccatccccatgcacgcaccccgctggatccacccacttgtccctccccttgttccacaaaagatatttcatctagtgtacttataatatttcacatgtatagatctaatgttgcagtgaattaaaatattcttttgcaacaaatcacctgtatattttagaaaccatctattatgggaatttgttttattttttgttccacaaaaatgtttcacctagtgtagtcacaatattttactgtgtatagatctactgttgcagtgaactgaaatactccattgcaacaaaaaaaaatccacatttttggaaccccctattaaggaaattcgttttttttttgttctaccgaaaaatatttcacctaatgtacttagggcattcccaacccaatgactaggatgatgtccatagcattaaataagttgccacctaggacaaaaaatgatgtggcaagtgaataaatgaagaaagagaaggaaaccatgtcttgcatgagacatggtttctacacaacatccaagacatcatgtgagataagtagcattaaattgaagtatggaatagtggtgtttgcattggaagagtagtgtctagtactagtttcttaatgatgtggagtttatagaaaccatgtctagtgttataggttgggactgcccttataatatttcactatgtatggatcaaatgttgcagtgaactaaaatattttttcgctatttgctgaaacattgtttttatataaggtgaaacaacacccgatttaaacgagttaaatattttcgatctacttagtgaaacaattccgatattcctagtggaacatcgtgcaacatttaaaaataattcaataacaagctaaaaaaaattcgtcggaatatatccatgtatggtcttgttttgaagatttaattgcaacgaatttaatagtgcaatcggatcatgatttggataagtaatttaagagaaaattcaatttaaagtagttttgcacgtaaatcgggctgacgtcagcgcctgatttttctccaaaccgatcgggcgcccgaaccgtagactcgtccgaataaaaggagtcgataaaattcctatggaatgtactatgaggtagaacctcatggaactttcctttgagacattatctctcctctaactactgctattgtcgaatgacaactgcgtcacattaaaggacgtggaaacccgttaggtgtttggaataataaagcaatatattaattggtaaaattttttgggatccccccattatatggccctagggggctatttatagtcctaatacaggctcataccctatagagtttggttagtacaggggaatttacatggttcctcttatgatagggacattacaatgggtataaaacgtcttatacattcatgggccctaaggtgatcttcttgggccagcccattaggtgacgaagggcctccatgggccgccaggccttcttaggtccttagccgaaggcctcctctactccagatgacggctttatgcttcgcttgatgtccttcgcccttagtgagccttcggtcggtcgccaagcttggcggcgaacctattgatctttatcgtcaggcttcgtccaatggttggtagcgaaccccatggtcttcgccctacggcttcgcccaaaggacttagccgatgctttgatggattaggtagtttcggcaggttaaccaaaggccctcatgacattcctccaacaaccgcttttcctgcggtccaataaaactgttatatttgtgttttgtaattctctattttatactagttgtattcatgtcaaaatcctttgttttctcaatcctgtaattcaagaggccctattccactccgtattccaccacctgacgtactgatccaaatcaattccactccctattccagcacccttttcgaggacggcatgctgcgaggcgtcgggtagcggatatgagctagcagagaagggttgtgtttagttacacgccaaaattggaagtttgaagaaattggaacgatgtgacgaaaaagttggaagtttgtgtgtgtaggaaagttcgatgtgacggatgaaaaaaaaagttggaatctaaatagggccaagagcagcagctggcgtcctagctcgtggcgaccttcttggggttcagcgattgtgagagagtagaagagaggatttatggtttggtttactttatatatgagtccagctactgatcaatataattgtgctttacattttacattttgaagtgagctattttcacatgactacacataggggtgaaaacggagcggaatcggatggatagtggtcataccatatcctagaccatattttttaagcagattcggagcgggtgcggatagtgtacggatgcggagcggattgtttcagatgtcagaaatggtgtggaatcggttcggaaatggattaaatttatcgaatgttatgtttgtatgcaatcaatataacaccaagttagcaatgcaaggaacaataatacaataatcaataaacgacataaatacataatataaaaatacagctacacaagactaagaatacataaaacagattaaaaatacatgagatgaagaaatctagattaattgatcaattaggccattagatggaccaacttatgttatatgcagtagatatagcggt

SEQ ID NO: 40531 - DNA, 11427 bp, Oryza sativa
tttatgaggtttgaccttcttaggcaaaaaaatacatatcatacaacatatacagataaacacatggacatcttattgaggacactaccactagaagtctcaactagtgatactttatttgccaaggtcataacgtacctaacgtaactaatgtatggcctcgcacaatgctcacttgagttaaatcgttcagagtgccaaacttgtttgggttgtataccctctgctccacattttaacttgtaaacatgtgagataagagcaacaacatggtgcaatttgtgatgtcagggatatcctttcttcatataccttccaacgttgaaccaactcatttatcaagctacacttaaaagggatgcaaaaccgatctgtgtttgaaagtctattatgcatgatggtctattgctatacattgattataatattgttagtttatagttcaaaactagcttttaggggtctaattcccactccgtgtaaaattgactgggggccaaagcccccacgctaataactttttttggaaaattttcaattaagcaataaaaaatagagaaataattaaggaatacaatccttgtcaaattagcaaggattttggttcgaaatcctttcattttagtagcttacccaacttctttctattcaatttttttttcaaaaatgagatttaccaaaattttcatgactctaaggtccaatccaatctatcttcctttcttttcctttcctatactaaaaaggattgaaattcatcactctcttatagttcattgtttccagtgtgctagcttagtccctccattttttctgttggtcgatcgatcaactcgtctccgttgttatgcgttgcccgctacaacctccttgtcactattgtattcattcgctgccgattggccggatcaaataagtaacacatactagtttttattatttgcaagtgtgacacctttctaaaatctaatttttttatatgccactagagcttgtaatattttaccctcactactaccattcactaatatcaaccgattttactccatacaccccttttgcaaaatcacaaaaaagtactcatttttccacctcaaacccatgtacaagtccttttgcccatgtatcgtgttgtcttttacctttaaaacttttagaatttagataatgttagttataattaagatgatagaatgaactatagaatttagttttagacggtaatgtggttttagttactagcattttgtctcaaaaaatacttttcattattttaatttgaactaacgttgtttaatattttatttaagatttatgtgcgatgatgaaaaacacattatgcatcgttggatttgcactggtactaggatttgccacaggattatctattgatctctcatatttttgggtgcaagaatgaaatacatatcgaacaacatatacagaggaaacttgaattattatatcctgatctcttgtatttttagggtgcaagcaagaaaaatacttccaacaatatatataaattgtcggcatgtgggccttggcaggcaccaagcgtcttggagagatcatcccacaatttgtatagcatacagctttccttgttttttgctttttctttatccctaggggttgtattttctcctgctatattcgatgaataagcacattcttgtgctggttcctttcaaaaaaaacaatatatataaataaaagttggatttcttatcaaagtcaatgctgagtaaggtcttcagtttgttttgctcttaaaaagttaatgtatggaattggaaagtgtcgagtagataccaatactactagttataagagatatgttacccaagcaatatggggcatccaggtggtacgtatgtgatcaaaatatggataccagtgtttattatgacttttgtagccttagatttagaatttctagtgaaaatattcaatttagtattctacatgaaatggacatgttagctatacttgtcaactagtctcaagtcatttataaatggttactgaataaggctgttgtgttacttatcgctactaatgtgttaagaaaagtagtgaaattatttacaagatttgccacatcacaacttaatataatcacaaccaacaaacctatactacgacaattgccactaccaaagcattttgcatggtaatttgtgttactgcaagcagctatgtggttgcgtttcagcggctgtaatgtgcagccgaacacaccctgaattccctcctctatctccgcacccgcccaattccgaggcccccgctcaaacgttccacggaacgaaaatttcaccacgcccccgtgggaaaaaaaataccacccgtctgatcccaactccccaaaccagtgtttcacggtctttgcattggaagcattgcccccaccgtgcagaaacgggcgtgtacagctacagcagcagtatggaaaattccttgcacccaccgaggctgccctgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggggccgtgcccgtgccggcacggcacgcccgcggcccacgggccgttcgggggcacggcggcccgtgaaggcaggccgccagcagtgcactgtgcacagtgttttttttttttaaaaaaaaggaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaaagaaaaaatggtattttcgctacagtaacgggccgcccggtccgtgccgtgccgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccccgggcggcccgtttggcccggcccatttggccagctctactgccctgcactgcatgtgtctatgggagcatgtaggcagttgtaaacatattttaaaaagataaaagagaagagataagagcagcgggctatatagatttatagccagctgcagcacaaagcatttgtgtataataagtgagaccaaatattgattgtgtagtatatatttataaataagtattgtatgaattggctattaagttgactacatatgttttgaagcgagcttggataaaacgcgctctcctttggataaatacatcaccgtactccgtagtactagtagtagacgacgtgttcccacctgtccgtacgcccgagcgagaagagcgcgaaaaagtcaacagtgccactcatcacccgacacacgtgcgcccgctctgacaccccctcccgaaaccccaaacccctttcccactctctctcacacaccacgtcccatcccgtcgcgtcgccgcacattcacccccacacccttgccgcgccgccccgcctgccgtgccgtccggcgaacctacctagcctagcgctagcctagctgaagccagcaagcaagtgcaaacagtgcccaggaccaccaccaccgccattgccgccacctctccctacagctgttcgactacgccattgtcgtcactcactccaccgtactacactcgccttcttctctctcctctccgacacgacagcgacttctccctcccgccaccttttccctccaagaaccaccccccaagaaagcccagaccagagagacagtgtgccgatggcgatggcggtggagggtgcgggtgcgggggtggtggtgagcgagccggaggtggtgtcgataccgccgacgccgagggggatgtcgacgccggatgggacggcgacgccgccgccggcggcggggaggggcgcggcgacgccggcgaggcgggtggtggaggggctgcggggttacctggaggaggtgggacacctgacgcggctgaacccgcaggacgcgtggctgcccatcaccgagtcccgcagcggcaacgcccgctacgccgccttccacaccctcaacgccggcctcggcttccaggccctcctcctccccctcgccttccccgccctcggatggtcaggcactttccctctgcttgcttcttcagtttcttcctcctctctgctcctcgcccttgccatttccctttctttctttctttctttcagtttcagatgtgaattaatgcaggttttctgactgtctagtttttttttctttttcacttctgcttttactgatttggtctgaggttatggtttttgttgatttggtgatctgaggatgtaatgtgcatcctgtgttacttcagatgttatgcagtttctctggaagtgttttctttagttctacttttacttctttgatctgagattatggttcttcttgatttggtgacttgagactgaagtgtgcattctgtgttcttcagatgcgatgcggtttctctgaaaaatgtaattcttttacttttgggtttactgctcgaatgtaattcttttacttctgggttcatcttgctctcgaaatctgaagctgtaattttgcattctgtgttcttggtaggaggtaattggattgggcgtgggatatattttgattttactgcatcagtttgagcttgtgattctttgttgcttcagtgatttgagactgtaatatgcattttgttttcttgattggaagatgtaactggattgggtttggaaatcactgaagatttcacatattctccatcactgcagtgcatattctccgtgtccattcaaaaaaaaaatctactgaaagcctcatccaagaacaagacattgttgctttaatcatgctctgggtgtggagctaccccttttgctacactttggactttgttgtccaggattcttcttccttttttaaaaaaaaatcagattctttagatggatattcagtcccaaaagttttaaagcggtggtgaaattgtattgtttatttgtttttcagattgttccagcttgggatttcttacatggttaggaacgaaatgttttgatgataaatatatttaacaaaaaaaaattacaacactttttagcaaatgtagagaaaataactgaaactgaggggtgaaaatacagatctgaaacatcttttttttttttcagtttcaaggatttattcctgaatcttcagtttatatatgagttgattgagttcttttgttagcacgtgcaacggcctcctgtgaaaaagcatgctcagcactgaaagaaaaaactgtactatgattcaatacaatcatttcaaactgaattttttcggtgccaatttgtgccttgcaactggacacagtatcaactagtagtattgatactctgaagtgcattgttttcagctgaactgttgtacagtttgaaaacacatcctaacaaatggttctttgcactgtaggagctggggaataatatcacttactgttgcttatttctggcaactgtacacactctggattcttgtcaagctccatgaagctgtaccaggaaggaggtacaacagatatgtggagcttgcacaagctgcatttggtgagacatgttctctagtctttaactattttgcatgtccattacaattagctttctattccaagctggatatctctgacatgatttctgctaatagtagcactgagttatgagtaatgcaatgtatataatcatggccttaacaagatctgtgtcagaaagatagagagaatctcctaacagtataatgtgctcttccaataggagatttttgtgttttttggtgggacagtggctagtcaaatgtactaacaccctcatgattgggtcacatctggatagcttgaactgtctccattgatggataatagatcaccctcatgttacagtaatgcaaaatgtggaatcttttttgctaccaccattaattactatgtcatcattttaatcaaactgttgcatttgacagctcaagtaattattgcctctggttacaccaaactcagaacatgcaatgttgctaagattctctctgccgatctgatccatttgactggtgaaatgcaaaatcagcaagaatgtctgattgctcttgttttttttttcattcgttcaggagaaaaactgggaatgtggctatctcttttcccaactatttatctgtcggcaggcagtgcaactgcgttgatccttgttggaggggagaccatgaagctcttttaccaaatagtttgcggcccaatctgttcaccgagtccgatttcgacgatcgaatggtacttggtgttcacatccttggccatagtcctttcccagcttccgaatctcaactcgatagccggcgtttcactcatcggtggcaccaccgcaataacatactgtaccatgtcctgggttctctcggtcagccaaccgcagcctccaacagtctcttatgaaccacaagcatacacttctcttggttcatctttgttctccaccttgaatgctcttggaataatagcatttgcattcagggggcacaatcttgcacttgaaatacaggtttgtcctcaagaaaccaattcacaagagactttttgtactctacagttaccatttggtggttcagtgtttgaatgagctggaatctgtaatttttttcaggcgacaatgccgtcgactttcaaacatccagcacatgtcccgatgtggcgcggggccaaagtcgcatatgccctgattgcaatgtgcctcttccctgtcgcgatcggaggttactgggcctatggaaacatggcaagtactacttgatcattagacccaattgttgctgcacttaacactcttaagtcctaacagtccttggaacattctccctgttgttttccaatgcctgcaggtgccacagggagggatgctgacggcgctctacgccttccacagccacgacatcccccggggcctccttgctgcgacgttcctccttgtcgtgttcaactgcctgagcagcttccagatatactccatgccggttttcgacagctttgaggctgcctacacgggccggaccaaccggccttgctcggtctgggtgagatcaggcttcagggtgttctacggcttcctctcgctgttcatcagcgtcgcgctgccgttcctctccagcctcgccggcctgcttggggggctgacattgccggtcaccttcgcctacccgtgcttcatgtggatctgcatcaagaagcctgagaggttcagctcaggatggtacctgaactgggggcttgggctgcttggcactgcattcagcctggctctctgtgtgggtggtgtctggagcatcatcagcagtgggatgaagttcaagttcttcaagcccccaagctagattgaccagcaatttccagtatcaaacttgcaaaatcagtacaaattctggtgtgtttgtgatattttcagacaatggaaaagcatatcccagctggcctccgcattgtgggtgtgcttgtcatatggttatatgaatgatatatgatgatgatatatatggtttatcttacatgccttggcaagaacagaattatgtattttctattttgaacacaagaaaaacaacaatggaatttcaccgaaacaattataaatgatccaagattctttgcacgattcctagcaagaatcaagttatcactactaaggctctaggacaattcaaatggttttgggctgattattaactcttttatgctctgcttagctactaagaaccagttaggaacataataatttcattggagtgttttttttttgaaatgttttctcaaaagacaatgggcactatctagcaggaacttatttaatcagagtcaatgttgcgatcaaatgaaattattgcatccaaaataggggtaataatatcaattttaccatttttagttttttttaaccagacaaaaaagatacggtaacgtcacgaaaataaattatcaagatgactatgataaaatagcttcggatagcatgaggcagcaccaatgttttgttccaaaatatagcaactttaagctctcaggatttgttccaaaatataacaacttctccaccaacattctcttctcaaccaatcacaactctctaccatttacttttcccacatacctccactacttatccagtcacagccctccaccatttacttctacctatttttttaataaccatgtccaactctaaaacttcttatattctaggacgaagggagtataattttgcatgccattgacaaatatgagtattgtgacatttaaagcctatctttgtatggtaaggctgaggttaagagcatctgagttggtgacatacggaattttactttctttttattctcgtgtgcctacttatctattggacaggagcacaaatactaacagttgaattttttttttgttattataccagaactacacatccaccctaactgttcactctaaggtcattgacggccagccaggaacactagtgattgagtcatttgtggtggacattccacaggggaactccaaagatgacatacgctattttgtcgagaacttgctcaggtgtaacctaaggaccctcgctgatgtgactgagagccatgccgaactttgatagactttgccttcttttttttaggggaatctcattttccttctttgcttatggtcagaatagtcgggatttcaaattggtagaacttgttaaaactctaagaaataatggagctccttgatcagcactaactactaaagcttcttccaaagaaattaattaccagtgcaatcatagcgctcacttcagtttactacatatacatatgcaactttctggtttagtgtgctctagtgtttgaaaaatgctgaactgaaataaaataaaaatattccgaaggattgttctcggacttcatgtgcaatcaagtgtgttattcttgggtattcaactaatgtttccatatatgcatgtccctcttatcatcatgttccctaacttatttgagttcaacataaacacttatttaatttaacattatcttaactacaacaccatatgcccaaatgcaacatgtacattgtattgactagaaaggctaatttgtatttagaaaaaaaaacaaatcatgatataagctttcaagaaaaaaaaccaatcaacttgacaattatgagcatgatgtacctagtatagacatctccgccctttggatgctgaagagggcactcctcagccaccatgcatgtcctatctctacctcttaatcgaagacccaacatgcaaggtgtcgtccaccaagttgggcatccatccagtggcccctgcctccccaccgttggatctaaaggtctagggataagggacattacacgtgggccttagagccatcggcatcacacgcaataggttaaccttagagcttccgttgctgccaaagggcctcggagaccatgtcacgtgatgctacaatatgagagcttaccttccttccaatttgggctgcctgagcttggggggataacggatctggctactcccaagctcataacagctagatctggccacctcagatctcatgctggctggatgtggcatttcctatggtcgggttgaatggaagggaggaaggtggcaaaaatacagaactagtggcatggtcgggtgaagggagaatgagcaggtggtacgtcatccagagaagaggagggagggctagagggggatgaatggagatatagggggtatgaaggggacctcacgtggacaatgaacttagtgtgggatcgaggaatctaattcagcttttttttggctgatttcactaaaaactggtaatgttgtttcaaacatgatatatggtttttaacataaaccggttctttgaaaacaatgattggagggggggtgttgattgatgttttagtgctaatggttccttctgccacgtcttcataatttgattcatgtatgttatgatctcttccatatgatctttattagcaatctctgtggctttttgtgtgcagtactcatcacttccttgctgatcacttggtccttccatccttatcctctcttacctttaatttcttgtcaaaaatagcttagctttttgttaaatcgttcccaaatgtgtaaaaccatgtttcatttgtttgatgaaattgtgtttattaagatgcatacatgcatagaaaaattctgaacaagaattaccttaattacttgatcattggaatgtcctaacgtccaacataggatgaaaatgatatactacatgtggtttaaattacatggcatctggtagcaccaagaggaaatgcttgtatgtacttcatgcatcatttgccatatgtttatgccaacaattaatgtatttcacatttttagctttgaactgatattctatatacacctactttgaaagtgtgatgaacacatttttttatattttttattaataattctctacaatattggttggcataacttatttgagttgataacattttggagcagcctgggtgtgttttggtaaaagtaggactctagctctcagattctcatctcaaggagttaaataccctgatcagatttttaaaaatggtgtggtgtagtaaaggttttttttttttgggggggggggggggggagggctgctccgtgatacagaaaaaaaaatcaaagacttttctcatagctacttgtatataccagccaactatggaaaacagaaaaaaaaaagagtagcatggtcactttttagtttttatccactcctggtctcaaaatttttggaactaatatttaacaaaatgttttcctatagggacagtctaattcccacttcctgaaaaaaaaggtcaattttttgtacatccaggattgtcttgagatttgttcatgaacagttaatcttatcttctcctctcgttttcccatcccaagcacgaccgcactaatgggcgctcacgggcgccatcctcccctagcccgactgagccgccgccgccgccttgatctgaacagttggctgaaggccatcaatagtgccagcacgttccgaccaactaaccgcctcctgctgcccccctccctctctttcctcctcccaaatccggcggctgcaccattcccctgtgctggtgtcttcaccagctcgcaccgccatcaatcaccatctccataccctcccccc

SEQ ID NO: 40532 - DNA, 14640 bp, Oryza sativa
  unsure (1)..(14640): unsure at all n locations
ccctcctcaatcccagtgttaggttgaaggtgactgaaattcctagcaatttttttagggaattcctagcaattttaagtcacctaaaaactagtaattccctttcctatgtaaaaggatccgctatatatttaatcaaatgttttgctatataaggattgagtatatgcattcgtggatcttttgttgagccatatttggatctgtaaaagttagagccctaaatgcaccccttaaatacatttttcttttgaaaagaattggtacagaaaatatttctgcaattaataggcgtttacccttttaagaccctcggaaattggctacttacacagatataaaaatttgaacattttccgctgtgcttggtttgttgctgacttgtgcgtgtcatcactagctagtacagagcaaaataaacgttgaggcatgtgacaaccaaatttgacacaaggacaaagtcatagtaagtttggccagatttggaataaaccggagttttcacatggggaccggtcagaccaccactgtatggtcggttggaccaaatggtgaactgcggtcaaaccgccattgcggggctggttggaccgacagcctcgagtccgagtccaattaaggttattctcgtggttccttgcttggttccaaggtttcttatatcctaagtctaataggcatggagaaggtctatggaggcaagaaaaactcatttataaggacgatggcagattcaattctagaccaacccctatataattaaatcgttcttttacctttactttttagccatgttttctactttaccctttatcatctatctttatcaatttgcatcgtaaatcatccatcttcactgtgagaatgtgatatcctttgtaggtttgtcctgtaaaacttccgattcatccatgagacgggtggttatctccttattgatctaaatcggcctagagaatggttttgatccctcaattggctctgctaaccaatttaatatctgaaacccatattggtttagagtttctaatcaaggtggttggcgactccgttaacactaaatgtatgttcctattcttgaatgatgaaattttagccgatataatgtcaaagtaatattattatctaatgatatatcttgtcatgcactcacatagatgacaaccactcttttatatttttaatttttaaaaattttgagctggctccagttgaaaaactagtaaactactagtcaaattcaaaaaaaatagaaaaggtaaaccaatctgttaacaatgaaatttggtaagcccctaagagaataatcatgtcgccaatagtcagattccttctatattcggttaaggaaattaatctattaaaggaaactaatccagatgtgaccgagttcaaggagaatgcggcatggcagtttatctattaattaggtagtatttgttagtttccttttatctttaggaaagtgtgtttagtgtcccataagtactttatgttttccttttatcttttaggaaagtttttttcttgtcttacaagatctagtatctacccatggatataaatatgtacacccggggtcattgtaagagctttccacgatcaacacaattcggcacatcgccacctttttatcttttctactttttatcatccggcggaacttggcacctaacgcggggctgcatcggctttcgatctccggcgaaggggtaagccctacgttccgtcggcgcaggcaattgtattggctatattggcgtcgttcaatgctgcatcagtacattcgacctcttggatttctctggtttggttgatatatttacctacctatttatcatatatcttagttaatctagtttagaatcttaatttacttgtatcagctgagatttgttttagggtttatgctggtgtcggctaaattatcttgctagattagattagctaaggtatccaccaccatgaaaattagtcaaaggcttgattgtttagactttatgcttctttgcatacttagtgctatatcagttgagtttgatctattaagtcgtgcttagaatcataaagtctagcatgtctttggttataataagggtttcatcggggtttcagccgatgaggtatctggacgttacatcggcttataaggattgcacatataagttggattcagccgatgataacaaatgtttcactgtttatctaaatcgatttgatcttatgacatcggacctccagctgatgtatactttaaccatcggatcagtgcttgttttaccatctcattgttagccaattggtttctattggatttatattgttattatattatattatattatcatcagccgattgtctttatatcattatctacattagacatatagccgattgctcaaaaccctatcgctatcgactggtatcagcatcggctggaatcactccatcggcttgtcagccgatcggctatttgatctactgtttacatatcttgtcagttgcaggttcaaactaactagcacggccgcatctcattaacttttggacctgcactagagctaagcagatctcccaggccagtgtgtgtttttcgcatcaacacaatcaaattaaaaaagtaaactaattttttaataacatttatctgaattttatccatttccaaaagtttttcaatgtttttcttttcgaaaaccgctagtaatggctttgtgaaccctgttcatacttcatatgttttctagccgagccctaaagcttcactctagggttagtttagtcactagcatttggctcaaagtagttcttcgatccatggaaaaggccatgtgagtgtgccatgccatcctcgtatgtaagtgtaatgatcaaataaccattctattattatatatatagtattaaaaaagaaagaaaaaacaaaaataagaacctataactcatgatagaaacaattttgagctgtcccgttatttctgttttgtttttctttatttttctttaatatggtgtgtgtgtgtgtaagggtagaatggtcattttgttgctataattatatatgagtatgatatgtcacacccacgtggccttttctatgggtccaatgactacatttgtcggagcgaggatcttctttagtgggaaggcatgataccccttttagagtttgaccagggtgcacattccgagctcgtgcactgggcacgtatgggagtgagtacacatggtttatacaggttcaggccgctcgggaatgtaacaccctactcctgtgttcttactctatgagatagtgtcaatgttacagtggaggatgatgatatgttctaagtggaagaggatgaaccctattgtaacaaggagataatgaaccttcttcactgagtttgatatatgaatctaacttatagcctatttcagtctgtccaattccaactcccctctctgtggcatggatcctccttttatacatcaagggggtccaggtgcctatgtatgcatacaaaagtggggcccaacccaaaggggttggtatgctagcttggtcttgtagttgtccatccaagcaggctgaccagatgtgatgaactcacctaccggccaatatatggagcggggcaaccgacgtctttgtcccaaatgtcaatggacccgcccgtcagcctccgatgctagtgaaaggggggcccgtggggtagatgttgagcatgtgccgcgtcacacgacctcttttcgaggcaacatgggcaagcaagaggagaaatgcacagtctcgttacccccacaccacccgtgatatgtccataagatgcgtatcactacgcaattaatgcagaatgacatggtaaggtagcgcataagaccaggtcaaatctccttaatatggtagattctcttgaagagtcctcctggcatagtcatcggggccttgatccacctgtagtggttctcaggcccccaaggtaatagatgcttgtcccaggcaacggttgtcccctagtcgtcttcaacagctcaagacgacacttgttacttcacttcatcttctactttgtacacggtgggtcctatggtgccccgagcattcaatggatcatcgttcccatatctccaacaaagttgaaccaaataatagattttagacaaattttgctacagaacaccgcaattgtgtgtatttagctcagggacaccgcgaaagtgaacttttgggggaagacatcccataatcgtggatatttgctgatggacactgcgccgtctcctctccacttgacgtgctgacgtggcaaacgggaggctatttttttgacgcggtcggacgtaagtacccctgtgccttatctcctcacatgcactcggtagacagagcagcggcagagccgatggcactcggcgacgttgtcgccgacgccggcggcgatcggtggcggttctgacgatgcggctaaaagagaaagtggagagggcatccttgcgaatctataggtggtggttttgtgcaatatggtggccggaatagttgtcggcggcgacgcgagcggcagtgactctcggcatgccgagctccggctcgtttccatgtgagtgagtacatgcgtgcgtggctacaaggctcctggagattcactgaaggtcgtctgaggttcggcgatggatgggcggtgatggcgacctttgaaatgctccagcagcggcagagaacggcaggtcgacagcgtcggctccttctggccttcgggctgtcaaagggaggaaggaaacgattcaaagaccatatgaggatgctacatgtgtgaggaattgcgccaaagctcacccgggagcgaggaatcgaaggaaagagccggcggccggacttgaggaagaaaggttcgatctccttaacggcagtgcctcggatcgattcctccggcagacctccttctaggatgccggcgatgcttttggcgtagtggctcggtcaacgatggcttgagtcgacgggaatggcgaagcgacgcacggcggcgccctggacaccgagaacgccgacgagcgcatcttcatatgcttgatctgcggttaattaggatgcaaggacatggctagatcaggtagaggaagtagttcacgttcccatggataaaatgcgacgaagctcaccagaggtctctaagattggatcaaacaccttcgagcagagaaatgaggagggtgttcttggagataaggcgcaggggtatttacgtccgaccgtgtcaaaaaaaagcctctcgtctgccacgtcagcacgtcaagtggagaggagacggcgcggtgtccatcagcaaatatccacgtttatgggatctcttccccccaaaagttcactttcacggtgtccctgagctaaatacacacaattgcgatgtcctatagcaaaatttgcctagattttaagtacttgtttggaaaaactgaattatcaaggaccaaattgatcccgcagaaaaaaaaattatttaccttgttggctatttaccattccatttacatggacaccattgaccggtaccactcaatttttatcaccaataattttcaagtcaacaaatttgaataaacgaaaatcaaatggttatatttaacatacaccaaacttcgctaaaatagtagtagtcatagttcggaaataatagtgcagggtgttgagtagcagtatttaggaacagaggaagcaactgtctatttttttttagagaaggctttttttaacccagcctctatatccaaccagatatatatagccatatattgggaagcaactgtctatactttacagtgaaaacataagcaatttttttcactattattattttattttcctattatctgtgcagcatgagtgattttaaaaggagaaaaatctgagctttcttgcccctggatttttcaactttttgaaaacttattttacaaatatacccctagaaaaatttattccaacgatggatccttttcacagcgccttgttccaatatgtaacggcccgtcctctagaaccatgcagtccaacccatccgacaagcaagcccatatacacatatcatcccacttacactttcatcatcgcttcgggtaaaaggttgaacccggaacaagaagtgatatggctggaggtataaccccttataagttagttccaccattgctaaactagcattgtgatattaaacatgcgtacacaactttcatgggtcacacatgccaaatcataattggccagaatttcacacaacatgacgtcgccaatgatattggcgttgtctccctcgcactcccgtggaagctaagtcactgatgtgaaagggatcaacgttatgtacctatttataaaaagagtaaattgcatccacggtgcatcaatttggtaggtaggtgcaatttggtacaacaatttgagaaataaacgttctagtgcaacaacttggtaggtaggtgtaatttagtataagaactttataaatgattgtataaatgcaaataggtacgattttgatacagtaaactaagaagttatacgacaacttaattatttgaagcaatttttttatatagattcatttttaagtaattattttgacaatatactagcgtggatttgtataagcatatttatatttttatcgtaataatccatagctgaaagtcaattaaactggatgtaaaaattattatatttcggttaatatttgagaagataaagaaaacaaaaaaatcttaaagataattggatgtaaactatatgtgcaatataattcttaaagattaaattcaatatttaaggtaatattcgtaggattactatgtaatggcatattgacatcgtgaaaaaattcatctagcatatgcttagccaaattgatgcaccaaaatatcgaattatcaagttcttataccagaacgcacccacttgtcaagctattgtactcgaacgttcaattcttaagttcttgcactatatcacacccacctaccaagttgttgtactatgggtacaatttactcttataaaaatttcaaaaaagatatatttgtaataaaaaaatatgtataaatatgtcctcgatgctaataacgatgtcattaaaaacctattgtatatattttttttaatttcaaatagatcattggtgtcaatgtcatttgtaaaataagtttttaaaaatgaccaaaaggtaaaaaagattcaattctcgacaaactaagaagtattaggctgtgtttgatagtagagactcattagcgtatgattaattaagtaaaatacttaaaaatatatattaatatgattttttgaaaataacctttttataaaaaaaatttaaaaaaaattacaccaatttgaaaaatatgtgcgcgtggaaaatgagagtaagttggaaggatgggaaatgaacagagcctttagtatatgggtcgatcggatcggatccgacggctctgattgcatccagtcccagcaccgcccggactcaggaggagagtgacctacctacctatacatctcctaccaacttggaagagagaaatcgtgtcaaaaaaaacaaccaaaaaacagccaaaaaagaaaaaaaaaactcggagagcggaatagaggccaattccaaatccgccatcgcatccttctctccatccaccgaggcggcgccaccacctctcgtccggcggcggcgcggcgcgacgctccatccccggcgaaaaggccgccggattccctgtgggggcggcggagaggcgtcggaggaggctggcgccggcgcggcgacaaggttagctgataaacttttttttttttggggggggggggggggggggagtggccttnnngtggggaaggnggnnaggtgttgttggcgcgcatacccgcatcaccgacctagaagttagccatctttcgtgcaattcctctcgttggggaagaataggcaaccgggtcgtttctttgacagcaaatcagacgttcttgttcttggtcaaaagaataatctaatcgatgcccctgtttatcagactaatcatttcaggtgattcaggtgaggattatttggtcctttggttggttactagatgcgtagtaaacgccaagagaaatcctcacagatgtcaaacaatttcatcttatgtctttctgaaattacctttttcagctagtacatgtaaactggagttgtatatatatgtatactcgttggcgttgattgctttctccatccattatgattttgcagcttaattaagcaaattggattcggatcacaaaggaggcggtgcctgtagaaaagccatggcttcttcggtgttcaaggcgatggcagagaaggcagggccgtctgtccgaaagcaggcccttacgctgaccgatgcagcggcgtcgagggtgcgccagctgcttggcgtacggcagcgtgcttatctccgtcttggcgtcaaggcccgtggttgcaatgggttgtcgtacacaatgaattatgctggtattcggtttccccgacgttttagatcttgtttatcatcttgatatgcgaataagctctgggtctcttgttctactgttgcgaggaaaaatttagattccattgtcactcttcctgaaattcctatttgggtgctccctgataatgtccattgcaaattccttttagagccttgtgacaagataggtcaaaaccataaaagaggtattagcttgagtatgcgaataagctatttgtctcttgttaaactgtggtcaagacagatgtaaattccattgttaccctttcttaaattccttggatgcttcctgatatttgagcttgatgcaaaattgtcatatctgatcatattcctttcaaattccttttaatgccatgcccagcatcacagttgtcttgcaagcagtagcaagagagagtgttctttggtgtatgtctggagccagggctctcaatgagttattgtgtgatcgcttcctttggatggttagctgctcctaggaggtctttttgttgcacatcgctttttgtgatgctttttttttcctctagagggttccttctttatggatcacctctgttgtacatatttctgcttcttgatgaaatgaagcgcaagcctcttgcgttttcgagtaaaaaaaatgtgttaaaaccgtcaaatttgtttgtcactatccacaaaagagttattagcttgagttcataataccagtggacatttgttgtgtctacaaaggtcatgcttccctaataatatcaggtggaacttaagcgtctagaaaatgaaattagttctcaactggattgagcgatttggctttgtttgttcacatccttgtcttttcagctctctagcattagcacatataagttagccttttaggatgttggttgattccatatatgaactttatattccaaaaggtacctttgagccaaattaacaatggtttacctgcacatgttttagggtgtctctcttttgtgactgggcactgaaggaatatgtatgcatgtttatttggaatgacacctattcttcttcacagcttctgagattataccatcttgctaaaatgtgtagttatttcaatcccatagtcacttgtttgtgccataattaacagatgggcttatttctgtgcttaattgtttggctacaaacgatccagttaatctgactaatttatgaaacttatactagtattgtaatttatgctcattatttctcagatgagaagggaaaattcgatgaacttgtggaagataaaggagttaagatactaattgatccgaaagctcttatgcacgtgattggaaccaaaatggatttcattgatgatccacttaggtatggttattttaacgtcttttttctttttcttcttttgcaaattgccattagtgattctttgtcttgtaggtctgagtttgtgtttatgaaccctaattccaagggagaatgtggttgcggcgaatcatttatgacatcaaccaaaaacaaaggcccggcatagtccaccaagttttggcagcgatttgttgattatttgatgtatagaagtatgttgctaatttgctatacacttcagtgacccattgtagaggaaaatttcatttcagctccattgagctgattatccttcgtcactcagcatggttggcacttgttacctttcacctctggattggatcatctgcagcaaaggaggatactgccattcccctctagcacgaaacatccaattgcaagatgcctcctgattgcatactctggtgagaacaatggaggtcagcgttccagcaactcgcctgagggatcatataacaggattttcggcattccatccactcgctaagggatcatataacagaggtcttgtttacatcttgtaagatggcatccaaggatagatgtggcattgttttttttcctcttttgcaccatgatctgataatcaccttgctgcatgttcatactgagattttgatctctcatgtaacgggattttatgccatttatgcttttcctggttggaagttgatgttaaatttaaccatgattattaacctacgagctgtcctgagtaatcatcatatcataggattaggttgtgaatcatattgttccatgttgatgagataaaaatcactaaagatagatgggtagatcaatgtcctaaacatgacacttaagctgtcgtcataagctaccatagtttgtattagtaatggtttagtagtagtttaatggacaaatgcaaagttggctgatgcctcctggatgacctaagacaacctgtttccaacgatagggtttctcctcgtagatcctcgggtctacatgtcagtgagggtctattttcacatgtagagagcagtactgcatctcaattggtttcgaacatgaacccagttatccagccatcatcatccaacagaagcatgtaatctgatagaacatataaaacgaggaaaatagaacccatttcattaactgcaccccatgcacatagttcgatagaacatttgaacgccattccattcgagaatccaggttcaatgttgggaagaaaccgccacctgaacaagctaaaatatttcaaagttatgaaccaatgccaacttctcgagctagttaaggggcagacagcctgcaaaagcatattcaattcatctagtggacaaagttgaaccctagctaatctacggaacgtcgctgaaaattcgcctaaaaacaaaaaaagaaagaaagaactcaacgcaaatggaactagaggctttctccagtgtatttactccaatacttgttgaaacacagattttatcatcatgagtttcttcccaaactgtcccccagtacaaatcgagggcaaaacacccgttgcagtcagttgcgaggttgtatacagctgggtaaaaacatgagcatccttatgcctgtcactccacagcatatgcccactttgatgtcacatggcagcgatctcaggcagaaaatgcatatgttcgagtaacatatgctgatcttaatatgttaagttccaagccaagtgctcactttgcagcacatcgctcaaaatcacaaatgatctctcaatgtcatcaaaactaaccttcaggccgaggccttttatagtctctttcacctcgctcatgagcagtatcatgactgtcatggtgctttgagccatgggaattgcgctgttctttaatgtcgtccattggggcatctttgagcagtctctggtgtattctgcttgccaaggtgcccattgcctgtaacttgatcagcatttctatgatccccccgatgcataacatgaggggaactctgcttcctctcctgctttatcttattatcctcaacagccaattcaatgtcatgttctagttgcctctcaagatcatcatcatcatctattacctctaccttcctagcaacatcacctttcagtttcctttgcttttccatttgtgctttcaccttatccttgtcaattttatttaccatcaaggatgtcacattcgtaccatcattgccattgcggttgacatctctgatttcactggagttgccatgtgatggaagattcttattttctgtcatggactgtttgtcatgatgtaaaccatcgttggcaccaaaatcaactctacttccactctgattgcttcttgttttgttgctcccatggtcaccattgtcattttgaagcattttctggtccacagtttgcttttctagatttgagtgctcgacaccatgatgacttggagcacctgttgaatgctgtgaacttgactgtttcgactggtgaggaagaggtgtttcctcggattttacagagactcgctgattaggaacactagcagagctcccttcagcttcatttccatgggacggttgtgcctgtgctgcacagttttgctcatacagctccaacatttgattgctaacttctgcaatcaagggagacatgcattattatctgatttaacaagaacccagaaaggaatgtgtcatgatcaaattgtattatcaaaaagttaaataagtataactagtgcaacaagaataaaaagacttaaaatatacagcacctagtcaatgtaaatttggattgctcatagcaacttagcaagcacaaatcaggttgcgcaagatgacacgaccaaaagaaaccggtttctggaccctatcaaattttcgaaaactggccacaattaggcttttccagaatttctgtgtatcctggtcagctttcattgtaatgtttatacttaatatatagtttggcaggtccccactaagaaaaataagtgcattcagccagttcagttaaccattgcacatcagcaggccaaggtatgaagataaacccttgtgaactctaaaattgacccctaatgcagtgcttatgccaactgaccccaaaaattctagccatcagatcgaacacaattagcacataaaccctcagatcctaaccaaccagatgctttgattagacagattgcaattgaaagcgtgtgcttatgaaaccacgtgaactatttatgaaatcacacatacccatggagagatttttaatagctccctttagaaggtagaacatacaaatagtaataacaaagatctgagaatctgtatgctagtaattcattagaaagactactacataagctccacattatgacccaaatttcaatcaatacagcagaaaataagaaaacaagaacatgctaatgaaaggcacaattactattccaccaacacccactacgaattaatccactacgtaaatcaagcctttcgcaagcaaccaattatctgttcaaagcagggcatagcagatcagtaaagaggcgaggatctgagcatggcatcacacagagagcaatgccaagatggtcgtgccagaggtcaggatggaaaccagcacctcagtgctgcaggccacagtgtagacctcagacagcatcagcctcagcaggccacatgctttgctccaggtacatcattcccagaatcagtgaggggatgaagaggggagaagaaagaagggcaaaaatgatgaaatggtataggtaagaagttttagcccaagttgtggtattactacttggtacccagaaaaaattaatattttttggtacctggccaaattcttgtgaacttttttgtccttgcctttctttgaaaaaccttgtgtatgacggtatgtcagtcttaacccatccccccagaatgttgcagaaagttaatgtagaaaacaacggggtgtaaaccttttagaaaaaggacagctgacgatgtgaaatttaaaatcgaaaatctgcacaagttgaatacaaatatgtacttttctgaaacagaggattatcaaaaaggaagccgcgtagtgtgaaaagtatttctacaaaccatgaccaaacatagcatctgatgattgcaagatgatgctgaatactttagacttatattccctgctcttctgatgattaatttctatttcctagtactactatggaggcatggactaataaaatagaccattctaaatccataacaaacctaaggaacaatgtgttcttttctagatgtatattaatttttgtgcaaaatccaggaatgaaatctgttgatgaatagagtaataaactaatgcatcagaacagattctccattgcttcaactagtatacaaaatttaaataagctgcagcgcaacattaactgcttcagcagccagcagtaaggtaccaaagcaacctagtcaacatgctcgttaaaaaaaatatgcggtttaaaactcaggagattgttgtaaaccgtcatatggaccagatagaagttagaacacaacattatctaggcaccaaccttccagctgtcttggagtcacatcaaactcctgccaccaaaccttctcaccatcagatggaagcttcactttgagaaatttagcagccaaaaagatagcacctgctgcaatatgatgaggcttgaactgcaggcaaagcgaagtacgcagcctgtacaatatacgccctttttaacgtgttatatacatgattgagtgatatctctaaagataataagggtatcaatagcatacccatcattgacaaaa

SEQ ID NO: 40533 - DNA, 4051 bp, Oryza sativa
  unsure (1)..(4051): unsure at all n locations
aagattgaggtgttccgtttgagaatcccgtggtagctttataaatgctttaccgccttagcggtatcatatccttgcttggtttccattcacattggttctctcgttcattttatagcaaaaccttgggaaatgtaaaaattttccaatgttacagtagggacaactttttcacaccactcaccaatgctcccctaactcctaactacatagaagattgataatggggcaaccactggtcaactttaatctggatcattaatccgtaacctccaccaacaactatcaaatatatgtggtacttttatctcataacaaacagtgcagtcaaaagcacaaaaggcgctcgcctagatgcaaaagcaagcgaagcgcagggtcgcaactaaagcacctagagtagcttaaagcacaatgccgttggtgagccaactttaggcttaagaacaaggcgctcagacgcctgctgccttctttttttctgccagcttgattcaggactcatattttgggcatcttttgttgaaggattaggttattaacttcttagcagaactttattaatgtggcacgctatgtatattatagcagccaaaaactacttgaattgcagtttgctagtctcggaccttatccgttatatatttcttaactattagtttgtttttggtcagctgccagaatcaggcatggagcttcctacttaggggtagacatttatgtttttatattgtgctccatgtgtctaaggcacacactttttaatgctttgtacctgaggcaatataatactattgcgtcttagtgtacttttcgctttaactgcactaataacaacaacttcagtccctataaattaagtaatgaagtccccatagctcttgtgatcgtaaaatgcaaatgtcaaagtatgtacttccccgcgacacaacttctatatctataaaatattgcagttttcatcgctcctacattactatccatacagaaggaaaccattttcttgttaaacatgttttagaactagataaaaaatgcaaatatgtcgttgtaatataaaggctactaactaaaagagaaatagccatccataaaaccacaaaaggaggaacgaaccaagcattgaagtacttactcgtctatcattttttgcatgggactgacgaaggtaaaaacggtgacagaacacaatagctgtagcaatagtgacttgtggcctaccacagaacaaaaggcagtcattgattggaagtagacagaatgatattatactccataaataagaaaaactaaacaatatgtagtattcacatgaccagaacaatttgcatggcaatcaagggctaaaatcaatgatataaagcacacattctgcttccatattttgataatatacacattcaacaagtcgaaaccaaacaattaccaggtcctcataaatttgaaagagataaaaaaacatcttctgcttctatgttgattatatacacataaatggatctcacatggatgtccaaacaaaggggtaaatagattgatcaagcttattagaacaaatcagaccaaaaataagctaacggcttacaaattacaaccacaatagatatacttcagttaagtttagcatcctttgaaaataataaagtagaaatgcatgcatcatggtaattgaagatcataataatgattgaaaggaacaagttaacatcaacaatgaaaaatataagttaaatcaactatgatcttacactttaagcctcatgcccaaatcttgtagaaaagtacaatatgattttcggaggtaagactctttcttcaaatcaatgccatccctcctggatggagaattctcttctatttcctttctactgaaataccatgaagcaccaagttcaccagtctcctcattcctgccctgggtagttctgtatgggctattttctacaattccatgatgtgatgaatcacttggcatcatagccatgtaaactcgctctcaactatattgagaaaggactgatgaagatattacttctttatctattgaaagtggcctgagcagcactgaacgaaaaagatacagtaagtgtttataaatttactaaggacaaaggacaggataataagatacagtacaagtaatgattaattctaaagtactaacatatggctttatgctcattccaatctgtaagttcgaaatagaaagagcaataggatgataatcatgctttacaagtcactagacccattaataccccactaccagagaaaatggcaaaaagccaagaatacgtctagtagtacacgttgtcgaactatgaatgcagggaactaatacagattatggtttataacattatcgggattatgctgtctaaagtttctaaagcatagaactagacaagtaaaatttaatcagcaaccctcgttacttccctaagatgcaaacctcattcaaaagcataaatcactttagatcaattccaatgtctatgtacgtattggtcctgatacaccaatcaagggtggtcgcctggttaaacagaaagatttaaatcgattattgatttatattatgtttgcaggctaacgaagccctatccccagtgatactcatcacccacaaaatgcatcatacatctcctaaaattgcccatccagtcaggctctttacacgaaacctaattacagtcttacacatacacaaagtggggattcaagatcttgcaaaaacatgacccccaataaacctattcgagcatggcaaacaatcatcgattcattctgacccgcagcctggctagctgcgaaccccccatagcctggctgacgtcgtccacccgtctagctgacgttctttcctattcacgcagatccgcgattcgaccctactcttctcctaaaaaggcgatcttgagcccaatacatcccgcaagatcacaccttgaatcccccatacccccgcacgaagaccatatatcgagccgaaatggcaccaatcgcgacacctagggtttcggaattcattgaaccgcacagctatcgaaaaatggcaagaacgccgcactagggtttcgattcccctccccgctccgcgaatgagacccgccatcacgagacgcgagaatcgaaacagagaggcatcgacgcgtacctcgtctccccccgcgctagggtttcgcctcctcctcctcctcctccgcctgagcccgcccgcggcggggcggatggcgccgaggcgccgggggcgcaangnggctctgccccccccccccccaccaccaccaccgagctttgcttgcccctctcgcgcggcgtgcgtgcggccgccgccttctcctcctcgtcgtcggcgagggctgagagggcggaagggggaagagaggaggaggggcggcggcggcggttcgggtgcttctcgcggataaaagcccccgcgttgcaaaaaccctagtctttcatgtgatttttttttggttcccctttggtttcagagtttgtttttctttgttttttttttcctataggttggggttttgattgagaatgataatttattttatgtgttttatatgaccgtagtgatattatatcgattgatggtttggtgttggtgttccgtataaattattattatgcgattggaagttttgtttatctgtttatgggccatggcccatcagcagtgacgcggtgcatgttctatttggcgttacgcttttcttactttcctgataaacttcttctgttttttctacatggcatgtttcggtacatgttctatttggtgttacgcttactttcttgataaacttcttctgtttttctacatggcatgtttctaaagagagtgaactttttttctctagcgctgcatcaacaaagaatggaagacgtcactaccatatggcttcagctctagccactctcttgtgtaatatactttattaagtgttttggtgagcaaatattttgttgcatcaaagattattattcatttaacagaagctttatttcaattgtaacacgttttttccttgttacacaa

SEQ ID NO: 40534 - DNA, 1592 bp, Oryza sativa
acctcatgggcttctttccatcatatcattattcctatttttaccataaagctttgcgctacctttggaatctttcatgcatgataactgcccctcctagacaaacagtcacatagatggaagtgaatgtgcaaaatccattcatcatatcgttattcctattcttaccataaagagggccacatttgtaatctttcatacgtgctaactgcccctcctagacaaatactagtcacatggatggaagtgaatgtgcaaaatccattggaagcaacattggtaagttatggggtttgtaggcaagtgaatccacctaattgggttcatgtcctcaatttggataggacaaagtataaattttgtgagacgtcctctagttgttaggcaagtgtcacagagacacatcacacactgggatgtattttgatgtgtactatatctctcttcccaagaaaataatttgtaggttgcccaaacaaaacatcaatcggaatagattttattcggtttccatttcaatgtacgactaacccaattcaattttgattcccattttcatttctagatggacttgaataacccagttcagtttatcctatgtaatcgtataaacaaaacggaagcttgtagagacaaagggctctaatacaatcactatttgtagtaacaggttatgttctagatgtttaacaatgttttttggggtatttttttgacaaagcagagttttatgtttaatttatagtattaactgtttcttctgctgtaatttgtcatttaaagcttaataacattgcatcccttgaaaagaaatatatcataactaaaatcaacgtcatgtttgtatattggcttctggactaaaaccatgtgcacctaaggctattttttcaatgaaaaattattcaccgtattattaaaatggcttaattgttctatactttggaaaataaattttcttctactatattatttagaacagttgtttcaagctatttgctaagtttatttcttaaaatatttaatttattcttaatagtctagtgaaaattaataatctatttcacacgaacctccggtaggaaatcaagagggaaagcccgtttctaccacttgaccaaagaattacatttcatttcttttccacttattttgtacagctagcaattctaaccagcaagcaccttctctagcaccaaaacagctatcccaaattcaacaaccataggagtatatgtagcagcttctagcaccaaacttacctgaactcatgatcacatcttctcatcattagctcatcactactcagtactcactcctctagaatcatgtcatgtggttgatgccaaccctgatcaatatcgactgactcttgtcatctctgttcctctactttgtcacctctgtagctataagctgccgtattgggaggctctacagcaagcaagcaagacattgatggacattggacaagatgccatggcaatgcagcagccatggccggcatttttggatccacgaggatatgttgggcaccctacgagatacacaagcgagcagcacaagggtaagcaaacgacggttcgtgcagt

SEQ ID NO: 40535 - DNA, 5121 bp, Oryza sativa
cctgcaccccatcacattaaaaaacttttatacacacataaacttttaatttttttccaaactcccaactttcttcaaacttccagattttttcaggaactaaacacaatcaatgtgtatcaacgcaccctgtggtatctcgtactccccctattttaaaatataataacttctatctcttaaaatttatctcaaaatataataacttctccaccaatattattttctcaaccaatcacaacctctttccatttaattttacatattctcttaatagtcatatccaactctaaaaccttttatatgtgatttaatagtatgttcttgtgaagaattcagactgcaacccgacgcagttgggcacgctactgcctgaatgcagtgtccactgtccaatggaggtttttgcatgtacggcatgtaaaatctatgaattaggagtactctgctcaatgaatttatgatttttgtgttaggcgtccggtatgtctataggaaatacatgccactcagtgacataacccgaaatagttttgaattcaggcaaattttaatataattagtatttgctaaaaaaaatttcatcatcaatttactaatcaatattaaatcttaatggagttttcatcgatgagctcagacagctgctcgggctagctagccgggcagtggctccacgtacgtacccccgatgctacttgacttaaagctgagtacttttgagcagctcctcatgataacttttttttttccgttaacactttttaattgcttaatgatatgtttctatataaaagtttaataaaaatatcaaataataaatcctttttaagtttaaaatagttaataattaattaatcactcgttaataatttatgcatgaaacatactagcccaaaccaaattgttgaatggaatagtactaccctaacacttaacacgaggacacatgcagagaataaacctcaaagattgaaagtttgaaactatccttgagatacatatatgactaggggtggacaggaagctcgtggctcgttagctcgctcggctcgtgacacgctcgactcggcttggctcgtttaaattttgtaacgagccgagccaacattttagctcgttagtcatagcgagccagctcgagctggctcgcgagccaaaacgagctgaagcccaccagtggacagcccatcaaacgaggcttagtagcagcccaatcatccacgaggcccaccacagcccttgatatgccaaaccctaggctaaaacaagcacacaagcaggttaagcaacgccgccgccgccacgcttcccacgcgcagacctgcgcgctagcgatgcgtcgtcgtccttcccatccgcgcggctctcgtccagcgcccgacgccaccgcaaacgccgccgcccgcgccgctcttccacggcgcccgacgcggccatggacgccgccgcccgcgctgttcttcctcggcgcccgatgcggcagtggacgccgccacccacgcccgacgcggccgtggaccttccccggcgcccgacgccgcagtggacgccgccgctcgcgtcgctcttccacgacacctctccaccctttgttcgctctctcttgtccagttgtccccaaagctcacgagctagctcgagcttacaaacgagccgagccgagcttgatttctagctcgttaggaagccagaccgagtcgagccgagccagctcgacatccacccctatgtatgacgtatttcatccgtcctaaaaagagccactcctatattccatatgcaagtttagtagtagcgtgaaaatactaaagtgcccccaataactacttccgttccgatactgttgtttctctaaacccaataattacacagcatatacgaagaacacaagcgacatcttgcgaaaaaaaaatccaaaaattcaaaattttcacttgccgaaagaaatataacatctccaatctgaaaaaagaaatgctttggacggtcaaatgcaagaattagcaagaactaactaccaagaacagagattaatcgtttgccttcaccaccgtacgctcgtgcatcctcttgcattagatcctctgcctccgccactgattgcgtcgcatccacccgtagcctccacctccatctgcaaaataacgagatgcacctgcctcaaccaccaccgccgccatattcgagccgaatccgtccgacagtgccatcatctgtattggatccgcctcctcaaaagcctctgcctctgcggccacatccaagctgccgcatcagggtgcaggtgtcgcatatgagctatttgcgaggatggtgggagggaaggaacatgggtagagcggttcatcgccaatgggaggggtaagagatgggtggaaggaggagagcgacggacgagacaagacgagaggaaagaggatgagtcaattctgtttttggttttttttttttaatcacgcttgggtgaggagagagacaaaggataagactgcccgctatcgctgtttctcgatgtatggagtagaaatcgttttttttttttggacaaagcctccaccccagtgctcagaaatcgtttttttaagatggaaggagtgcaagttttatgtataagaaactacgagactgggtttctttcaaagttggaaatttggattgaaattggtacgatgtgactgaaaagttgtatgtgtatcacaggttgatgtgatagaaaaagttggaagtttggatccaaacacagccaagattgaaaagttaatttgaaccagtggaacacaagaaaactcacaagagcaacaagtgcagtacactggtcctactagagcaagtgaagtacccggtaatcggtgccccggccggccggacaccatggcgcaaagctctgactgcctcagccttttcacctggcgatcgactggcgacgcaacacgacggccggcgagaaaccgatgcctcgtccggtcccatccatccatccatccatccatctcgctcgacagacacggggacgcgacgcgatggttcgacgacgacggatggcgcggggaagaaaggcatatatggcgtcgcagccagcagagagcacccacgcggggaaacaatcgcctgcaaaaatgcaaagcaaacctttgcctgctgcgctgcctgcgcgtgcgtgtgtggatcatcgatgctcgacggctcggtgccgtttctgcatgcgtctttggcagatgcgtagattcggcgacaggggtaccacaggacatacttcctcagtcaaaaaaaaaaaaaaaaaaaaagccaaccctgatatccgtgtccaatatttaaccgtccatcttatttaaaaaaattatgaaaaaaattaaaaagataagtcagcataaagtattcatcatgttttatcatctaacaacaataaaaatactaattataaaaaattttcatataaaacgaacagtcaaatgttagcatgtaaacccgcggtttgtcttttttagggagtatacgcttcagggggtgcagaatttttggcgcagaaaattcctgttcgagcttgtgaatatcttggccgtttaacgcgagtttcagtgccgctgctgggtcagagatgagttatgccttaggacaaccacaacatgcttaaaaaaaagtaaaaaaggaataaatatattgatgaagtgcaccttacacattgtgtaagccagcaatagaaaaaagtttcttgtggtgcacctcaaggttacaatcggccatagtgaataaataactatttttttctcctctacttactctctctctccccactatcccaaaaaagttagcagccatctcatatttttattttatagtggacctacgttaaagactatatatgttgtgcatcatactataacaaatagctaactatttatggatcataccttaagatgtgtatgcacattatacactgaccttgccattatggtacaagcttttatttactgtaacggatcaatttcgtatgcccttatggtacaagcttttatttactataacggatcaatttcgtatgattagagattgactgagttggtaaattaaggacaaagcacgggctgagtccatatatttgggattagttgggtgtgtgggttgggaataaagcacgtgtcagtctcatataattagagattgactggatgggtgcattgagtataaagtatagggtagatccatataattagggattggttgaatgggtggaatgaggagaaagtagttaggtggtgtttggttggaggggctaaagtggggctaaacttcagttcatctcataaaaacataagtctatgagagaaactaaatttagtttctaacttctaaacacccccttaatcttatggtggttacacacgtacgaaggagcgcacgacctcttgcgcatgatgagaaggacaggatgaatagatgagctgtggagcactgccaacatgctcgaaagtacagttattagtagtagtataaaggactacctatttaattacttctagctaattcaatgagctcaattttcttatcatcttgcatgccagcctatatgttttaaaaagaaatagaagtctcctttaattgcaaactaagaaagaagcccgcgcagatgtgcgggtattttgtttaatgtttatgtcaaaagcgtttcctagattcaaacataaatcactatgtcccggttatatataaatttgtctaatatcgccactacttattattattattattattttattttattatggatacttattatcgttcttttgaaacctgagtgattatttaatagatgaaactgtatttgtaatatcaaaataagaacaatacatcattaatcgactaaaaaaattatctccactactaacctaactgttcatgtcgatctgacttatttccaaatctatgtataaatattccaataatattttatcaaaaaaatatattataacaatatcgcttgtatgagttaataggataatactgttaaaatttgatatgaatgcccatctaacggatgaagccgaacatactaccaaggctttcttcctcgataccttaaaacatgggtcacatatcgacatagtcgtgcccatcaagacc

SEQ ID NO: 40536 - DNA, 9586 bp, Oryza sativa
  unsure (1)..(9586): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgggaactaaatgacaataagaaaggtttgaaggagcacaaaatatcatatttacccgataatagaagtaatcgtacagacgtaaaagatggtacttgtcagcagggtcatgcttgttgacatacttcaggagcttgatttcatcaaggctctggtcaaaaaaatctttgttgttttttatgattttaacacacacatccattcctgtgtgtaaatcatgtgcttgtatagctttactgaatgctgctgaacccagatattctgtgacatggtaacgtccagcaatgacagagttgagaacaacatggaaatttttgtcttcttcaaaaccagttctgttatattgtcagcaggatataatggagttaaaaaatatcgttagagataaacaaattaacaaacgcaaacaccaagcatgataccaagtatcattttaatacaaatgaactaataaagaaatgccaagtaattaaggaccagaaaaagagcacctgttttttctatgcacaatctttagattaaaagtttcaaattcttcttcctgggcctttatctgccttacttgctcttgcaatgctgctgcttcctcatcatccaatgtggttccagtgtcctcttcttgagcgtcgtctagcttgtgatgccgagaattcattgtgtcatctatttcatcataagtattattcaaagcagatgatgcacttgaatttcttgacctaacaacatcagaagccatttcatctcgagagctccttagggaagactcactattctttttcctccatgtggcaagcatatcatctgataccatgccgttttgcaagtcatcaggatcattgatggtatacatatcaaccttctttgaccataacggtttaacatcagattcaacattttttccactatgcaatggtggaggaaaggagaatccaccgtcagcatatgatgcacctggtggtaaaacgcccttctgattatcaataaaattcaattgttcctgttttgcccctttcgcatttattcttttcttttctgtttcctgctgagaatttctttttccactaacactcagattactttcattaaagtattcaatatctccttcgctgcttcctccaatcagactttcacgcacctcactgccaatatcagcagcatcactgctaatgccaacaccaattgacctaactgaaccatgctgatcatcctccacaaatgggtcatcaggatgaggacgttcagaatcattaaggaattttccatttcctaacatgcctaattcactattctgtgaaacgaaaccctgccagactggttctgaatgcatcaaatttagttcttctgggtccaaaagctggccatcatactgagcaatcaaatcattatcaggaattccatgccccattggcccctccgaagtacctatttgtgcaatgttcttcccgtgaaaatattgttcgccagatatgtaagaatcctcctcaacaaatgattggtcatcatcatcatcctttgtgggacgatcatgccgatcaggcccacttgtgtgaccagttgccttctcattgtcactaggatagtcaatttcatgtgctaaaaaccaggtttcatcctcaattggttgccgggtgtacccaacatcgtcatcatcatcgtattcatcagaatcccagtattcatttggatattcaagtgaatcatcaccaattgttgcaaagcccgataccaagtcagaagtatcctctgcaataccttgactgacagagaaccagttattactaattgtgcgtcttccacctgaatttgtaaacatatagttcaaggtcaaaaacttatgtagcatcaaacatcagagaggctaagaatcatggaaaacaatctgatataatttcactatttaaaagtttgcatgtctgtattataaaaagacaaaattatcaactgagagttagaaaaaatcccataaaacattaaaaagcacatcaattagaaaaggcataagccaacgtcaaatattcctttaggaaagcaaggtcaaaaacacaaacaaaacactgtgacattatgctaaatgtttcacagtacacaaggaagaacacatcctggaatctactcagtgtccgtgaaacttcagtaatgaaaaatcccatattttgctcacatgaaaatggcctcgcaatgcctacttcagtgcccgatagaagtcatctaattatgtatcattcaaatgaaaagtaatacatgcgcttctgcaactacagctacttgagtagaaataacaaactcatgataccaatgcacccatgattttgaaaggtgagaaaatatgctcgctttttttcttgatgcaaaacctgcaacagaaggaatccataatgcggactgctcgactgttgtcgctatcacctaatacatatgatgcagattacatgtagatttagcccatttcaagttttgtcctacagaacatatgtcaaaattctggtctagaaaacaaccaggtgaccaggtctaggagagttaccaacatgaaatacagcttatagaaaatcgaattactaaaatacaatggtgttagaacaattatttacctaggcaacagaacatacaacatttacaagtatattgaaattccaaagagatactcaagtcatgagacatttccaattcgtagattttttttggaatttacgcagagaaaaagaacaattcaactaggtctaaagccattgtattgttccattttacacaacagaaggagaaaaaaaaatcatattcaacacactatagctgtatagcaggagtcagtaccgctactgttttttcttgcttcattcatgcatccatagttcaattcactaataatatgtcagtttcatggggcgggtgcacaagtatgcggtaggttttacagataatttgatgtaagatgagcatgtaaattcaaagcagactactgtggagcaatgtaccatgttgcttaaggggaaggtagaatatatttcatccaccttgtgttctaagtaaaatattgtgtttccatgtgaccactaaaaatgttatcatacctgatggtgttatttcttgtccgatgggaacatcaagataagacccaatcataaaagcatggtcagcactggggtgcttggctcctgacccgttatggttgaccttttcctcccaattcatattaactagcttgtcctcagacttgagcctcacaggaggtaactttggaagctcctcacgttgattgtctccaataagctgcagatcgaagcaacggtcagcaacctgatctgcgttctcctgggacttccctgagtaatactgcctgttcccctcatcaagctgccccttagttgcttttccaacacagtccgcatcaatgcttttcttagcgtctttcctctcatttccatcatggtgtgctgtatggtaactggatgatggattttctgcagggaatggaagcactgtcttaactgtacatccattcaagagctcctctttttctggaacaagatttttatccctggaatggcctggttcatttatttcatttctccctgtccctgcaacatccactttcccctttcctcttccaaaagaaaccttttgctcaagcacaggaccaggttgctcggtcccaacaccacgatctctcttctcagctacaacggcgccgcgccgatgtcttggcacctcctccgacaccaatagctctgccagttgctccatagtgctgtttgcaatgctaaaattccaaggatacagatcccctgtattgttctcctgagccaggccaatccccaaccctttcctcccatcagacccattcggcaggcctccaacatcaatctccttcacgataaactccctcgacgagtccgcgctcctcaccgatgcagcacctctaggccctgcattggaacctgcctcggagccatcttgctcatcgtcctccttgggctccgctacacgcctctgcaccgtcggcccgttgctcgcatcccctcggccatttagctcccctcggagcgcggcctcggccttggcgaagcggttcttctgcaggaactccagcaccagatcgatgttctccgccatggttccctccaataccagctaacccagaggccgaaccccaccgaaatgcttacccaaaaccgccagacgagctaaaaggtggcaaaccccagccacggggtcaaccgaatcgaagcttcagcaacctccccccaactcaggaggccctcccaatgccgcgccgcagccagccacagatcggcggcgcgcgcgcgcgcgtatccccgcgaatcgagccccgcagctcctccgaagcaccacaggaagaaccaacccaacccccttagccgagacggcggcggcccggggaggccgagcaggcacgggcccgacaaccctcaccacccgaatcgcggaaaccctagccgcgcgtccccccaaccccacgccggggaacccagggggggtgagggtgggaagggagggaggccgcggaggggatgaggaacgggggcgcgcgtggggcgaggtcagcgggaggtggggcggggcagatcgagagcggggcgcggccgagcggatccggcggcggcggcgagggggcggcggcggaggcggaggcggaggcggggaagcatttggaggcgcggggtgcgggggatcagggcgcggccggcgtggctgggggcagcatattcgcgcagctgtggtgggggcgtcgcgtcgcggcggtggtggtggtgtggtaaaacaaacggaaagggttgagccccaaaagaaaaaaaaagtaaagtaaatggttttttattacaatctgggatttttccttttctttctttttttttttctcacactatcgtttgggctcgtttggtgtttagcgctcgggcgtcgtggggagtgggggatggatcgacagtcagataagctagggtacgttgcaattggttggggcgttcaaaatttttttggacccggtggccgtggctgaattgggtgcgggggagcgacaacggtccatgaacccccatgcggcgcggctggccaggggagtgtgctggtgctggatggattgttgtttatccgctaataaaaacattgttataatcatatagtatggttttagtttttggttcatggataaggttttttttggttttatactgttttttttctttcacaacctcaattggactgatgggtagggcatagttatcgtaacatgtctattcctacagcattctcttatgtatacaagtttttctttcgaatgtattttagctgttagtatactttagtatatacccctccgtccctaaaaaagccaacctaggactttgatgggacatgatttggacaggcagtcagtcctaggttggctttttttttttacggagggagtaagttataggctcatatacatacaataagatagtgcaaatattactttcggctctataacaactaagatgtaaaagctaagcctctaccgcaactaagatataaaagccatgttataggtttgtatcaaactttattgaagtggtagtttcattgatacacgccatcatgtcttaaaaaccattagttcttttttttggaaaaaaaaggaaatatgagttgcccatgccttacccatccatttctatggtgaattcacataaatgattatgacatgtatagtaggatatagttcgctagaatgtgcatctcctgtcacctaatttatgtggtatggtgggggaatcaacattccatcgaccttagcaagcttataaaaaattctttactatttcatgttaatagaataagaggtttgttttagccggggtttcaaattttgaaactagggtttctgcccggggggaggcgaaagaaccgaaatttccgaatttttagaaattttggatttttttcatacgtcattttttgaaattttgactgattttgaatggatttgaataaaattttaccaaattcgcaaaaaattgtaaaaaactgaaagtttcggggcgagatatgagcatttcgggagggcggcgaaatttcatgccctggtttcagcacgtagtgctaacatcagtgataggcatttcaatttagagaaaatacaacaaatactactgataatggctctattccaaaaaatatcatcgcaccaacaaacttatcttagaaatgccatcatcatcagggttccatccatttcaccatgtgtttccatgtaagaatgtgatagggttaacgtagaaaaatagatggaaacccgacaacaatggtatttcttggacaaactagctcgtacgatggcattacaaagtgaatgaggcctaagatgcactcacgggcaccttgcttattagagttgtgtttgagaggagatgaatcatcaacacatggttaattgagtatgaattatttttaattttaataatggattaatatgtttttaaaacattttttctataaattttttaaagacacctttttttttccttcaaatgcaccctaatagtttaaacactcgatcatccgtgagtactgcatagcaccgggccgggccgcctggcactcctgcatgaacaggcgcgggctaagaaaagccctggccctcctcgggcccaaaacgagaggggcgtggcgcgcttggcgcgaggagaggggtgtggtggtgcggtttggccaaggaaggagcatcggacgcgccgcctctgccttttccttttcacatttccccctccttccctcctgccctgcctcctcggccggcgcggcgccccatgtacgtggctcgaccgacggcgatcgccggccctacccctaccgcccgcggcgcacgtcgccttccggctccgggattgttaattaccgtttcgagtgagacacttttgccccgcgtcgcgtcgcgattctgcagggattcatctgtcctgatcatctatccattcatctgttcccttacctaatttctctgcacagatccagcagtttgacagcaaagagaaacagagggatcatcgaggaaaaaaaaaagggctgggctacaagcacatccagatccaggctggagtaggaggcagctgagcgagtgttgttccagtggtgcctgccaacggaggtggctggctcatgaacattcacccgtacaaccagacaaccgtcagcaagtgcagaaaagagggacaccaaatttcaatttcaggtacatctgctattctgctttgggtcctgtttgtaaagtttaatattctgagaaacagctggagagaagatagggaagctgaaaaacccagtttctagcttgtttctagcttttaattcattttttggattctgcagctacagtttctctcaaactaagtgaaaattagaactgttttttttgggaggggtggggggagagcttttggcagtagcttcttctagaagaatcttcagctgccagaagctcccacaaccaggcccttacttcctagttgcactaggcctgtaaaggtcccatttgagttacaggccccatttgagttcactgaagattagcgcataattaataaaattttaattattttaacttaaaagcaatctctatatagatttttttttgtgcaaaaaacacgacgtttagcaggtttagaaaacgtgctaacgaaaaccaatgtgaaatccgtaccttaatcaagaacaggccctaagtaagaaaagctttattagattctacttttcgaactagtgagtaaagtcaaaccatattttattcatgtagtagtaacttgaatgctctcagcatcaagatacagcatattacagattggtgttttcacttccaatcttaatgagttcaggcgagcaacagcacgcatttgcaacttagaagattacacatactgacattagcatggtgaagaagacgacagtacataaccaaatgtgccatacgaccatttatctgtaaagtcaaccatttatctgcagccagtgaatcttcagtctgcaagtacgtccaatcctaagcacaagccaccgtcgtggctatacgaacgaactgcagaaaacacaactctttagcaaaagtatcacactggtactttgaaaaagtggaagttgttcgcaagagaaataaatatatgaaatcaattgtttgtagttttatctctaaaatggacagcaatttagataaatcatatttgctagtcatctgtaccaagtgacaaagtgtacagattaagaggatgtcataagccaatgtatttcagaaatggtagaaaaatatgtttgtagctaaaaaaaatcagaatggaagaagcgaagcctacaggacatggtggttctataggcactcttgtagccgcttaaatagagcacgagtcaggaaaagacgcagtttcagcagtggactcgggttaactttagtccctatatttagacactaatttagagtattaaatatagactacttacaaaactaattacataaatgaaagctaattcacgagacaaattttttaagcctaattaatccataattagagaatgtttactgtagcatcacataggctaatcatggattaattaggctcaatagattcgtctcgcgaattagtccaagattatggatgggttttattaatagtctacgtttaatatttataattagtgtccaaacatccgatgtgatagggacttgaaagttttagtcccatctaaacagggtctcaagcaaaacaaactgagcagcctaaacagtcaattaagtaatttcacataccatttcatgattattttgctggagcagaagcaagttcgacgctgaggatgaaggttgacatgccagcttccctcatatgtcggacatcgccattcatgagcctcagcaggtttctagaaaccgaagactcatgccttcatccgactgctccttattgtcatcctcgtacatttgtgacagcagatctgctgggactcctttgccctggtgcttgatcctgaaaaacattgatccacaagagttaatacacatcattttatacttcaagactgtcttaacagaaagaagagtaagcgtgcaaatgtcatgactaacatacctaagttctaggtctatgagatgaaggttttccccaatgctgttcttggtcaggctacaagagatctcaacagaacccccaacaggagagaacttcactgagacgaataggaagtcagagagaatctgctgtagtcgaacaccatccccgtagactgtttgcttcatatatctctccggtaggttgcaagagactctaatcccttttccctggcaagttatgagtacttgacttacagcagccacaaacacatcttgcaatacaaactcaaccatctccaaatccaagcaactagacctgtgaacacagcagcaggaaattagt

SEQ ID NO: 40537 - DNA, 8793 bp, Oryza sativa
tgcaacattgacctccttcatctgctcttcattcagacctgtgttcttcagtgctttcctagagtaaagcatacctgagagagggttgttgattgcatgtctcatgtaggagtaagctttcaactttgttagtgcattctgctgtgaggcttgctgcacatgtagtgcatgttgcagctcatgactaggaacttgaatgaaacaaaatactccagtgatgacaccatctgcatttacttttctgttaacagaaagaaggcactcgatatacttcccgttccggtcgaagaagctgaatggagccttttctgtttcatcaccagctaatgcactgttgataagaatgcagagacttacaaatgcatctttattcttcacaagacaggaggcgttggtgctatcaaacacctcaccaagaagcatcttattgatcacctcatctctatgccacccggtcaatttcgtcatggcagcattccactcagagcaccatccaaattcgtcagcaccaaatatgggaggaataagcgggcttggattgtgaataattgctttgtagtctccctcaacccgagtaaatttgtccatgaccaacttatgaacagtcatatcttgtgcaacaaagcacacaccaacaacatggtcgtgaaggtcccggctggcacaggcattcacaaccaagataacagggccatcatctctcttggagccatgagttttcacctcaaatttcacttccttctcttctttgcctgatcaatcaaagaaatgtttagaaatcaatcaacccacaacgcagctgaatgtcaagtattaatgtatgagcatgacaatcaaatgtagcatatctaggcattgaacattagaaagcaaccccaaagtttttttgataaatcgaattgccaaataagcagaaacttgaaaaatactgggggaatagacaaaaaccactatagctaatttacccaccttgcaaagctaaatacagcatcctctggacaactggtacagaagattcctctacaacggtaagtatgtgtcttccaatagcctcatctactctcaaccctgtcaactcagcaaccttctgattccatccattgaccaatccattgctatctacagccaagattgggacagttgctgtttccatgagacgaaccatttcacttgtaactgcctgcaattcagcaagcccatcaagcttgagatcaccaacctgattatctaaactagcggcccttgttggcttgatgtcatcattcagtgtccctctaagtataagttgtaatgagtgaatagcatccatctcatagtcattccaaggcaagctcttcatcttgacaacctcaaggaatgccttgaaggacagcctagggtgcattcttctgctgtcatccttgtctgatggatcatgttttgcacctccccatctgatttcagcagctgtatgtgacctgaaccagaacaggatatccttggaatttattttagctactgccattccacaaatcatatcaccaagagcagcagctcctggatatccagcatcatgtaggctatcagtactcaggccagtggaatccctgtggacatctgacagccagaaggcaatatcacgtatctgagactcagttggagcattctgtagccgccacacttttcccccatacaaaagagcagcaccatcacatttcacaaggtccatgatgttgggagtccctgatactatactcagaggagaggattccctgagaagcatgtcagagagcattgtttgcatcctcaatatgcttttctcgcgtacttgcctctctaattcaaactccttgttaacatggacagcaaacacttgtgctaagaactcacaggcataccgcaatgggaaaggaacatatctggggctctcatggtggcaaacaaggagtccccatagtttcttcctcttctgctgttgtgcaggttgatcagccccaacttcatcatcatcctcattctcattaaccacaacagccatgacaagggatgcaatcgagttcatgttctccatatactgaagatgacaactgtgtggtgccctcagtgttgaaccacataagctaatatccaagtggagcgactcatcttcgataatcttgatagatcttgcacggcaatcacaaatcatccggactttgttcttcatgaaaagaaacctggctgcctgagggatatcagtagctggataatgcaggccaagataaggttcaagaccaggctttgtgatctcagcaaagacttcaccatggtcatcttcatggaacttataagccataactctatcatatcctgtgaggtcaaagagttccttgaccaccgtattgcatagcacctccatgcttccacctggcagtgactggatcttagagattgccttggcagcaagtttgtaagattgcaaagccccagcggcagttgctggaaattctgtaggtttcacaggctcaaagtctaccaccaaacaaccagttgcccgatgaacaatggcatagaaaggcttgcctgaggtcttgcattgaactaggatagggttcagcaaggaaacatcagcaaatcccagtgccttctgcagtgctgtggcacctgggtcagtgaaaagagaccatacattggtgccaatgcgtagctttgggggatcatcaacacttggcactgcatggctgacagttgtaagcatctctggtgcattctcgctgagcgctataacattgaaggtcttctcatcaagggccaacaagcaaccaaatggttggattagctttgctctctgaatgtgatgcaagtaagctatgaccttctcagaacgagcttgctgctcaggtccagtagttctctgtgcttcaaccaatttggagtaatcaaaggagtcgccatattcttcatattcagcattgagttcagcatcaagagttgtttgtgctaatatccttgcccgggagctttggcgggtcctgctggatgaactggaacattgagtaggtcttgaagaagacatcttctgccttgattacctgaatcactcaagagtcttatctgctgtataccactcctgctgaacaagataatataagttgaaaacatcaatcagtaaaacaaaaaagtatagcaatccactaatatcaatagatgcctcaatctagtggataaatgtggactatcaactttgatcaatgcctaaaaccacatgattagacttccttgttgcctgagcagttcagaaaagagaaatgtttttgtctttcaagagcttgagaaatataaaaagttagccctgctagaactcgatggatgaagtaagaacggttgacgaagtaaaataatacaatgttaaagatgctattgaagaacggtcaacaaatcttagagcattagaggactaaagtttctccaaatacaactgcaggcacttgtgttagcaaataagcatgacatctcctgtaaagccaaaacctttctgaggaatttccttcactaatctgtgataagatattctctactttgtatttgtcattcatctgattttcattggcattacatggccagtctttaagattttcaaaggcatgaaatgcaggaaatctagtttacattctaaaaacagtataaaaggaaagcttccacattctataaattactacgttgattggaggaacgctaaaacatatccattatacttattgtggtggatctagattatagtgtgggagattaataggatatatattagagctatttcataagaaacactgttgcatattagtttcgatacaaacatgttattagtatctaactgcataattgcttggaaattctgctagtttgatgtttagatttactctttttcagcctaatattccctctgttaacacatgtatgccactctgacatgggcatggtaaatggtaatctaatacaacttcgagtctttcaccactatacataaaactatttagattggcgctgtaaaaacagcaacaatagatctgttagggaaaaaaaattctccaaagtaatataatttttaaagggtttcatttaaaataataattgaaataagccgtcaaaggtaccttggactcacggaggctgcactttcactagtctcatggaccaaaaccccaactaaatctcatatgaaggtactatactgggccacatactgggatcagttttaggaccagttgcaaaagtgtgaggacaaggacaatatccagtttgcatggcggacttttgagacaatgatcatgcaaatcttcgccatggatggagatttagaaatatgattgattcctgattcttttaattagtccttatgtcaatgttttcatatggttttcttgtcctcttggtgtttgttactttcagccagacgtgctgcaaattttgtaatggtgggttgtaatatctgctgatgcaaagacccggatttcccattatctaaaaatctcatggaactatattttttaccaaaaagaaactacaaaccatattcagttgtagttactaataaaaaggtgaaatatcttagctgaatggaagttcacagacatcacagaagacggacttgctctaaacagctgaacttagcatgtccatgaaattagtatgatggactaatacgaatgatcagcatcaagtgcatttttatcatttggaaggttttatagaaagcataaaagagtcgcttatctaaaaaaaaactgaagccgcttattatattactgaaacaggttttataagtctttgctgtgcatacaacagtggctaaaaaaacaacttgtggcttaacttgtttgcaagtccaaatttggagcaaaaccccttaacaggacgagcaacatcgtttggagtttggactactcgctcctccaatagtaggctcttatgtagcaacattttcaattgaactcatcattttgttttctctttatcccaacatatggggattttgagttatggcttttctgacaataaaaaacaacaactaagcaaagccagattaaatcttctcaatatttctgcaacagcacacttctccaggatcagcaagttgttcctgctgctttccactacccctcacctttgttcctatcctcttcctgtaccaaggcttgggggtgagtcagtggacactgacgtggcacatggatagaagcactgaagcagtaccccctctaccaagaaccacccagtggcacccaaagtccaagaaatccaccactaaacaaatcctaaaaaaacccatctcaacagagacaagcaccgaattttatcctctttgcttgccatccatcacaaaccccaggaaaggggatttctgaatcatcaatcatcagttcatcacactcgcatacaagttcaagtttttttgttaatctcaaagatgctaagccctgatcacaaaaaatacgaactaaacaagagcaccctccagtccccaactcccaaacatctctcaccacatctcttgtcccccccaaaatcatcagagaaagagaacaccacactacagggcagcacagcccgttcctctccaagaaacgaacaagcagcagatgatgctagctaaggcagcatccaaccatacaagcgaagagcagcaaagatgggggaagaggagggatcgaccggggtacctgctcggctcagctcagctctgctccagtagtggcggagctgtggactgtgcgggaagaagaggaggaggcagacgagacaaagccaaggcagccgcactcgggtggcagtggcgagctgaataaataaatagcctagcctgtgatggtgtgggggctcagctagtcagctgtgctgtgcttaggccggggctcgcgtcgcatcgcacgcacgcaccggccccatccttcccccatcaccccgatcaccggccggcgcggatggggtcgccgtggggaggtgaggtgtcgcggatttacctcgacgccaacctggagttaattaccgccaataattaacctagggagatatatatatatatatatatatatatatatatatatatatatatatatatatatatatatatatatatatatatatatataaaatttgtgtggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataattaggtatatactcacaatttgaaaattttgaaaaatttgagtgattttgtgtatttgatatcatggtgcccgggcaccatggtgccccatatgagtgtcctatatatatatatataaataatacaaagggaaaatttagaaaacatgtaaaataaacgtagatcaactgattgagtttcttgcagtgggatctattcacctatgactaaggcaatgtttggctaatgtgatagggaaatgattttccacccaccaaaagacatatttaaatcttaatcattcattctccctctttcatttaatcctaacccttcgttcatttactaatcccaatcccactccctatttttcattatccaaacacaccctaattacttttttaagtagtagatgacgtgttcaatctcaaaatatactaataagtttgtattaggaaaaataaaattcagaaaataccattgcaagatggatacgtgaggtgtaaaataccattttacgtgataataaatgtatcaataagatgatttttttttacttcgtggattttttaacaataagaccaaataaattggccgttatatttatgaccgtgtttttattaaaggacaccaaaatttctgtatatatttacactatgaattatatgtagtgtaatataaattttaaatatttatagcctgatttttaaatcttacgaaacttcagtacttgcttatgtacttaaaatccttggaaaaattgctagtgtaacttccacacataaatagaaaagttaatgagaaagagatatgaaacatggagtacatacaagagagagttaggctgagttcggtaaacggtatctttcttcttttttaatcacgtttcctgaacaattaaatagcgtatttcatgtgattttttaaaaaataaatatattttttccaagtttataataataatcgattaattatgcactaatatgtttttttcgcatgacgtccaaaatcctagctaactcaacgggtctacctttctcagtcctagtaataatcacttaatagttcctaaaaaaatgtaatcgcgtaataaaaaaagtgacttagcaaaactgtttaacctgtcctgcttaacccaatagcctgcgtagtaaactagtactcctcccttctttaagcacaatccgtaagctgattgggacagaagaacgcatagaaaaactcccaacaaacttacaaatttagtaatagtacgcagctgtacaccagtggccatgatactctattggacgaacagctcggggttagtagagattactagattatagatcgagattagcgttagtgccatcattatcaccatcatctaattggggtttaattaagtagagcgagggagcagtggccaagagttggagttgcacttgctctttgggctttggttctttttcgacttcctttttcgttaactgcaaaagaatttcttactacttttgggtgacagtgcacccgtggccctcctaggggtttggtatttggggctttccacttgcggacatggccatgtgacccgcacgtgaacgcccatgcccccgcgtctggggctctcggatgctttcggctcgcaacggggtttggcttttcttttttttcttttccgcttttgaagactgggatcaggcacaattcatcgcgtgatctgatcctagctcctgtgggaattctgagaggaaggtcatatgaatctagtaaaaaaaaatacaatggaaactaatcttttattatgatataatttttaaataacttttgtaaaaaaaatccccagatagcatgagtatcacagaacactaggatttatggatgtttcaataaataatgcattttttaagcaattagtaatctagtatcacaaaaacatagttccattaattttcggtcacttgacaggtgaactccgtgtgttaatctcacgtgccttttcttcccctttcttagtctggtgacttggtgagagcaagtttaatactccgtttcgaaatgtttgacgccgttgactttttagcacatgtttgaccgttcgtcttattcaaaaaatttaggtaattattaattcttttcatatcatttgattcattgttaaatatattttcatgtaggcatgcaattttacatatttcacaaaagtttttgaataagacgaacggtcaaacatgtgctaaaaagtcaacgttgtcaaacatttcgaaacggagggagtagtatagccaactactagcttcaaatcatctatagctaatataataacacattcatacaatagttaactataaaaatatactcactctgttccacaatataagggattttcagtttttgcttgcaacgtttgaccactcgtcttattcaaatttttttgcaaa

SEQ ID NO: 40538 - DNA, 1612 bp, Oryza sativa
cgtgagaagataaggaatgagtgttctactaggtaagaaaagatagggcttgtttagaagagattttggcagttgcagtttctatcagaattgaaagctcctcaaacagtccagtttatgagaagttgtagttatataatcgagaaaataaactagaagctaaaaattagggttcctagcttttttcagatttttagaagctgacttactaccaactaattattttttcagaatctttgaactttcccaaataggaccatagtccgacttggagctatctagaaccgcctgagataatatccaaaatgagccctcaagttctttgtgaacaaaggatagttctaaagtataaattgaccttcacaaaagggagagggaatccagtatcgcctatttaatattgagtacacaaagacacagcaagctaatatcctcgagtcgtacaaggagtttcttgaaggcaatccgccgaccgcatcaccaaggcatttcaccaagatgggaaaatggtagtggatgacgtaagataaagaggtcatggataccactacaatcactccctctgctatacactaagatgctatgctaggatgaggtagagcttagtgcgaaagatccaatggtaggtgagggtaaatccaacaacaaagcttgatgcaaatgatcctgtggttgctggtagagtaaaaagctcagagttgcataggcggtactcattgatactatgagtgttagtagccgtgaaatttgaaactcggcaaagatgaacaatgtgacatactggatcgatgatttgctagcttatagctcaactccgagtaacttggccattgttgataaaagaagggagataagaagcaatggctaacaaacgtggcccacaagttagtatgatagagttaacagagcggggtttatgtaacaagttaccttaaaatcttatgtttattgaaacaaaccccaaaatccaaggttttgtgacaggcataactcaaaacctaatactttgtgaaatttacttaaagtttatttgtcacacgttgtttcaaacaaaaatatagttagaaaaggagcgagcagtgtttgtacttttcttttttgaaagagaattattcatgatttttacatttggcactagtcactcgtatgtatgttctcttacataacatatatagtgtaggccaagtagaccatagaccactctagttacatacgagtagtttcgatgaaaatgaggggagacaaggatgcatgacgaagtactgaacggagctaataatgcatcgaataatgaatgattaaattatcatcactaaattagcgacgaattaaaacactgaaaacaaaaagagagaagacatcaacatctctgaatcaagctaatgatctcctggacgagcactgatgagaggctgcagagccttgacgacgatcgtcatgttgggcctgaaatcagcctcgtactggacgcacagcgccgccaccgccgcgagctgggacacatgaacattttgattcgttcagaaaatataccagattatacacagcaagtttgctaagccgatcctgacacaaacgacttgctgatctgaagaaaaaaaacagttcagaa

SEQ ID NO: 40539 - DNA, 8245 bp, Oryza sativa
ttcctgcagcccatacatagtgtagtatatcgtttagttaattcgttatgttataagttgttcaaaacagaaatgtatgaggatcaaaccacaatattgcaattgattactatttgtggttctcctcctatattcaataaaattgtcacactcaaaatgcgggtccgttaaaagcaaaagagattactatttgtgtttggtctagaccatcaaatatattgagaacaaatatgttatacatctccaattttaatatcacagttaaacgatttgccaccgatttcgatagtcgagttcatattgtcatcgtggattcgtgatcgagcttactctggcgcgtggtagccgaaggtgccgagcaccttggtggagtggaggcgggcggcggagtccggcgactggttggtgaggttgaagtcgccgatcttggcgtcgtggccgtcgaagacgagcgcgttgctggagcggatgtcgcggtggacgatcggtggctgcgcgcgctcgtgcaggtactccagtcccctcgccgcgccgtacgcgatccgtgctcgctggctccacgtcaacaccggcccgggctccgcccccttcacccccttcttccctgcaataataaaaatcatgaaaaccccacaatgagatgcaaaataccataaaattcggaaaatactacagcacggtatccggttcgaacagaataaagtattaactgatacaccgtttaaacggaatgatacctctgaggtatcacctgatactagtaaggtatcagttgatatctaggtatcagacgatacctctgaggtatcatcctgtccgaacaggatatggacctgtagtatttccctaaaatttatgcgtttcaaacggggttcctttagaacaattggtgcaacgacacgtgaatggtcgtcgttgatgcacagcatatgttgtgatgagtactactagtagtgagtttaatttggttttttttgtaccgtggaggatgtcgtagagggagcctttggtggcgaactcgtagagcacgatgcggttgttgagctccaggcagtagcccagcagctgggtgaagtggtcgcacttgagcctggacaccacggacagctgcgtgcagtgcgtgccgtgtcgtgaccgatagaggcaagaacaaaacacgtacgcgagttagtttttggcgctgatgaatactcttggagtagcatttgcacttttttttttcttgctgaatttgaaccgaatgtgcggttttctcgtttacctgcgcgcagaagtcggcttctgactggccggagccgccgttgttgtcgaacatcttgacggcggcggcctcgccggtgctcagcgtggcgcggtacacgcggccataggatccctccccgaccagcgacctgtcgccgaagttgccggtgagacggttgagctccgccagcgccacggccgggacgtcgatcggcagcaccttcgccggcgcgccgccggctctcggcgcgttcggccctctcggcggccctgcattccaaagtgtcatcacgacggccggcggcgaacattacggacaaattaatcaactaggactgcgcaattcgaacctggtgctcgcggtggcggcgccgccgggttggcggccggcgcgccgtggagctcctcctcggcgccgctgcaacaccacatcgtgcgacgcagatagctagacagacagcttagctagctagctgtgcaagaacgattaattcagctaataacttagcttaattagccgctcctctcgcacgttgaaggattcggagctagctggttcaacgatactactactatagcatatatacatcgcgacgcgccgagtttgccgcgacaaactcgcgcgaaatgcacgcacgcgggaagacaacgacaaggccggtctcgcgacgtgcgaccctcgcatagaatttttgatgcaccattatatttcgattttgctatatatttatcgataaattttctctcaaaaatttgacagatgtaattacagtacaatcatagtataattacactgtaacttgcatgtaattacactgtaactatagtgtaacttgtatgtcactttcaaaaatctctacgtaatatgttatttcggtaaaacagaagttgtgggaacaaatccttacacatatatgtgtgctgtgattttatttttcttcctcaccaaaacaaatcttgtaatagatctaaaggtttaaaattacatgaaacttatatacaagttacactgtagttacgtgcaagttacagtgtaattacatataagaattatactacgattgtactataattatatctgtcaaattgtcgataaatgtataggtggtcccttatattttgcccccctttttttagcccaaatacgcacgagagtggcggatccagaaaatcgattcgttgatgccataacttatttatcattgtcatagtatactaattatatttaaatcatgatgttataatatatggataaatagttttgttatatattttactacaagtcgtcggtatcatctgacaccggttcttatactgttggtctgctcctggtacaaccaaatagcatacatggtactagagcagatgcggttggtgtcaagctcgtacgtgtatgtacataccacgcatgtcgtggactacaacgaaccaatcatcgtgtgctaagcccatgtgtgtacatagtttagcttcatggagctaaagatcggttagtttaattattatgctgctgttagtaatcggttgagcaatgatttatttagctgggtagagattacttagttttagttctctagatttaatgcgaatacaattcggactgcaggctgatcaaccacgtttgcgccgcggtccgctccgttgatcgatccggcgtcgtgctcccatgctgccttcacgtcgtcagcaacaacggcttggccggtttagaacagagcaccacatgttttcgagtgagctagttggtgattttcagaatatcgacatggacccggcgtgtgaaagttacacacacattatattattgaagttattacaatgtaatcatactatatttatatttgatcgatagatatatagtaaatacgaaaacaataattatggtatcggatgatcaaatcacggtgctttgctgatatcacctcttctaccgtctgctgcaccgtgaaacaaacgccagctcagaagaagctcaacctgcttacctgcagttctttgccccagagatctccggtgtctaccaccggtcgtcgtgctcgccatgcgcagcgaattcaggagagatgggcggtgccatgggatttgtttatgattgattgactttctaggcttttaaagccttgctgttgcgcaactttgttcaggttgaagatgatacagttttaaattttcattgaccgggtttaagattagttgcggatgcaggcaaaattggttcaccgggaaatgtaaggagtgttcccatccagctagatggacgcaaggaattgcttgtttcagtttcaagcaatgcaaatagtacttttggtttggagggtactgcacgtgttaacaacaaaaaagaagttaatcagatataccagattaagtagacgcattggaagcaaagctacattccacaagtagcttcaataaattaatatctacagaacaaaaagtataaaatgtatagtagcatcaaatacagagtacaggatggttaaagttctcttgttacggtcgctgcttcaacatgtactttgtgcacatatatacagaattttgaagtgaaattcccatgacgacagtcttttaactcctgattagctcaagctgctttcttgcttttgtatttgtttgcgcagatgacatatatcacaaagttcagaaaactgagcccagcaagaagccagaagaaataatctaggtgaccttgattcaagttatcaggaatccatccaggatttcctcctcttgttgtgaagtacgcaaccaatgtcaaaatgaatgcactgagataattcccaagagctgttgtgacaagctgcagtgcgctgcagaggctcctcatggcatccggtgattgatcatagaagaactcaagtgacccgacaaatgtgaagacctctgaggcaccaaccaagaaatattgaggaatttgccagcagatgttcagtggtactggaacattttgatccaccaaatgttcagcccttgcaatgtccaaccttttaatctcaagaactgcagctgccgccatcgaaaagattgagattaccaaaccaatccccatcctctgtaactctgtaaagcccctcgggttgccagtgaacctcctagctattggaaccaagatactatcatagagggggacccatataatgacacttaccacatcaaaggtagatagagatgctggaggaatcttgaatggacctactgatgtatcaagcatcatcccttgctcaacaaacatggtggacatctgagcatagacagcagaaaacacaatagtcgttgcccagacagggaacatccttaccaatatcttcagttcttccacctgagtcacagtgcatattcgccatgggtttgtaaagctatctgctttcacatcaagatcagtaattgtagcagctttgtccagacatctgaaatgaatatcattgagagtatatatgttaggtcgttagtttctcggcaaatatggaaatagaggacgagcagatatcaaaagtcaaacataaatatttagctattttttctaaagcgctaggccaaaaggccagtatctataatatttaagtcgcaatttatcaaaactaaaatgttaaccatcacaaaaagaagaagagaaacactacacctaataactttcagaaaatatattttcctagttcttcaagggccaagagctgctaggaattgtgcactgagctatggtctgctgctgctgcaattttagctcagagaggaacacacctgagttcatcggtgtgctccaattgccgactcccttcaattgctgaagccccatcaggcaactcatacaagcgagagctatcctctggaacatgtacgttccacttgcgaaaggaggcaacaaccacctggcatactcgtgtaataggactgccgcctggcttttggaatctataaagtgatgttccagagaagaaacttatgatggccagccccatgaaaattgttggaatgccaaagcctattccccatcctatattgtcttgcacccaaaccagaaaactgcttgatatgagagcaccaatgtttattgagaaatagaaccagttaaagaaagatcccttctggattcgctcaactgggtctgtatcatcaaattgatctgctccaaaggatgagacacagggcttaataccaccagtaccaagagcaattaggtaaagtccaagaaaaaagacagtatactgcaatggatttgctggtgggcaaaaggacccttcgcaaggtggaggcatgaatgtaggaactgatgctgaaagagtcagtacagccatcccctacaatcaaaatatgatgtaaatataacaatgtaacccggtcaaattatagaatcagttcggttcagcagttcaaatacggacagctatgagcctatgaagagagcttgtacacaagaattacaggcctattcagtagacagtaaagaaacagatctactcagctctacccttcctagcagttcatttaagaattgggaaagagtacagcaggccatcttaagtttgagaagctgcatcacatactcactaatctgagagcgtatatatatataccacattcacaaaccatttctacattcatagctaataaatgtttcttctttcattttgaggagtccataaaagaactgatacatggtacaccataaaatatcaggagaaagatgacttacaatgaagtatatcgtggagaatgttgcaatagtccaataccttccccagtatgcatcagccagtatagctccaataaggggagttaagtagcaagttccctgccatgcagtcacattgctagcagcagaagcattaccatcatgcagtttctttgtcaagtatgtaacaaggtttgtggagattccataataggccaaccgctcacagcactcattacctgtggtcagtgatggtagttaattatatatcattgcagatgccgacataataatagaccttgataccttgtagattagtgttagaaaattacctaagataaatgggcatgccctccatctaccagttctctccttcacaacaggattcccagaaaagtcgacagatccatctccagtgtatgtaagttggttggattcctggaataaagatatttacagtgccatctcatcaaacaatttttgttgggcaataactgaacagcttataatgactatagagaacttttaactcggtaagaaatcaatgtgcattgacagtcgtcacagagtaacttaagtttaaatgtgcattgctgactgaataatgtatcaattcagtaagaccacaaatctaaactgtatacttgacttcaacattcagagttcagacgcaaaggaagcagctgtactgctgcagcactatgctggttcctaggtagttgcgttggcatgcggcagccaaaattatcgtaagtccttccaggacaaggatgccattttcccatattgcgcagtacaggagttgaataatccacaagccagaatttttttttgcttaaaaattaagaaaaatagaacaaacagatattagttgttttttttttaaaaaaaaagctataagtagggacgattgttcagcaaagttaacttccacgaatcgatatcgaatacatagaagagaaatatttcccttccaattttccgctcagccgaagacttaaggtggtgtacctaaacaaacaaccctaacatattcctcactcctcactgaaatcgaaaacagcgattcacctcccaaaaaaaagaacgaaaaaaaaattctcaacacgattcacaagcacgatcgctgattcaccgccggcgcgccaaagaaacagagggcggattcaaactcacctccgggatggcgaggagaccctgctccagggtggactcctcctcgcgctccgcacggaccaccgtcacctcggccatggcggcgggcgggcgcctccctccttcggtggatcagtaacctgcggcaagcaagtctgggccctggccttcgatggtggaatcgtatataggaagctaaaggatcaggaggaaggaggaggaggaagcttgcagatctggatatgtggggtctccgggtccaacaagacaaacggtgaagcgcacgacaagaacacccactgtcttaaggcgattcggggtcgtctttttcccctcccctcgctacgattgttctgtgatagaaacgggttctgactggtagttggtgagggtatcagagtttttttgtgggaaaaatatgcagtgtaaatcctaaagtgagtataacaaatttgtgagaaaaaaaatatgtagtgtacatcttaaagctgagtataacaaagatgatgtaaatgacacatgaatgagagaagaaatgaatagattcataagctgtaatacgtactctaataaactactattatgtgagaggtgagtaagttagatattaatgatgtaatatagatctataattgactgttgtgtgggtgggctattaggttggttattatatatgatattttaatttttaagctagtagtagaatttagaataaatttagaataccgtaaaattaaaaataaactaatatagatttatccatgttatcatgagtaaatttgtttctctcaatcaaaattttagctatggtcgtatttgggaataaatgcgtgacaagttatatcataatagtcttttggaaaacacgtacttcgtaaaaaaaaccgattttgggttttgatttatttttctttacggagggagtaggttaacctatagaaatagatttgtttaggctgtgtttagttcagcgcaaagtttagattttggttgaaattggagatgatgtgactgaaaagttatgtgtgtatgacaggttgatgtgatggaaaaggaggatccaaactttggatctaaacacaaccttactacagtagtaaccgagcagatccctactttctgcaagaggcttaatacggagtactataaaagtaaaatgttggtcactttaggtgg

SEQ ID NO: 40540 - DNA, 26868 bp, Oryza sativa
aggaagaagatgagaggggaggggggagtaggtggagctcgtcggggcgggcggccgccactgccggacctccccgtaaccccgtgggccacggcgcttggaggctggagagaggaggggagacagatggagagggaggaagaagatgaggaggtgagtatgacatgtggggcccacgtgggtcccacaattttttattattttgtctgtgaagatgacatgtgggtcccacgtgctttattatttttccagatcgaattggcacgtaagcgccacgccagtgccatgtcagatgaagaccgggtcaaattagccacgtaggcgccatgtcagccaaaactgctattaaaaccgccgagagatctcgtttgcctggttttcataagttaggggacggatcgtacctggttttgtggttaagggatgaaaatcggactgggtgacaaatagagggactcaaagtgaacttattccgacgcctctactagatgagtgaaaccaatttaaaagcgctccatcggccaaagaggagccgagatggtggtcttggacgctatctagactgcacacaagcttatgagcccatcctccacagcaagcatgctatggccatcgaccttgaggccaacaacaggggaagaagctgcccgagcagaacgctatttttgggagcggcggcttgtggccaaatcatgccatgtggccgtgagctagccaacgatgatgatggctaagggcgagccacttccatcttgccataaacgagacgacgactccctcacctccttcctttatgcccctctcccacccatatgtcctcctctcctctgttgctgtggcccccttcgtgctagccacccaccacgttgttagccttcccttcctatggatgggctggcgagctcaagctcatcaggacaaataggctcccacttgagcgccaccttcgtgatcgcacagtctacgattgattccagtctcgatacccctcaaccaagatcccttccgttactgtcggtcaccggcacacactccctcatcggctctatcctgccatggaagttgaaagggagaacagggtgagagtgagggagagagtggggtagagaggaaaagagtaaagacagagagagagagctgactgatatatgggcctaatactttttattgttttttctaactggcatgtgggacctgttaagtttttttgttgttttatttttcttctaaagccatgtagacattacgtaggataaaaccaccatctaaaatagtcaagggactcaaattgcactaaatttagaagttgagggtgctatatatctgattacggttaagggctgtgaaaaaactcgatctctcttgacggggtctaaagtgaacttttttccatttaataacctttgctttgcctctctgggctatggcatctgctccacttcatccaggcccactttaactaaacgagaagaggccaaagcttaaagctgtacttgcagtatcacgaacagtcatgagctatgatatcgtcccgtatcatggcgtctgccaagtgccaaccatgaactgtctgccctttggcactactgggggttcagctttccatacgtgccatctggcggtgccaagtgtccatccactgccaaagaccgtgacccggcgaagtggcgaacaccaaaagccaccggatgattacccgcgcagctgtacgtccacgcacgcgcaccgcgcaccatccgctaattgccggtgatcagctcgcaggcggcgcggcacggcatgtgcgcgtggtcgactgctcggttcaccgcaaagctaatcacgcacgcgttaagttgctgcgcccaactgaagtcgccgagagcgagaggtgactgacgacgcgcgcggggcgcgagagatcgatcgaggtgaagcgtcgggcgcgcgaggtgccgagagacagtagtcaccggccgatcgaggtgaggcgtcggcgcgcgtcggcagcgcctgcacgggaaaacgagccgaaaacggcacggcgtacgtacgacggtgcgcagtcgtagtacagcgcagctggcagccgacgggaggggcggtcatatgtcacgcgctcgcggcacttggtgagtgggactgaaaagctcgccgttgtgttattccggaggcccatgcctaataggttgttttctccggtggaacgtaactttctgcgttggacttgttcgtgggtagttctaatgggcgatcgatcgccctaccgatctggtagcgatcggtagcccccctcctcccttcacctggttttcttttttggcactgcattacttttctattttaataaatttatacgcctaaagtttatacgcctcaagtttacacatttaaagtttagagatcaacaatttataagtcaaaaatttatatatctgattcaaatttgaatttgaattcaaatatttttttatatatagtatttctatacatctaaagtttatacacctaaagtttataagtcaaaagtttatatatccgattcaaatttgaatttgaattcaaattttttcatatatagtatttctatacatctaaagtttatacacctaaagtttatagacctaaattttatatacccgattcaaatttgaagtcgggtatataaacttttgatttataaactttgggtctataaactttaggtgtataaactttagatgtatagaaatactataaaaatatttaaacttgaatttaaatttgaattggatatataaacttttgatttataaactttgggtctataaactttagacgtataaactttaggtgtataaattgactaaaataggaaagtaatgcggtgccaaaaaagaaaacatggagggagggaggggggaggggtggtgatcgctaccccctcgcccctcgcggtagcgattgatcgtgcattagtgtttccgcttgttcgtccacagcctgagggggagaggcagcgacggtccgatgtgcactcaattgcatcttttcaaaccaataaatataaatggattattctggccgattttgctcttagagcaagtttaatagtatagcccactaatagctccaattcatctatagtcaatctaatatccaattcatacaatagttgcttactatactattagtatatgatcctacctgtcatacacacattgtgtcttggagtccgtgctgcagctggctacagatctgtagcccgctgctcttctctctcttcctttatctctttaaaatatgtttatagctagctggcttatagtctgctattgtacctgctcttagataacttcacaatgtacacggctatgcgttggattttacaccctcatttcacattataaaatattttgataccttcatttctcattagatttgctaacatcggtacaaatttgataaatatatgaaggatatacatggatacatgcataaatctattgaaatcaaaacatcttatattataaaatagagaaaatactataatgtttacggtaaaatatctgtgcaatcacgatgtacagcgacgtgatccactcatcgtagagttatcaggacgtgtaccggttgtgtgctcaattatcgtctttaaggctaatcatgtgccatacttctggagtacagtgcaatccagcatgctctggtaccacctccactaggtccctttgtatatcttggaattttttgcattcacagcacgacttaggccgagtttagttttaaactttttactttaaacttttaattttttcatcacatcaaaactttcatacacatacaaactttcaacttttccgccacatcgttctaattttaacaaaacttctaattttagcgtgaactaaacacacccctagttgtgttccaatatattgcatcacatttgcttggtcatcgaacggaagcttgcagtgtacactgcattgccatatggccacgcatgctcacatggattagaggaagaactggcggtcaacttgattcccacatgttattattcatcaccgttctgaatcgacaacgattaattacctgttcacgtcgatcacagacgggaaacgaagatatttttttggtattcaaagctgcaatgatcactctaaattaatggaaccatgtgaagaatttggatcaaggatttaaggtgatgctgaatatttatgtactatagatatgagacgaaagactcgaaattttccagataaataaaaagacctgggtcgctgtccattttggaatatctctctgaataagactcctagcttagatccagatcgagaatggtttcatccacacgtatgtgccttatcaaagctttcaaacgtgcttcaatacaaagggtatccttcacatccactacagtagcacgcacctgtatgatttattgatttggatttatttgacccacggccaaccagatcagataacttggaagctcttagtccatggtgaatacacagtatccactacagattcgattttcccatgcgaccaaaatcgaattttgtaagcgggtgggtggctagcccgcaccaaagtgtcgtctacgaaaatcaaatttttgtatgtggatagagaaaccatatgtgaaaaatttaattttcgcatgcgggcgcttaagccgtccacgtgcgaaaaggaaaaatcgcaaaaaaaaattccaaaaatcgaaaacctacttcgaaaccctgaccctagaatcctcttatcgtcgtcgtccttgtcctcttgtcgccgccgtcgttgtcctcgtcctcatcctcccgaccgtcaccgccaccgtcgtcgccatcctcctcgtcctcccatcactgtcgccgccattgtcattgtcgtccttttcctcctatcatcaccgttggcggatccgcacgggcacgccgggagggggggggggagggggagcagtggctggatccgcccctaccatcgtcgccgccggtagaatccttctcgccctagcccgcttatgtcgccttgcccaccgccgttctcaccctcgctcgagcccaccgccaccactgaagcccgagagctccgctaaagcccaagcccgccactgtcgtgagggagtgtggatgggagagagtggggagaggagtaagagagttggagagggagggtgaggagtggtgagagagagggagtgtgaggagtggacgagagaggatttagtgggagagggagaggaggggaggaaacaagagtgatgagaaaaaagaggagtattttcgcatacggtcctgttaatataaaatatgcttattttcgcatgcggttcttgaactgtgcacggagatcgatttttgctgacgggatcagttttatgatccgcctgcaatataaaggggttcttatccagaaaaatcaattatgtagtagtgatcctctgcatataaaactcaattcttaggatcaaccactgtaaactacaaacacatgatctggaaccttgggcatcgagaaaatgtaagtttttcatctagttgatagtgtaaaacagagtatggccatcagatcgcctggtaacgagggactagctgcacaacctactatacccgctatgccaacactcgcaagaaatttcacatcacctcatcatcgattgcatatacacaagaagaatttagactttagtagcagcaagcgtcagagttgttcaactgcgccagcatggtcgaaactaaagagccatcatatacttatcatcattctttactcgtacaccagataattaacaccggtgacttttttaaagagaatatttaacagggatgacttttcctcaaagcaacatttggaaaatgttatactccagtataaataagaagtcgcaagtaaaacaatcaaagtaatcatcatcatcatcatcatcttggaaacgctccaagaaaacaaatcaaatagataagcttaaaaaactacaaatattcggacactctttttttatgtgcggtctgggaatgggcgtagcgccgtccttgaattgcacagccccaaatggccagatccacgcatgttttgttcatcgattaaacacgaccaagtggaaggacaccgacgacctgggctcacacggcgtgtggacgcatgatctctaattccccatctcccaatcgtgatgcacgccactacagtaccacacctacgctgacacaaatcgacatatcttaattagcgattagtcttctaccactagcactaatataagagcaagctaactactagctccaatgcatctataaccaatctaatatctcattcatacaatagttacatactacagtattaatatctagtcccacctatcataaacacactgcgtcttggagtccgtactacagctagctataaatctgtagcccgctgcttttctctctccttatttatctccttaaaatatgtttgcagctgacttatagcctgctattgtacctgctctaagagcttcatcgtttattcatattctctaataagagcaagtttaatagtatagctaactactagctccaaatcatctatagccaatgtaatagctaattcatacaataattacttattatactattaatacatggtcctatctgtcatacacacattacgtcttagagtccgtgttgcagctggctacagatctgtagcccgctgctcttctctctctttttttatctcttaaaaatatgtttatagctggcttatagcctgctattgtacatgctctaagtccttttaactcagtaggaaataaaaattaatttataaataaaacttttatatatcgattagttcgtagcgacttaaaaactaaagctaaaaggttatgttaaaaatatcttaaaattaacttaaaaattaaattctaaactttatatttaattttttgttttggcttattagactaaccgatcgggctctaagggtttttttaagtgtaatgccatctcaaaaggggaagatgaaatacccgatcgagcaatcgcgcctagttgtccaatcggcctgcttctcccggcatcctggcaaccaaacccttaatttaacaactcgatagcaaaccggcggagtaacgacgttgcccccgtgtaccaaacgcgtgtgtggattagaacagattcttttttaagacctattattaagaggataggttaagcacatccctgtccccgtgtaccaaacacgtgagggtacgttctcttgtgctgaatagctaaatgatttacgatagttatgggcgtacatacaaattaactaaatattaaatattgtaaagttgaaagttagatttagaacaaaattatatgtgcattaatgtatagaaagtttttttaaaagaaaatcgtgccgttaagtattctaattccattctattcgggaaaaaagaacacatcatgggacgatgttggtgattggtgaaggcttgagcggcatacacacatgaagctgtgatactttttatgttcaccctttcataatcgtactaacctctataaaaaaacactttatttcacgctattcacttgggcaaaaactatttatttatttatttttaagacagaggtagtatcatttattacaggtgcatatgtagtacttagccaattttaccctggtgcatcgtatatcaacaaaaattgcctcttgaactctactatttttatatgtagttgacgttgatccattgagataatgcggtgatgtatgatcgttaagggagaattcggaaaaaagaacatcagggcaatgccttatatggggaggaaagcatggtgaaaatttgctaaatattgtgaaaagatgaatgagagggtctacacaaccgttattctcaaataccatcctttttatattatgtagttggcattgaagtaatattcatcttatcatcatctatcaactttgagcgctcacatcattttttaattatttctttaaaaaatgtgatatctttctaaaatgataccatattatcaaagtgcgttatattctaaatataagcatgaaaccttcgtttatataagcctacgattaaatgtaacgcatacattgctagctatgttatttatatatttaattcgataaacttagaggctactccttgatctaattagcacgcactactatatctcacctatgcatgatttgagatctaatccttgatctgtccttcctacgaccttcttctttggaataaaatatttctagaaaaaaaatttatctgtccttcgaccttcttctttggaataaaatatttctagaaaaaaaatttatctgtccttctcctatggccttcttatttggaataaaatatttctagagaatttcacaaaggaaattcaatagaagttctgccaaatccatatgggtttcaaaggagagagccttcccgtctcctttttttccttccatccaaaaaattccaaatggagtagtagttcacatttttacaccgtcgtcttcgcaaatttaatactactatacgaaggaggaggaagctctcgcgccgcggtcgctttccttcccctaaattaaatcccgtgcgacgcgtagagacctcctcctccgctttctcctccaaagcccaagctaatccccctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggcacgcacgctcgcctctgtctcgagcgccattggcgccgatcgattcggtgattgattgggagttttaattttggatccgggcggggcttgcaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccaggtactcctcccccccaccttgcttttccgccgccgcggccgccacccccctccctcctcatcccgttcgtcgtttcgcgttcgttattacgccgcaaattcagggatcactgcggttattaatccctctcgttttaccgtgagatttatcccaaaattttgatccaaacttatttttggtttgatttgatttgggtttgggtggcggcgtagggtagctgctgggttttgatcagctcgttccaatgggtgcaaccggccaacccagttggtggccgtccgtttcgacaagtagtcgcggtggatttctaatcctcccacttggccgctgatctggtctagagattagaaaactagctacttagaaaaatggagtacaaacagctcgattgtccgcgtgagccaagggccatcagcccatcacatactcacatgcgccttcgcccattggctctctcttgactacaataatatggatccttgtttaccttctctcagactgtacgtttctgcttttccgtttttaaaacgaaagttgccaagaactcggggaatcgtaactcatatgcagccatttttcgccagtatttaggctgtgttcttcccatgagttttcaactcatggaaactcatctccccgtttgatacgggtttcaaaaaagtttatataagaaaattgttttaaaaaatcatattaattaattattcaagttttttattactaatacttaattaatcacatgttaatttacccctccaaaagaacatgtacacagccttagcatggataggtcgagatgttgaagaatccctttgtaatgctttttttttaccaagttacacgaaaaataaaataactttaaattttaataatcctatagaattcctgcatccggcacaaccaacatgttcgtcattaagcaaacagtttcgtttgcctgtgttttataagggtgagcgataaattaagcgatacacagtagactttttgattgctttggagtgtttgtaaccgtagtcgtaacggcaagaacaagtaggtccctttgaagcaactatatatgacccgattgccagggtcaaaaatgatgtgacagaaatgaaaaacccattcccagcgtgtctgtcaccttgacgcgtactcactactgacataaaaacaacgattagtgtctctttcagtagttaattaggacagaaattgattcaccgattaaagaaaaacagtactcgtacatgttcgaggatccctcgttcctaggaggagaatcgaatttggtcggtcctggacaaatgtcacgtggtgactcttggtttctgagtggattggaaacataaaacataaaactcagtttctaattggactaattagatctgacactaccttatatttagatttgtagtattacttggtgtctaatcatgtatttgctatattttgaggtgaaataaacacattgccagtattttcatatgagtttttggtcatttcaatctgctgacctgtcaagaaaaaaaatgtttttcttctaaattttatccttcaaaatggaacatattctatgaattttccgccctccaagtgagaagataataattgtagtaattaagccaatgtccggtgattacgtcttatgtgtggacagatgcaaaattttcgctgccgacgtactctctgtgtccaccaataattccttgacaatatgtcccctgtcctctcattttctttgaggctaacgggcgggtgatcaacccgcccctccctctgtactcctctcccttctttcctatcatcgtaaaataaaaaaaaccacaaaattagtaaaaaaattagaaaaaaaatctaatactcttatacatgtgcataaactttataccgtaaactttgcacacataaacttactttatgtatagaaatattttatatatacaaatatttgaatctgaatttaaatttaaatcgggtatataaacttttgacttataaacattcgctctacaaactttaggtggataaactttagatgtgtaaactttaggtgtataaacttttgacttataaacattcgctttacaaactttaggtggataaactatagatatgtaaactttagttgtataaacttattagaagagaaaaagaaaaaaaacgatggctggcagcgattgatcgctcattaggaaaaccgtgggatattgtctattgtcaaggcctagtgggatttgcctttctctgtccactaagcagccccgtagaagaagggtaacggaacgaggcggtcgtcggttttctgacggaattcatgtgctaacgaccaaccaaatgtcaagccataacaagctgtggaatggggatggaaacaatgagttcaagttgtattctgggtccataataattgtccttttgcgatattgtgtcacgtagctgctcttagccatgtgaggggttaggtcgtgatgtattctgaaaatgtttcttttcatggtaaaccagaagaaagtcgagaactaatttcgttacatggtgggggtacatgataaagctgttatcttgcgctccaataatatacacacgcacgtaagagccacgtaaaccattcatgtccttttcccctgtttattttagtcacagattttccgaggatgaaaaaagaaactgtactagtttcagttttgttgattcaagatcactgtttaactttcaagtaaccgaaatctcttcaaatttcaatggtggggttataagttaaaacggtctgagagagtgtgctgaaggacggaacaacctggccagtgctaatcacttggtctgtagtactccatcggttgggatgagccctctaacagatattgcatctgttttgttatatggttctatcggatgaccgagagttgattataccccgtaacagtttattactacctccgtttcacaatgtaaaactttctagcattgcccatattcatttagatgttaaatgaatctagacttatgtatgtgtttagattcattaacatctatatgtatgtcggcaatgctagaaagtcttacattgtgaaacggagggagtagtaacttaaaaattaactagctgggtggccggcgcaattgcgcggctagcacccaaacaaaatcatatatatttttagtatgattttacttaaaatgtattaaatagctatttcattgtcttaagactttgaaagatcaaaccctatctcctcgtgtttctaattatatagttttaaaagtcacaccaattactatccctcatgtcatctctttctttatttgcttgctcaatctaccactatttctattcattcttcttggaatatttaaaaattggattttatagtttttaaagtttattgtcacgttggatttcatttttataatttctagatatcccgtcaaacgttgccattatactcctctacggcccgtccactgtctcttctctttattgtcattgagattttaaaaatcgaacataattatcgtttggtttcatttttactttctagaagtcccgccaaaccgtcagtggctttgcgattgtactcctctacggctcgcccgctgcctcccttctttattgtcattgagattttaaaatcgaacatgattatcattgttttttttacttttcagaagttccgatcctttaaaaattggacttgtagtttcatttttaataattttaaaaagtcccatcaaacgatgccactatgcccctctatagcctgtccgccgcctactctttattgtcattgtgattctaaaaatcgaacatcatgatatcgtgggaatttattttttatttttcatttggtgttttattaacaatttttatacgtcgtatcaaccgccaccactctactcatttataggtctgttacttaatttatctcgtcatgtgttttagatgatcttttctttcaataatctttattttttatcaaaaaatttagtcctaattgaaatattatttttctttttctaatttcagatttttttaaaaattttagttaataccgtattgtgttcttttaatgtttttattttttatttttaatttcagttgtttcaaaattgtattcctacttgaactctcttttattttttctaattttggatattattttatttttattctaaattttaattaatctcgtactgcgttcttatatggattcttctttcagtattgcttatttctaattccgaatttcagcaaattttaaattgtattcctacttgaactcttcttttattttcttttgctaatttcggatttatttatttttattccgaattttaataatctcgtattgggttcttatatagactcttcttttaatattctttttttttaattccgaatttcagctatttttaaattgtattcctacttggactctcatttccttttctaattttggtttttattttgaaattttattaatctcgtattgggttcttatatgaaaacttatttctatattgcttatttttaattccgaatttcagctatttttaaatcgtatttctacttgggctctccattccttttctaattttgggttttattttatttttatttcaaattttaattaatctcgtattgggttcttatacggaaacttctttcaatattgcttatttttaattccgaatttcagctatttttaaattgtacttctacttggactcttcttttttttttctttatctccgattaatgtgggaatttctagctcccacagcgaacgtggtgcctcctttcaaagctgttttaataatataacacatagatagatagatagattgtgggtaaaatcttttatatatgtgtgtctagtgtcctaagcaatttataagccaatgataacaaaattacgttgtgaaaataaatcaactttaaaattaagttaggaaatttaaatgttggagcattcgcgtatattgtttgtccacagcttttctaattttcactactcactacggtataataatggaaattaagaatccaaaacgtgcatattactatccattttttgttataaggtgccttgattttttttctagttaaattttgttagcgactagtgaagtcaacttgcactatgttggaacatatctttttttgtagcaattttatatatagatttttctctagacgtggttgggagcgcatatacgtcaaatatcattccacatttcttcaagagtgatcaaacttcacaaagattgacaacagcaattttaagtcataaaataaaacagaatgaaaacaatattgaacatggttatgacaacagtaacatttcctcttatatggcatcattatgctagtttcattaacatcttctccacatttagtcaaactgtcagagtatttatggctcaaaatttgaatttgagtgagtgaattacgttgtagcaaaatgtgtttattgatgtaaattcgtaaaccattgctataactgcatagctggtgcttcttctcaactttcaactgaatttgctgtttgcagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtaagcagatggccatctccatttaccactcttgttaacgagcacgcgtaattaacccacatttgaaatgcaggtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacagggtaacgaatcaaacagttcatttcttccaatcctctgcacaaagccacaaagtacttatatgccccaatgcacattgaaaactgaaaagtgtttgctgcatagtaaaaagctaatgcagagttgctgctggattgatttgaatgtgcagctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggtaaaaatctcctctctttgttttgacagttttacggtttcttgaatcttgatggctatgtcagttcggttcatctggttacatgcatgatgcacgcacacaataacagaatggcacaatcttttttccaggttccagccaggtcattgcacagtattaccaactaatccgcctaggctttgaggtgagaaaaatgctatttcttagtactctctctccgtttcaggttataagacgttttgcttttggtcaaagtcaaactactttaaatttaactaagtttatagacaaataaagtaatacttataatatcaaattagtttcattaaatcaataattgaataaattttcataatatatttgtcttggttaaaaatatcaccactttttttctataaaattagttaaactaagattaatttgactttgaccaaagtcacaacatcttataacctaaaacggagggagtagcttttatcactcttacacaatcacaattaacttgtactcctatgtgattaatacatataatttgatcacgtgatatttgcaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctctactctgaacgtgctacctccattccaaaaaagaaaaaaaaaacttttatgaacgaatttgtgtatgaaaattaccatctccgtctcgtaatataataaattttggttttagattgcgtaaagtaaatctcttatatgatgatgatgatatgaaggtagtacacatttttctgagactggacggtagactgtctggtactgggagagaagacaccaacaaccaagggagaacgagacgttcctggcacggcgtgggttcgcatttggactggaattctctcatcgtaaggcccatcagtcatcagtagtccatcttaggccccctgtaatttttctgattcatttttaggaacaaatgcaccggatttacttgaaaaaaaaaaactgaccaagtacactcgaccgtccaaaactgataggacggctcagattgctcactacaccatacatacaactccctgcaaccaacgttgcgatggtgtcaaaatcctggtgatgtttcttgatcatcttcttacgacaatcgcacaaccatgaaaagaaagagtgttcattgagcggtaagcattgagaatgcccgccgatagctctgagcgcaacccaccacagttgtcgcgactccgggcatgcgaccaagagattatcaatcgtctcttcgcattgatcccaaagaacacatcgatccagatatgacaaaccacgactctgaaggccggttcactgtctagcaacggttaagggcgaccaaccaaaggaagtagcgacaacgagggggcgccaaagattgcaaaattggcttgtgctggagatgagttcttcaaaaaaaaaaaaaaagagaacacgataagctgagcgggaagagtattctcctgaggtctcccaccgccaagatagagagtccggttcttcggaaagctgcactgaccgaaggcaatcccaaagcttgaaatactccagaatcgcttgaatacccaacaccgaactgatgtcccggatccatcttctgtcagtcaatgcctcggccaccgtgcgacgattccgaagacgagcagggacggctgcatagacagccggcgccagcgactgaattatttttttaatcttaatctttgctaaataatctagttcaataattatattgggaaaatgaagtaacttataagagtggcaaatagtaaaattcccctatcatatgttccacttgacatttcgattttttttaaaatctgagatttcgaaatagattatatcactatggagtatggagtatgggcatttcatattttcatttcggaagggagatttcgaaaaaagaaaaacactacagtggctgcgcacccgccgcatccgagcctctgcacgccgcatcctctccgccgacgaggacaccggcccggagccccacctggccaccaccactcgccaccttcgccgcctcaactgccggccgtccagtcctcggggatgcggcagtgtgtgtggcggcccggtggctgtgctatggcggccaaaatcgaaatcaaccgccggatttcctgcgctccaccgcacggcggcctgacggtggctgctcatccttcgcgccgagctattccgccgccggtgagttctccatgaagctttgctgacctctattcggaatacgaatccgtgcgatccagtctgattcagagtggattcgcgcgcagacacgagtttcccgggaacaagtctgattcagagtcggatttctcttttcagggcaacaaattccggtggtgtccgtgtccgtttcagtttgcgttggctaacttcaggtatatgaaggtataccttgtgcctctcacttcatcaaatgttccaactcggcaagttttcaagcagacgacgaatttcacctttcaagtggggatcgatctgttccaatggcggcctgtagcatagccaggattataaacttaggggatctagcaaaatgtcccaaaaatttgtgctgcctactcttcagagttgtgtccaagttcctagccctttctcccagtttactgaaggaagtggaaaaagatgatggtgatcagccatcaatgacagagagtgtcatggcaaatttaccagagctgcatcaggacatcttaatggagatatttgccctcctggagatccctgacctcgtgcgcgcagggtcggtttgtaactcctggcgctccgcctacaatggaatgcgcagcctaggtatctataaattgtcccagacaccgtgcctgctctacacctctgaatctgctggcgatagcgtcgtgtctctctacagtcttgtcgagaagagggagtacaagattactctaccagagccacccgtgcgtagtaggtttctgatcgggtcctcactgggctgtctggttactgttgatgacgtatccgagatgcacctggtcaatccgattacaggggaacaaatagctctcccttctgttatcacaatcgagcatgtgaatcccatcttcaatgagtccggtgctatccacatgtatgagtactcatggtacagtgcatcgagggtttatcattctgagccatcaattttctcccttgacgagctgcgagaataccttcttgataaggcttttgtgttttctgatacatccacagaaaattacctcgtggtactaattcacaatccgcattcgcaactttcgtttgcaagggttggggatgataagtggacctggcttccaccacacactcactatgctgactgcatctacaaggatggcatattgtatgcagtgaataaagtgggagaaatccatgcattcgatctcagtggccctgtggtcacaatgaagacgataattgaaatggtgccaggatatgcttgtgataagatgtacattgtgcaagctccatggggtgatcttctgcaagtttggaggtcatatgagtacattgagggggattacgaggctgacttgcatgatgctgaccctgcaatatctgtggagaatactgcggaaattaaaatatttgttgttgacactgtggaaaaaaagcgtgtggagatcgaaaacctggatggtcacgtgctatttcttgggcataaccaatcactttgtctcagcacagaacaatatccacatctcaaggaaaattatacatattttactgatgacaacgatctttcgttatttggacacaagaataatcgtcgtgatattggattatttgatttgaaacataacagcagggaggaacttgtgtctcctcagctttggtccaactttcctgctcctgtatggattacacctagtttcacaaagttgaacttcgcctagaagaagcacctttaaggctagttttttatttatggatattagagttgtgtatgtttcttcttgttctgtgcaatttatatgtaaaattatgattggagaactaaagtgtgaatgtgaaggttaagttgcttcatatttgttttgtaccaacctttattatgtttatttaaatttctgctatgtgaaagtctaaacaacaggtcttgtgcggtagccacttgaggggaattagtgaaatatacaaggctaatgtgaccaatgttattttggaaaatggtaaagctgtaagtactgagtctaaaataacttaactctgagagtcttgaatgcaaaattggcaggatgaccgggctaattttattttgaactacgactaattacccttacaatgtttgcaagtattataaagtgtttatgttctttcttaacatgtccattaacctcttagttttattctctgctatctatgactaattatcctgtcatgcagcatgtccattaacaatgtatattttaatggtaatctgaaatagtggataatgctttttgttcttatttatgtttcttcttccaatgattttggacttttctttttctagtaaattgaatatatttggggtcatggatgccacaaagtaaaaatatagagttctcagattgcacatgtaacaaatatttattcatttttgttctgagttttgacaatctaaacttactacattttcctggaggtatgatacagaagccatgtactttgatgaggatgtgagaaccgctaaacgtcagcagttagaatgtgaaatcctaatgagtcactcatttccatgttactaattcaagttatgactaagagaaagtagtttaaccagctgatggtgtttggttattacgaaaatatgtttgttttttcttaatattcttgcttgttcatgacatttcaaataatggattgctaatattcacacatacattccaacaaaggtgctgcaaaaatttcaggcactctaggataattgcagtgataattgcatatggctattataatatagacatttgtctcttcctaattagagaggatgatatctgtcagaaaaatgtaaatggactgttttatttgtccttatttgatcaactggtctcataaatcttgggttttgcagcacacatgtcctgctttcaagaaaatgttagaacacctgcatcatgtggttctcaacaaattcaaaagcgatctagaccaatcattaaggagcggcgggggatttgcagcatcagctcgttattgtgcgcagtcatcaatggtgaaattaaatgctagatcaaggtaaacaaaccacggccaagatatattgggattaaaatattttgcaatttgttaaacgtgacatgcattctgacctgctttctgctgctattttttgtcctgcaaatccgattctgcaaaagccaaatctccaaagtttggtgctcatttgatagttttattgacgatgaatgtctaaaccgtatgtcgactagtattatgggcctttgcttcttgatcttgttttaagcctcttgtgcttgctcctgccaaccatactgtgtaaatttttcaaatattatatgcttgtcgatagtttgtgcattcagattatactagaaacacaacagtattcattataagtaaattcctagcagtttgaagtaatgtgatttgaaactcatcattccttaaatctttggtctacaatacatgacatcaactctctgcattgtcatgcagattctttggttaagcatgcagtgtgggacactacagaagttaggggcaaactggagcaccatatagaagctcatgcaacatctgttcggggtacaaaactggctgaactgaaggctaattatgaggttatttttcatactcagtgcacagtatattattgcaatttcagcatgctcctagaattcctcatttcatgagctcttacagttgtttttttaaaaaccatcctcatgcttggatcttttgttgccgcaatgttcagaaaaaactcttggatgcgcttgctggacctgtatagtcaacctggaaactggtgaaaaaaaactcttgggcatgtattagaagactttataggcatgcaactgaaaatgctattttggcattctcagcttccctctctgagtttgaactagaccagataactatccataagatggtcaaggaattaagagaacatgcaagaagtatagtagaagagaaagctagaaaagaagctgggaatgttctgatgcgtatgaacgaaaggtggaatttagagggaaaaaatagtcaaatctctcttacattttcaatgattttcagattatactagccatttttgcaatatttatcttatccgtacccatttcattggactgtagattttccactgttgagccgtgataaggactccatgcctaggacatggaaagggaatgaagacataagtgcaatcactagagaagcacgtttagcggtatatctttttttttcttttaatcaatattgcaccatttattgggtatctgatctatggtgtagaaacatgatctgtttatcatctttacactgcaggcagctaaccgtttggacaataaaccagataaaatagaccggactctaacaactgctcttttagatggaagaccgctttcacagaagaggagtattgaattcgcatctgatcctattgtctcaagcacatgggaagaggtgctggcacttagatttagaaaattgtgattttcaaggaaatgtgatgaataagtcgtaacattttcacatctatacaggtgttagaaaaaatacactgatcacaccagtgcagtgtaaatccatctggaggaacgcagagactgagtatgctgttgcagaagcaatttctatgcaggtatattccttggccatttctgctcaagtgcttatccaattgattgcataacactgaactattttggtcaaatggataggtaaaacataattgaatttgttgttttcttattatgaaccatgaagcctggcctggtgatttcagagggtcctcaatgctcttaaaaaaaactgaacttgataagctttttcatgaaatatgttctttttgtccattatgtggaagtccatttatgatatttccatctgatgttggtgctatgtgctgaccaaattcttccaaattttcttccagcaggaagcacacaaacatagcaataattggctgccactgcgtggactattctacttcttgcaattgtaggttacaacgaatttatgtttcttctaaggtaatcatctcaatgaagtagcttgcttatccttgtaaaggataggattctctgttgcattaatgcataaactgagaaatcccaaacttgacacttaacatatataactgctaaccatttttatgaactcctggacacgaaccctttgtatcttctggggctcttcgttgtcttcgtggtatcctatgctgcatggttgcaatataacatcacagcctattttcgccatggtacaataagattatacacatctcgtttcacataaattgtatcccagtgcattgaaccaaagtcgctgttgcttaagaggagttaaggctggatcaccttagcttgtttcatcatgcagaattcttctcttaaatttctttttttaaataatggatagaaatttggcctctatatccacaagtggatttacgcagccaaactcctcttaaatttctatctagtgcatttcagttcaactgaattacttgacacgtattattcgaactaatctctgggttgttctttcatatgcagctgtcaggtcttctgacaattacatctggttttctccccacaataatggacatcataacagcagtcatcaacattagtcacaaccagaagagctccattaattctccattgtgaacccattgttccatgttcctcagtttaaacaacacatcctgattattctcctgttctctggacgaaagtcatttttcacagaaaggagttaaggatgggctatcttagcttgttcattttatgatgacataagttactacagtgattgatcaaccggcaactaattttatgatgacagaagagcatctcacacgtgttatttgttactacagtgatcattgaagagctgaagctttaaggaacaagtgtacatatctgagttgtaacaatctaggcgaatatagagattaagactacaactcgaatgtgcaaacatatgtatatgtatagatgattaatgcacaaaaattggtcaatccgtatctaatttgctaatgtgattattgcacaaacatatgtatgcagagaaatgactaagagttatctcctcgagatctcagctttatatgctggtgaacaaacgatgaaaggaaatgatgaagtcgaatctgaatttcttgagaaatgatcactcttcccaccaaccagctggcaatgtgtgacaaaagtagttgtgcaactgaagatcacgagccgtagtaacatagatgcggcagtcctcggcctcacatggaacaagaggaaacttgctgtgcttcatgtggcagtgaagcaacatctgcaagtgcaaattataaccgtgtaagttgttgttaagaaacacacaaaacaatagaagaaaatattgattgtaagaacagagcatcactgaatagaagaaaatattgattgtaagaacagagcatcgctgaatagaagaaaatattgactgtataacacaaaagaagaacagagcatcactgaacaactgcaagtacaaatcacaacattaattaattgttgttaagaaacacacagcataataaaacaaagcatgcattgctgactatacaacacaacagaagaccaaagcatggactactgacctggctgcctgaaaccctgttgctcccagtgaagttttgttcttgaaagaagcagatgtgacagatagttttatgaacaatggtacgagattctctacagtaatgaatatactggtcttccacctcaaatggaacctcctccccgttcaccactcgatgttggcgctgcgcctgaggttgaggtggagcttgtggtggagctggaggggtatgcttcttttgaggaaggtgaatccaggcttggttgcctgttcgattcgttgtggcgcccttgcctccggccttgccatgggctaagcctgttcgacccgttgtggtgcccttgccatgggctggtgtaggtgccacctctgacgaacgccgggcgtggccaccaccgaagaaactcatcattctctcaacagctgtcgtgatccagcccgagtcagtcggtggcgcgaccgtggccacctctgtcgacggcgacgtcacggccggctgcggtgcctccggcgcgcactcgcggcgctggtctgaggccgcgcgctgccgcctccttctacccataactcctctccggtcggcgagttgacggcggcggtgggcggcgctatttcttgtctcgtcgcccagcgcacgcgttcttggctcgccgacaacgggaacacggctggtggtggtggcgacggattcttgaagctgtgcagaggagctcccgacggttcttggcgtggcggatttcttggtggcagagtcggtgtcgtctctggcgacgcaggtgttgctcgcggcgatgtggtggatttcttggtggcagaagcggtgtcgtctctggcgacgcaggtgttgctcgcggcgatgtggcggatttcttggtggcagaggcggtgtcgtccctggcgacgcaggtgttgctcgcggcgatggtggcgcaccgacccacgtccgccggcgtgttcttgtagcccgacgcaacggttcttcgcgcggcggagctccccgcggcacgggtggtgtcgtccccggcgaagctcccggcggcgcaggcgtcagcccacggggatggttggcgcacgcgcacccgcgttcgccggtgggttcttggtgcaggggagctcccggcgacagaggcggcgtcttctccgatggttcttggcaccgcggacctccgagttggcgcgcgtggaccctcggtcgccggttcgggagttcttgggggaggaaggtgatgaaggaagaagatggaagatgacggcgaggttcttggtggcgaggaagcgggatgggaggagttcttggcgagaaggtggcggaggaaggcgatggattttgacggcgatttcttggtgaccacaagggggaattcttggcgagaagaagatggaggaggaagatggaagtcgaggccgaattgttggtggaggaagaagatgagggcaatgtttaagagtttatggagcgggaaggcgagagagccagggagggggagatggagtgctatttatcgtcccaatcccgaaagaatggtcggcttccccggcgccgtcaggtgttcgattgcaacctctgcaaactcaaagctccttggagcattctggttgctggaacgcaatacttattcgcccattgttccattttttcttcttttgaacttgtctaacatgcaactggacatccgcagcgatgtcatgtcttcttccttgttgccggcggccatgcccgaggccggagccagtacaggtagtccatcaccgtagagttcatgttgcctcagtgcctcctcgcctgagacggaggaaggcgagcgtggcgccggcgcgccgccggctcccgcggtcaccagcggacgagcgccatggcag

SEQ ID NO: 40541 - DNA, 9251 bp, Oryza sativa
gcgtggacgatcggtgtcggtgatctgtgggccgagtggaccgcacgtatgggctgtgggccgttcgctgccaaattcaaggcccaatacggagcagccactgcgctagtgcggtgtttagtcccacctcgcttgccaaacaatagtcttactaacttgactggatttataaatcgaagtttggagagtgcttgttctcgcaccgacttctaagagcatgagcagctccatagctccattgtatgtataaactgacaactattttagagccgaactcctttttttaagaaaaagcctatttacgatcgactttagaactctttttttttaaaaaaaactatttacgatcgtaaaaaaactatttacagccgaactcttttttttaagaaaaaatgtataaacattttagagccgaactcttttttttaagaaaaagcctatttacgatcgactttagaactcttttttttaaaaaaaactatttatgatcgtaaaaaaactatttatagccgaactcttttttttaagaaaaagcctatttacgatcgactttataactctttttttaaaaaaaaaactatttacgatcgtaaaaaaaactatttacgatcgactttagaaccttttttttaaaaaaaaaactatttacgatcgactttaccactgcaactattgaaatctttttttttaagaaaaagcctatttacgatcgactttagaactctttttttaaaaaaaaactatttacgatcataaaaaaactatttacgatcgactttagaactctttttttttaaaaaaaactatttacgatcgactttaccattgcaactattggaatctttgattcgtactttagagtcgaactctttttttaaaaaataaactatttatgatcgactttaccactgcaactatcgaaatctttgattcgttcgtctcccgtggtaggcatgagtcgaacggacaatgtggatgccctaacgaaacaatagctgtcgaactctttttttttaaaaaaaaaaaactgtttacgatcgattttaccgttgcaactatcgaaatctttgattcgttcgtctcccatggcaagcatgagtcgaacagacaatgtggatgccctaacgaaacaatagctccattgtctcctttctgcacgctttaattactttattttttgttacgtccagtttgtataattatatttttttacaattacaatgttacgcctataattaattttttataatgttacgtccagtttgtttaattaatatagaccacctataattatttgtcatccgttcagaccaattaattgtagacgtaaacttttttttcacactaataaaaaatatatatcactgggcaaatcatattttctcttactgccatcaaatgaaggccgatgaaaataaagtattttcataagtgggatcagtcgtttgcgaaaatatattatttcggtgacgggtatctaaagggcatcgtcagtgagaatcaatctttctaggcctttctatctatctgcacgctttttattattttctctacaaatttacattagattgtttggtattaatatagaccacttataattatttgtcatccgttcggaccaattaattttttaaaaaatgttacgtccagtttgtttaattaatatagaccacttataattatttgtcatacagtggaccacttaaattgtaggcgccaactttttttttcacactacttaaaaaaaaagcatatcactgggccaaatcatattttcgctgacacctagccctactgccatcaaatgaaggccaatgaaaatgaaaatagagtattttcataagtgggatcagtcgttggcgaaaatatattatttcactgacggatatctaaagggcatcgttagtgagaatcaatctttctaggtaggacgctcaagccactcaccacgaaaaatacatttttttcagaattctttttttttaaattttttaaatgtacataatttaaataacaactatgcacaagtttttataattctttaaatgtacataattctttatcaaataacaacggtatatttttcactcagatctaaattccttactttcttttaactttttgagaattcttgtttttacaggttggggagtgtaacgtcaaacatcttcacttgtttctcttccaatcgcccaggtgtttgacactggcaatgtcattcatttctctccttctctaccaagaggttaaaaaaatgggtccgatagaagcatcagattaccatacgtgaaagaactgtaccatttcgcaactgcaccaacgaataataaaaaaaagcacagaataaagtaagcaaggagttgatcccattattaaaaatcatgttattatctatttaaacaaattccgaaactctaaactacctgttataaaaaaaatagaattcctaataacagaccaaaatgccttatttttattattattttagattgtttttacaggctgagtgtaacatcaaacctcttcacttgttcctattctcatcgcctagttgttgccactggcagtgtcccttcactccttttttaccatgtctaaatatctcctcctttctcttttcctagaaaagagcccgtatgttacaccggagagaaagaaacatataaaatacagggaacaaaggcatgaaaattgagaagagagggcatggttagtactggtagaaaggttatgtgagatggtggtgtggaaagaggggggtaggcgtctaacggaagaaggaatttagctgtaatcggtggacaggaggatcctagtgaagtgaatctcatggtcttatgttgatctggaattagagaaagtttagggcttgtttgggtgcccgaatgaaatctggctagcacgcgctatcagtgggactagctccgatagacatgggaaaccgcgatccgggttgaagtaagtccttgatgggatgggagcagaccagcggtgagagacatgtgttgattttaggatgtaagatttgatgattttgagtcgttggatttgacgatgagaactgtataagatcataattagtgaactatagggtagataattatttttatcactctccattaattcctaattaatgccccacctttttagataaaagtttattatgtaaaatgttaaacacaacattctagtacaaggttggcttttttttaagagggaataactttaacctgaaacacattaataacacgcatcacctgtttgtaggatggttggaattgcagctgtgatctgtgctctttgcaaagccagaaacgcagcatatgtttccgaaataaaagaatcatggacccagctgagctaatacatgttgtgtgctattgaaacgatacttggtccgtcttgcacataatggaggaaaggcgaagaatgttgcaactgggagcggtgctgctaagcagagtggcagaagaagtatacaactcggcatatagatggaggttgaactcaaggcgtctgatgtgaagatgaagtacctgggatcgtttttactaccgtttcagcaccaccagttatgtgggggagatgtaggaagggcggagccagccaaaaaggacgttggggtcaactgtgaaatagtatttacaaaggctgtgtttagatcagttcaaagtttgaattttggttgaaattaaagatgatgtgactgaaaagttatgtgtgtacgacatgttgatgtgatagaaaaaattagaagttttggatctaaacacagccaaaataccaataaaaaaaaccatgaaaaccgcttggttttgtcaattcgctagttttagaatgtttttcattacagagttgatgaaaaaaaaatcatcgatagtttattagttttaattatttttttacgatgttacgtgaaaatcatcgatttttactagccagcaaaccgtatgaatcggacacgggccaaattttaccaagaaaagataacataaaccctataaatccctatatcttaacactcacatgtactctctccatcaagaaaatataaaagattttggttggatgagatatgtgctagcattgaatctggacagaggagggagggagtagcatctaataatgtatatataaaatattgagaagaaagtatggctccgttataagtttgcttcctgccaatttagtagaaacggaaaagttaaaacatatggagtactactgaagaagatattcatataagctgtgaacaacaaatattggtttctaatttcgttacttgaagttgtgctgaaagaaacatcagaccttacaagctgcatatacttttagtaaatcgtaataaaatcgcccttttatctgttggcttgtgggccttgtgtagttcacgtgggcaatcataccaatgatgggcttgcaaaccagccagctaatcacagagattttaatcagtggctgtgctcatacaagaaaaccagatgggttgaggtcagatcaacaattttaccgggttcacattcaactacaccctatttatcaagtggaatttagctccggtcgtcggtgtcctaggaccctgatccaacaacggtagctccgcccattaggatccctgcttgttttgatatgattgtcttgtgtcgtacccatgggaactgatggtgcttttgtttatgatggtgcttttgtttatgtggaaatgttgtcggaaagatgtaacagacttggtaattttacatttccttaatgaaatgggagagcttagctctcttaaaaaaaacttgtgtcttgctagcatcaaatgttccaactctgcaagtattgaagcaaaccatgaatttcaccttccatgaggggatcgatctatactcctatggcggcctgtagcatagccagaattatgaactttgggggaactagcaaaatgttccaaaaaaagtatgcaacctgctcttaagaattgtgtccatatcctagccctttctcccagtttactgaaggaagtggaaaaagatgatggagatcagccatcaatgacagagagtgttgtgacaaatttacgagagctgcctcaggacatcttaatggacccaagattgcctgaattaagattggacccaatgccaagccaagcgggcttcatcatttttctacaaataagtctactttgtttcccttgtttttatatcggaattaaattgcatataaactgtaagataagggttaaaaaaaaattattgtggttttgagagatatttaaactacgaaagtggacatgtcttataccttttgctgccgcgtccgtcgtgtcggcggtgacccatgaacgtgccccagtacttgaattagaaatccttcggggcacatgggtgatgtttgaatgttctgaatatgaagatgaagtgtttcacgcaaaacgtggttgtaataacatgtgattaattaagttttaattattctaaacttaaaaaatagattaatatgatattttagagcaactttcatatagaaagttttcacacgaaacgcaccgtttagtagtttaaaaaacgtgccacaagtatctaaaatttaattcaattttagttggagaaaagaacatggccatataaatcccagattttcacagcaatcaattgtatatgactttcaacaaactccattatttgtcttgaccttgtgtttaatttgatgatgtttaccttttcttcctgctgattttttttctttatcttctcccaattttcctcttcttccctagttttagaacattgtttcgtcatctttttcttgctccaaaggagtacggcaagaatataacaaaatgagtacggagagacaaggagctaggtgacccggtacggcgttacctcgagccgagcaagcggctgctgaactcaacaaagcaatagaaaaaaatacaggattctaatagaaaattaaattaagtataaaatgaagagttgcaaaaaaaaaaaacacaagaatgatcgttgattagacagcaggacaaacacagaaatcggatcaaagagatagtctcgaaggaatttttttaagaggttgaacctcttactaaattttctcaaaacttacatttaatgagccattccattgaaattttatatgatttgaaaaattccaattttttgaatcaaaggattatatagaaaattttcctatatgattttaatcctataaaatttctctgtaaaattctttgattcaaatggcccacagtatacagcgcttccagatttttttttcacgagagaacctgtctacacaggagcaataaactttgaccgcttcatgatgcaaagactgcgaaacgagatgcgtcatcatactttggactaagctccacgtctcacctttcctgtacatagaaacggtcgaaacatatcgttattacctgcatttactgtccatttgtcctcgtcaacactgacacttgtcacctgtacactcccaatcaaaagcgcactactccccgtagaacatactactacatcactttgcccccgctgcctttgccggttacaccgacagcgccggtagtccggtacacactacacaaagaagtcgttagggccaaaccatctgaattctctgataatccaatgggccggccaatccgaggtcgccatgcttgttgactctagatcgatcgatcgatcgatggatcgaccgcgacggcagcgaaagatgagacgacacgagacgagacttgccgatcacaactccgccgatggtcgctgtcacgcacgcaagcaccggattgccggaacatacgagccgatcgagaagcggtcgaagcggatcggagttacagtagctagccccacccgtagccggtgtatcatcccgttctcctttaattttccgatttgtttgttatccgagggatgcgatgcgagcctgcacttgcgcgcgcggcacgcgtcgccgtcttagattttctccccaactgatgggcaatggctacggtattcgccccatgtggcgggcgcgccacaggagggtctcgctctcgcttccgttctacgtaacggcccgcgcgcgcggtggaccggtgcatgcgcgcgcgggggtggggtgcggcgcagggagtggtgtggtggtgcgccgggacgtcatcaggcgtccaccatcatcgcccacgtccactagggcggattggctccgggtttcggatcccaatcgcgcgcggtggtagctggctctccgactccactctatacatgcactccgcccctgccggtgaatttgttcttttgattatttgttagccgaatgtttcttctagacctggagatttaactgatcgcccccactctttactacagatatgtttaaattactttgcatataacttataactagcatagtgacccgcgcagattgcgcggctagcatcactatattttctctcatataatatcatatatgttttctcaaaatatattaaaatgacaccataattttaaattttgtactaactttatgaaactactgatatgtaatatttatattatattttttatatatgtgttagttattaactatttttaatatcaaattttagttatttctaaattatattcctatatggactctagactcatctttcaatatttcttattttttaattccgaattttcattatctgtaaattgtatttctatatagactctaggctcttcttctaatattatttatttttaattctaaatttttattatttctatttgtatttctatgtggactctaaacttatctttcaatattctttaatttttaatttcgaattttagttacttcctatattgactttagactcttctttccatttttttaattttgaattttagttatttgtaaattgtattttttttatacggactctaaactctacttttaattttattatgcatattccaaattttagttagttttaaattcctatatgaactctatactctacttctacttctagtattccttatttttaattccgaatttctattatttcttaattgtatttctatatggactctatactcttcttctaatattctttatttttttaattctgaattttagttatttttaaattgtatttctatatagactctggtctcctcttccaatttttcttattttttaattctgaatttaaattatttctaaattgtatttctatatggactctgtttttctttttctctggttaatatgagaatttctatgccgtgaaagcgaacgtggaggtttctttttctattattttaataagttaatagattttatttggatgtgtgataggatgagctcacattttgtgggtatgagtggagcgtgcatgtgtgctttcgacttgtattaaaaaattgaggaaaatgatgtttcctaagaaattaatatgggtttgtaattagaagtgtaccttttgggttcgggttttctatgataaactattgagaacctggaaaacaatataaaggctacctacataaagaatgtatttttttacatatgagatatgcgcacgtgtatatattatatatttatatatagcggtcaatttagaaagcacacatattagtcagaggcaaaacccgcaagggaggaggcatgagggttatatgggctatggaatatccacaaatccacaagtatgttttttttagtagaagaaaagaaaaggtgttcttccacatttccattctacaaaagtcgttacaagaggggatagttaatttcctcttgtctataggtgttgctttctacaagatatcagttagttttcagtgatcacctttacttaattgacttctgctaacaactcaccggcacttagaagctaactagctgggccaaattatacacactagcatgatgcccttatattttgctatttaaccatggccatgctttctttaattcttcattatttgcgagtggtgacgacgaccattaattaggaaattggatgcttatcaactacttcagggagcgtttcagtaaccgaaaaatcaatatacacatttgggaggggcatggcgcctcatgtcagttatcagttggatcagaggggacatcaactttttccacttgccaagtgacagcgatcgagtggctggattagagggaaaggaaatgtaaacgtcttcacggtcctaattaagcaccacattgctagaggtgttagatcccatcaggctaggtacagtatgatcatccta

SEQ ID NO: 40542 - DNA, 20212 bp, Oryza sativa
  unsure (1)..(20212): unsure at all n locations
gcattactttcctattttagtaaatttatacacctaaagtttgtgcacctcaagtttacacatctaaaatttatacacctaaagtttagagacccaaagtttatatatccgattcatatttgaatttgaattcaaatatttttatatatagtatttctatacatataaagtttatacacctaaagtttatagatccaaagtttagagacccaaagtttataagtcaaaagtttatatatccgattcaaatttgaatttgtattcaaatatttttatatatagtatttctatacatctaaagtttatacacctaaagtttatagagacaaagtttataagtcaaaagtttatatatccgattcaaatttgaatttgaattcaaatatttttatatatagtatttctatacatctaaagtttatacacctagaatttatagacccaaagtttataagtcaaaagtttatatacccgattcaaatttgaatttaaattcaaatattttttttatatatagtatttctatacataaatttctctaactttgtttttttaaaaaaatcccaatcaaagattaattgtgtgctactatcaagattcagtaaaactattgtgtcacacgcacacacgaggtgttagtaatttcgtaaagggagatataacgtcgctggcgcatggatcaattcagcaagctctcttaacctttcgtgactttgttatcacggtgagatcacgttcaaagatggtaggctggaaaaccggccgtgccggccggtccctgctgcaggaagagggctgaactccagtttgattaggtcgcctggccaccattcgagcgtgacacctcttgtagtgtacctgaagattcgttagttatcgccaggttttatggtacacatgtcacttttgcaccgttagttctcttgtttctgcgaataggtctacttgtccaagtcctctgttttttttttcaaatgcctggaaaacactatcgtccaaaagatatccggtatgcgacaaaagagaatttatattgacctttaagaaatatatatatatatatatatatatatatatatatatatatatatatatatatatatatatatatatatatatatatatatatatatatacacaccatcttttctattctagatcagttgttaatactacatataccagtagtttctaaattacgtagatgcgtggatgtacaatggtcaaaaggatatagcatttgttcgtgtagggtgaacttttctaagaacccgtgcgtagaagctccacgcacatacactttgcctcttatcatctgttgattgtcttattagctatagacaaatttaatttttaaactcaatttatttgcagttgattttggagttatttcatcataatctattttttccgtattggtttttaaaccaccaataacacataagtaatgttttacatgttactttctttttcttttttagctgatcaaagtttatttcatgatgcagaaaactacaatattagtacacgtagcttgattcaaaaccaggtacggtttatgataacaaattaataagatcacataggtaggaaaactatgtgcgcctatttgaagagatcaaacatttctacgtacagaaatcatcgcattatgtgtacaggctgacaactcaattccaaacattcacataacataaaatgtataaaaagaatacatccatgtggacacaacatgaaaaaattgaaatggaagctcaatgtgtaaaataattccatctagctgcaaccacagagatgaatagcatgatatatataaataccaacaagtcaatatatatctccaatttttaaagcataggcgatgatcggttgcttggaatcaaaggattttatctgcaatacggaacagggttaggccaacaacggttgaagctgacatgcagatagtacactcttgtgatgtatgttacctccaatagaagcacagcggacgcactcgctagctagctagctcctgagagaggagctccctctctctctcttgttgaccacaaaagcaatctaacgcgcaggaaaggaaacgaattaatttttgaaggatagtatattatagttaattaacctctgataggtagttgctgttacccatgatatgcactcgctatcacgggaatgttgactctgttataggtgctaaggcccaatcgacttaatatatactccttccgtacttgtaaaggaagtcgttttggacaacgacatggtctctaaaacacaactttgacttcttgtttatataaaaaatatttattgaaaagtgatatatgtatgcttttatgaaagtatatttttcaagacaaatctattcatataatttttacattttcaaattcaacaacttgagagttatttatgatttatattttcaaggtttgacttaaagattgtcctaaacaacttcctttactagcatggagggagtatatcagtgtgagagttacacattaagaaaattaattgtgtggttattaattcaaactaacgttctcgcactccgtatatttattcttgatagggagcatatatacaacacaaaatgtactctttaactgctcctcctattaaaaaaacatattgtttggacatcgatacggtttgtactagctatccaacatatattatacgatactagtgcctccgatccgtttgttttcaaacgtatgatcgatgtcgttaatttttatatatactgtttggctgtctatttaaaggtaacttgttttatcattaacgagtgccaatgtactcccctcctaaaagattatcatgacagttagtcaaagtcatattaaatataagaggttaaaatactactatgtacttcattaatttttaatatggagagaaaacaattagcatgaggaaattaatactattgtttgatgattaaaacaggaagaagcgtataaagtagtattaaaggttccgttgaacaaacctctaaaaccacgatctttgtaggataacatttttacgctaaaaaacaacggtcttttatggattcagggagtagtatttttatatatttacactaaatttcctaactagccgaatgcatggtcaaatgtcatgtaaaaaaatcaataatattgtggagtacattttaagagagagagagtaacagcattattgtattatatgaaggtactttcatgataaataatttagacatggtttaatttttcacatatccaattcaacaatttgaaaacgcgtacaatattaaagtttctaaggttagtttgggatataagaaaacaacatacatatttttgtgacgagagggagtactacaatttacagaaaggtgcatgcagcaatatttggtctccttaatttccatgccctttagtctttatccaatattccattaaaacaataaattgggtgcaaaactagtgctatatattcaagttaacagaatattggtagggcaggttttagcagcaatcctaaaacggtcctaaatgcaaccattagttaagttaatcagcactgtgtaatttgcacagtacgtttgacagttcgtgtttactgagcaggtattatattaggaactgaagataaaaacagattccgccatagctaaaataatccaactatcttcgattgatcggcatcaagtagcacatatacacgtggccagagctagcaactatttccacttactccctccgtttcgaaatgtttgacgccgttaactttttagcacatgtttaaccgttcgtcttattcaaaaaatttaagtaattattaattctttttctatcatttgattcattgttaaatatatttttatgtaggcatataattttacatatttcacaaaagtttttgaataagacgaacggtcaaacatgtgctaaaaagtcaacggtgtcaaacatttagaaacggagggagtataaactgctatacataggaaaaaaaagcactcaaaacagcaagacatatagggaagtagcggtatgtagttacaactcaacctacctaactgagcttaatttaatcaattaattattaaaccggagacagacacgattagataataaattacgggattgaccaggtaggtcgaggcgcccaaccagcacaggaaaacccgtaacaactaactcgctgtggctctcctcgtcccctacaagctgaaaattagctagggttgagcaagattatgagtaaattaggctatctgaaccgtagaagaacttaaccattctaggcatgatcagtgctcgtgtgtctaactgttccagaattgaaaaacattaatgtaagaagatagtatcttgcttgtgtagactcagtctcattaattatatatatttgccaatatgtaatatatagatagatatactttgtcgcatggtttgtttaactaattaatttgttcttgctagctagtgcatatatatggatgggtatagtacaggcacagggcatcgtcaatagtagttctgaaaactactgataaaattaactaacaagactaatattctgcgctgagatcattaattgacatataaggatgctcactgtgtactcaacttgaggcataaaattgggtctcccagtgaaggaaacttaatttattttaaggcacatgcagccataattaggtgtcgagttacattttgggggagggaagagtgattgggttggttaagtagacgttgtaggtttgacaacatcagagagatgttgagacctgaacaacagaattccccccaccaagcaaaccctactacagcgcatgcatccatacatgctgcatcaatatatccatcttaattatattttccctggcctaatctatcccaaattaatcctgaaaattattaggtgcacctagtgaagaattttcccttgcacacaaagatcgacagagctagcagctgcagcttgtgaagatcgatcgacaataacaaatgatctttctgaaaggtacatacagatcatatttaggtaacggatgaagcagcttaaataataagctagcaacagaagtagtagtagtacacagatcatcggttgaactatatatttggttgataccaaacatttttaccaattagctagctatacgtactactgtaatctgtttttagttaacccttcccttaaatactctgatgacatatatatattttctacgtactatactactactcatgtagttcctcaattgtcatgggtagttgcatgcatggcaccaacatgcatgcagaaatcatgcatgcatgctagcttaattaggttctgtaagtatgcagtttgttgaacaatttgtgtaaccggagaggagatataggtagttagttaattagttgatcttgtgtggacctacacggcgtgcgcaataactgacatttttctattatagttgcgcgagaagcttaacttacaaaaccaccagttagcccacacgtagcatcaaactaacctggtgtaaccatctcccatctcactgtctttagcttctccctaacgatcagcacaagtgcacaacgatggagagatgtagctagctagcttatagctaaaaaaaaaaaaaactgcccaacacaagacaccactttccctttggctagctagatgctggcctcctgtcgttctatatattcccttggccatcgtctctctcttgccttcttcttctcaccctattggtagctcctgatttagttttttgcttctcttcttcctcctctcatctgcatctccagtggcccagcctcgcatccgcggcgcaatcgtttatatatatgtcttgatcgatccctcgcatccgcggcgcaatcgtttatatatatgtcttgatcgatcctcgttcttgatccgttgtctgaattaaccccctgaaactagctaggagattcttttgttgctgcagcttatttccatgctgcaactttaggaagctattacacatatatatatacttgattgagagatacagctagttgcaagattatagcaaagctagagaaagagggggttgagagggagattggatttgcttaatttgttacatattctggtgatcgagatcgatcgatcgatcgatcgatcgggaggatgtgcaccaggggccactggaggccgtcggaggacgagaagctgaaggagctcgtcgcgcggtacgggccgcataactggaacgccatagccgagaagctccaagggcgatcaggtgtgccatcatgatatacacatagtagtacatatctacatatgctcaagaaatgatcaatcgatcgattgatatatatgtgtgttatttacttgagttcttgatcgatctttgggttgagtcggttcattgtacggtttgcttcttcgtggtgcaattcatccgagcaagtttatttgacttgaggctttggcatgtgttttagttcgttttatgatcagatagaattttaatttgttagagtgtcatgtcaaagaggtgcaatctacacagttcatcaatacatgatgtccactgctctgatgtgtatatcacatctatatctcttgtagagcaatatattccatctctcctgtcgagctagagctactactagaggtagttactaattgatttacaacctttcttgctctataattcatccgtgctttttaccttctcaatttatagcacaagcctcatgctgcaatggtgtgtcaccaatcgcttaaaaaaacattcatagtgtaaatagtttacatgcacatgtcttattcttttttatgcggcaaaatagtcaggactatgtgtctccagtaagtagtgcatagcatcggccggagccccttggcactcgagcatgaacaggtcctccttgagtagagccgtgcccctcgcagggggtggacggagatcggcaggctgttctcgggccgagaagacaagtgccgtcaagaaccactggcatgtgatcatggtacggcggtgcaggtagcggatttggctgtcgcatcgccggggcggtgcctccgccgccggtgctgcgaaaggcgacgagagcccagttaggattagcaacggcgagaagacggcgacgaggcctcctgccacgaatggcagcggcatggccatggcctccttgctcgacaagtaccgaagagaatgcggcgccgctggcctgtttgcaattggcagacaccataacagcaaggaggattattgttcatctactaatgaaggtgtgtttacagttaaacatacaacaatctcgtatgccaatagtacacatttaccattgatccattagttcaagtctataattaatagtgttattcttaattatcaattttactatatgctaatggagaattaattgttttgcagatacgagtaaatcggtggagttttacgacttcctccaggtgaatgcgagctcgagcgacaccaagtgcggctcgagcattgaggagcaagaggataaccgggatgatgatcaagctgaagggcaggtgcagctcatagatttcatggaggttgggactacttctcgtcaatgaatttatccacatacatatgtgtatttaactaggggatcaaatgatccaaaacatgcagcttgtaatgcatgctttgcagtttgcatgctgtgaaaggagagggatgctgatagaaatctaacaccaaaaattaaagtatatacttatagaggaagagaaatgcgatgacgtacgtatatatatgacatgtaatttattgatgtaattaaacacacatatatatctgttcgatcgtccatcctcggatcgtacatgtgaaattcctcatggtaaatgaggaattaattattctctcatctatttgtaaatttcaattaataatataaaatttaatttctgttttgttactcaattgcatttttttatgccggacggatcgatacttgattgggatataacttattgcaatacaccacttccctacatatactccaaatagttcctattggtctaatagtattaattaatattactacctatatatccaaaagagtgtatcttttagtactatttagctaaaagagtgtctaaaaatattactacctaattatccgttgcctagtacaatatgaaaatgcagcagcaattttgacattatcagtaatttgatgtataattaactatgtgaatacgtcccaattggacatgtgatgttgatgccatatgtgatggaagcagtccaccatatttatcgtctaccattttgtttgtggatattatattctgtttatgaacatatagtttaactaatttcacatcgatccatcattgattgaccccctggctatcctagcttttctttgttttggacttcatctatacagtataacgtacgcatgttaatttgattcggaatggaatatggaagatgcatgcatggaaactaatatgcatactatactggtgacgatggatagttgttaatttgtcacctttcaagtgcacaaacttatccgatccattcacgcttctttgtcgaaaaatcgcttttagagacttcacccggcctagagcagtgtaacggtgaagcctcctgttactatatgccatgacatgacatttaacaaacctggaagaactttcccatctctctcgtttgcggtgtgccaaaaggaaagaaagtttaaaaaaatgtattggtcgatcatttgtgatatttctataaatctattgcactatgtcgacgtgtcctttttactgcttctgttcgaaaatgacgataatatagaagttacgttttttcactactttctaactaattgacaaaagaggtcgaaacacatgcgtgtcaattactagttctcaaagtatttcaaatactaatattgtaacaagcactcaaaattttaccaggcatatactccttccgttttcaaattaatgataatgttgactatcaatttttcacctttaaccactttactcttgaatagatagactatgataattaaacaaaaaattatgtgcttatatttaggacgctatacattttttaaggaaaactacagtaattttttttaaaagaataacgagtggtcgaagtttaaaaataaacagtgaccggtgttaataatttaaaacgggaggagtataatcaaatggtcatacgagtgaaccactcttttctaacaattataaatacattcgtaatatatcttatagctagctagtatacaactatatatatactccttccatccaagaaaaaaactttagctagggataaatttggacaagtacttgttcagctagattcatgtctacaagttgttgtttttttctgcattgggtatacatccttaattagcaatatatattaattatgtatactcggatactccatatatacggatatgtatatattcatccttaggttgtgggacctataatcaaccaaagtgctgccctaaaggagaacaaattaattaagtgcactacccaaatttattgttatcagttctccagcgcgatcgacgaccccagctagctagatgcctagatatatagcacacttccatccatcattccataaagctattcattccaataaagctattcttcattccatcaggccggccggcagcagctaggcatggccaccatctcaagtctcaacacagttagttatggtgtacgtacttaccaagcacagagacgtcggcgtcagcagggcggcgagctgccgagtcgaactggcgtttcggtcccaagttagctagcactcgcagcgcccccgcacgcaagcgcgctgcaggccgggaccagatcaatcaaaaccaaatcgcccgatcgggtcgcgccctgcctgtgcgcgcacgacgtcgccgtcgccgcgcgcatgcagcacggccgcgcaaacgcaacacaacgcaaaaggcgtcgttttcgaacgagggggggagagagagagagagagaggagattctcccatccccagtgcgggagcgcgcgcggtggaaatgggagaggccaactgcttcccccaccacttcgcggccggcgccgttgttggtgggcgatgtgacgcaggcgctgtacgatcgatatggagctgagaatgagagattgtgagagagcggtttagtaacgggcaagtcggccgtttctcgcgcgatccggcccgtacgttttttttcgttatctcggctcgatcgatcatgcgcgttttttagaagagggaatcggttaatgtggggcatcgtggcgtgggggggatcgaggtcaggggtcgctggagcgacgtggatgggggaggggcgcaggtgggacgtgcgcgtcgagggttaatggggccgtgacgtaccagtttgatcatcatccggccgggacgatggggtgtgcaagtgcaacttaacgtcgattattcccagggtttagtttagtttaattaggccctgtttgggactaatctattagtctatctattttaatcactttcagttaaaaaaatccaaacaagggtgactaaaagagactaagggcccctttaaattggaggattgttataggaattttggaggatttaatttcctaaggattttttcctatgaaaccctttgattcatagaaaagtataggaaattttccttaggattgcattcctatagctcaatttcataggaaaataagcaagaggttcaacctcttggaaactatcattttactttgtttgtttcctatggtgctatcaaagagaccctcttcatatttcctgtgtttttcattcctataggattagaaaaacataccactccaattcctatgttttttctattcctttgtttttcctatcctacgtttcaaagaggccctaaaagtgcatattgggactaaaatccattagtccctcttggaggtactaaagtggcagcctctctctagagtctttagtctctagatccaaataggaccataatcttgtggtgtgtgcgtgtattagtggaagacaaaaccctctcatagcttgcagtggtcttgaaatccatcctacaagagggccgcttatggttttctacaagcacaacgtcttttgggagtctagtagaacccaacagccacccttcccttttcttaggagcgatttcaaatttagttccccctagcattttttggttattttttctcttgtgtcctcaggcaatggccgtctggccggttgcgtcgtttagttaaactctgttttcttctaatatattgacgtgtaatttttttgttcgttcgcgaaaagagatgattgcatatttggttctttctttatagaaaagtagttgtgtacgttgagacacatatcgggtacagattttgcaggaactactccctcagattatttgatcccttttcctattagaatttatgttgtcaagcattaatttgctattctgcaatcttttgtgtagtttttcataattttttccttgattgccagtttctatcaaaattttatcttctctctttgcgtttttcttttttctctctggtcccgcagaattttattaattccttttattcacattttatatgcttatcttcaaattatatatcagatattgtatgggccccataacaacagcgcattaggacgttaaaccaaactttggaccacagctagctagctccccaagtacacgctggtgtgtctctaacaaaagaagtacacacacttgtgcacggccacgttttgcacactatgcacttgcatagttgcattgcaccccacgcgctcgcatccggaagtccggatcaccggaacgctttgcgcgccgcctcgaccagacgaccacgtaagcgcgatcgagcggcgggctcgtacgtttcggcctggaaatcctccgatctggacctgtctgtgtacggcgtgggtttactgggccgtggtggtcgtggctaaaggaaagagtttgactcccttaaaaagtcacccgaatctaatccgtagccctcaatcgtaaaaccagataggatgactctctaaactattcaaactagtgcaatttgactccctcagcggttttgctgacgtggcggtgttgacccgatcttcatcccacgtggcacttatgtggcattacaattaaaaatattttgtgggacccgtctgtcatttacacacaaaatatactgtgggacccacatgtcatcctttctctctccaacccttcttcctcccccctctctctcccttctctctcttttctcctgcagccgcacccgctgaacatgccggtgtagttgaacccgtgcgccacctcgccggtgctggacaccacgatgagcccgatgaacccttcgtccagccgttccttgacgcagtagtcgatggcctcctgcagcccggcgcccctgtactccatcacggcggcgacgtcgcacgccagcgtggagcgtatgatggccttgccttcccccgacccgatcaacggcgagtcgccgatgcgcccggtcatcttgttcatcagcccgcccgtggacatggccgccgcagtgtggccgtttgagtgcaccactgcgcaacccaccatctccggcgtgggatacggcagtcaaactacttgtaccaattaatcacaggatgtcacggttagatgttagcaatttttataggcgaattggtaacatgagtcaatgcgctgatcgacgaaccaagatgctattggcctccttggcgagcttcagcatgccgacgttgtcctcggtgatgaagtagctattgtccacgacctcaagaccttgcaaacagtgaccacaaagaaaaaaaatcagaccagtccatgacctcaagatctgcaggactcgggtggaccacgctggtaggacggatttgtcctgcagctgctggtcctgccaaaattcgactggattccatggcggccgcgccttgctaccccacaccggcgctgcacttgcatctgctaggcaacgctgtgcacatgcatgttctccgagcagaaagaaacagaggcggcaccccctgccggcgcagaccgggaggcacggctagggccggcggcatctcaggtttcgccgtctacattagccctcccgttcgtcccagcctggcgcggcaccatcatgggggaggccaccggccagacgcccccgccttctccagcgagctgaggccgtcgccgctccaccacctctcctccgactctctgccgtcgccgccgaagccgccgctcgacccgctcaagttccttccttcgcgccagccctcaccctgccgccgccgccgctccagattccgcaccgaatctggaggaagagaaacatacagagaagggagagagagggggaaggaggatagataaaggatgacatgtgggcatcgcaattttttttcatgtgaatgacgaatggagcccatatagttttttattttaatgccatataagtgccacatcaacaacacatatcaggtcaacatcgccacgtcagcaaaaccgccatccaaaaccactgagggagtcaaattgcactggtttgaatagtacgggaagtcatcctatccggtttacttttgagggtcacggattagattagggtcacttttaagggagtcaaagtggacttattccgtggataaatggggctttagtggtggaatgggctgtaatgtagcctgtggccgtcgaaaagctgcgtcaccgttgggctttcgctgacggcctcgtagcgccggccgcccgctttgctcgctcgtgttgctatcaagttcacgttaggtccctatatttgtcgtccaatctgattttcatccctgaaccgtaaaaccggatataacacatccctcaacttacaaaaccagtgcacataacatcctaaggcggtttgaatagtggttttggctgacgtggcgcctacgtggctggtttgactagttctccgtcccacgtggcattgacgtggcgcttacgtggcaattatatctcgaaaaaataataaaaccgtgggcccacatgtcagctaaaaataataataattttaaaatggtggggcccacgttggcccacatgtcagttacaaaacaaaataaatagggtgggccacacgtgtcagtctgtagcgatttctttctccccacttgaccatctcctccaatctagcaatccccatccgcggacggcggttgctgcggtgctggcagcgcacagcacacggagggtaagcggaggggagtgggggcgtggccaggctctcggcctccggggcgcaaagctgccgcggcgtcatctgctccgggcagcgccgcggcgtggctagccgccagggcccaggggctcagccgctcaggcgagcggccacgcacgcgcatgagcgtagcgcaggcagagcagaggaaggggcaagcagggcggagggcacaacagcagtgcaaccgtgcagcaccaagcagcaacaacaagcaagctaactagccactcaagcagattgaaattgtgaactaatagctctgtatcttattaacctgaaataatggactataattcgatgtttgcttcaagaacctacatccacacctttacatactcaccagcgagcgacggtcaaagaggcggggctggtacggtggagccatggtagaggagcggcgtgcgactgcgactcggcggcaaccggctcgccggcctcctcttccccctctcccgccagcacagccggccgccgtggtatcctcctcctcctccgcggtggcggcggtgggcggtgtcgagctcccgtccgcgcgccgctgcgactcggcggccggcggagccaagcggagggcgccagcctcgtcgtcgtcgtcttccggcgcgcagcggcgcgaagctggcggggcggggcggagcgggcgggcgaacggcggcgcgaagccgacgggacggagtggggcagcggcgggcggacgcgccggcggagtctccttgaggtcgtcgtccccggcaccgccgagaccgtggccagagaggggataggggaggaagaagagatggggtgagaatgacatgcggggcccacgtgggccccaccattttttattcatttgtgtgtgaaactgacatgtgggtcccatggggtttaatatttttttttatcgaattgccacgtcaccgtcacgtcaatgccacgtgggatgaagacctagtcgtaggcgccacgtcagccaaaaccgcccttcatactgtcgagggatctcgtttgtccggtttttgtaagttgggggacgggttgtacctggttttgcggttaagggacgaaaatcggactagccaactaatagagggacctaaagtgaacttattccttcgctagttgccattgaactactcccttcgtactgtaatataacaagcttatattcatagtactagcttcaataacaacatattctatgttttatattttagagtgaataggataaaggggacagataggtaagggcatgtttagatctctaccatattaatccattaatagtgctaatatctaggtaatctttggcactgttaatgaattagaatgaattagtaaggtagtattatcagatcatgtttggattgggattaatataaagccaaaatttgcgaagtgatttagttcaactggttcgatttattgtggtggaaccaacccaccggggttcaaatcatagatttgacacgagtgcttacatttacggataattattctttcggtggtagacaacgtacccgactacccgtcgaacgcccatggtgacttcgtcaatctcaagatatgtcgacctaatctttcggagatgctcgtagaggtagggtgtgcgtgtgtgtttatatggtgagtgcacgcgcattgtgggaacttgtatttgttctgtgtttcccgaaaaaatcatagtgaagaaacttctagaatttagctaaataaaacatgggcactatcaatttggttggccttaatccaaactagcacatttactatttatattgctaaaaaaatggttttacacatttaggtatcaatccaaaatgtccccaagtcttttgtcgtttatctcacttgtatatttcttcttcgattttttatactgccaatgtagaaaataaacttagtaatccagttcaatatggacagtgggattgtctacttcttacatcgaactctagttatctctgcaccaacttattctaccgactaaagttgctcagaaattgattctcgacactccttgggatgcatggatatgtaagagtaggatttttttatgagttggaggagagagaggaagagagagagagcatgagcatgcgactaaccagtcgcctgtgatgtccacacaaaagtctttccatgtctgcttccttatcgtcttcgatgtggttgcgaaaaccaagttttttagctagttaccataacaaaacgagaagtagatgtaggttttgggtgaagggacttccacagtgggccaaagtggagtttctattgatgaggtgaatgtatgtgcattttcgaccatgtttagtagggtttcaactcctaaatataactttaggagctaagtctatagtggagttatagagcgttccgaaccccaccctatctctctagtttatttttttcggatcactctagtctgctctgctttcttttcgagtgaaactaaagtcgtttggttgggttcaactctaagagaagtggagctaaagctaaagctttgtcaaacagacctttcgttaccctcagttaggggagagcaacaatggattcctaatagtactccatgtctaaatgcattgattatgaaagatcacagggttagataaaaacttggtaaaaatgaggtatgatgtaagttgtgaatcaaactgaatattgactagatataatataatgctaatctagacaataacattgaacatgaaacaattacacatacaacacagatacatatgacatgcattcgattgctttctatagcgggcagcgctttcggtaacaagcaaccaagcatgttcatactactgataatatattaatttgttttcactatgaatgatatgtgacatatatccaaacactcgtgaatcaataatgagatccattacctctctaaaatctgaacaggcatgcacgtgtgattgtcattccgaatcaaagtggtttctgtcaaacggattcaccagaccaattggcagacccctttagagcatgtataatagcagactataagacaaccagaaacactaatgtgcgattgatcgctaccgcgatgggtagcgatcaccacccctcccccctccctccctccacgtttccttttttggtaccgcattactttcctattttagtaaatttatacacctaaagtttatacgcctaaagtttatagtcccaaagtttataaatcaaaagtttatatattcaattcaaatttaaatttgaattcaaatattttttatagtatctctatacatctaaagtttatacacctaaagttgtagacccaaagtttataaatcaaaagtttatatatccgacttcaaatttgaatcgggtatataaactttaggtctataaactttaggtgtataaactttagatgtatagaaatactatatatgaaaaaaatttgaatcagatatttgaattcaaattcaaatttgaatcggatatataaacttttgacttataaactttaggtgtataaactttagatgtatagaaatactatatataaaaaatatttgaattcaaattcaaatttgaattggatatataaacttttgacttataaattttggtctctaaactttagatgtgtaaacttgaggtgtataaatttactaaaataggaaagtaatacggtgccaaaaaaagaaaaccaggtggagggagggagggggaggaggggggcctaccgatcgctaccagatcggtagggcgatcgatcgcccattagaactaccctaagacaactataaacacattttgagaggataaaataaaagagagaaaagtagcggactacagatttgttgccagctgtagcacgaactctaatatgcatgtgtgtatgataggtgagtccatatattaattgtatagtatatgtttatatatagctatggtataaattggctataaaattaactataattcatttggagcgggtagttggccatacccttgctattatacaaccctaacttacactccaactaccacggtaggaaccaatcacaatgaggggcttacataccggacccacaaaagatagcgcaaagaaaaatgggatcaatcttgaactgacaaagagggcccacatagcagccagacacgacttgtggactctgccaaacttaaaccccagcaactcggcttcctcagccctgcgctgcgttgcccccctcctcctccgccgccgcctcatcccaccactcgctagtccaatctcggtctctccccgcgccgccgccgccgccgcgccagccgcccctccccccgcggaatgggcgcgcaggaggcgtcggcggaggaggcgctgcgcaccgccgcggccgaggtctccacctgctcgacgacgcgccgcctccgcctgttccgccacaccctccctcatctcctcgccaaggcgtcaggtacctacgccgccatcgcctccgctcccccctatcccctggatcgcgcgtgctccccccttccgtccgcggattagtctccccgtgcgcgttcgcttgctcccgtgctcctaccccccctttttttttctgcgatcgagaaaattctcggactctgatggcggatttgctttgatttgtgggagctagggctcatcgtcccgcgttgcgcgtttgcttgttcgtgtggttgcccaattccgttttacttgtagcggatcgtagctcgttagcttcactcgtctgtgaatgtggtcgctatcctgtgtagattgagaataatagtgcttggttttgctcctcttttgcatccttgtctcgtgttatgccatgcgatctgtagtgttattttagttgcttagattacagttaggtcaggactaagcagctacgtagcttctggagttgcttgctgttgtttcatcctgacatctgtttagtagttttgaaccaagagaatgcttgtatacattcgtgtgaagctaagtctctgcttgcttccaagtggttccgcaaagcaccattgttttgtatgtatctcgtgttggtctgatctgcaattataactgaattgcatcgcgcgttagtcctgactgcaagggaagttggttcgtgtgcactcatcatctccctttttctactatctgaccaaagcttttattatgataagcgattaagttcacagatgcatagtgtaatctgagcctcccttgaagtacctgcattcctgatgcagagcgccagagcatatgcttctttgtgttgactagatttgatagtgatatgtcactctaagcttaatacgttggacatgcttgttgaatataccaaaagtgaatatgatgctacaactgcatggtctctgttaccatgcagtgtatatgtttatcacacacacttatgttacggctgttcatgattctctagaaaacttgttgcaaacaaaccaaggccgctgaactgatgtaatagatccctacaccaccaccactaataagttaataacacacacaaacacatactttccttgctacgcatctggctgatacaccttcatttcattatactattccatgtataagatcgatgcaaagctgtttttcttaagattgctttgtcccccctgcagagtcaccatcagatacaacattgttagttgatctcattttccagacattgcttatatatgatgatcgggcatcgagaaaagcggtcgatgatatggttatacaggctcttggtgaatctactttcatgaaaccctttgctgcttcacttgttcagtgcatggaaaagaatatgaaggttacaagtcctcttgcatgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40543 - DNA, 758 bp, Oryza sativa
gagctccacatactcgcccccacaccccccccctcccccgcaatcggcgttgctgttgggatggaagggcgcgagggtggggagctcgggtcggcgtacaaggccgccatgctcaacggcgtcaccgtcgccgtgaagcggatgcgcgacatgaaccgcgtcgagttcgaggagcacatccagatgctcggtgacctccgccaccccaacgtcctctcccccgtcggctaccattatcgcagggaagaaaagctcatcgtctccgagttcatgccacgtggcagcctcctctacgtcctccacggtaataataatgacagcaaatactagtagttcttaatcaactactaatctcgattatagtttgctaattacgatgtgtttgtttgttggttaaggtgaccagcgcccggacagggtggtgctggattggccggcgaggatgaggatcgccgtcggcgtggtgcgaggcatggcgtacctccacgagaagctggggatcccgacgatgaggctggtgagcatggacggcgccgacttcgacgccatccactcctgccgccgtggacatctcacactactcgccgtctgaggtctgcaccgcctccacattgagctgcccaccggcgagctcggcatcgaggacggcgtgctcctcaagtggaaggctgacttcggcgtacaaggccgccatgcgcaacttccatcccaacaacaatgccgatcgaggggggggggggggggcgggagtaggtgga

SEQ ID NO: 40544 - DNA, 768 bp, Oryza sativa
ttcctgcaccccatccgctccctgcaccgccgcgccatgatcacatgccagtggttcttgacggcgttgtccgtgcggcccgggaagagcctcgcgatcaccgcccaccggttgccgtgggcgcggtgcgacgcgaggaggagctcctcctcctcctcggtgaaggggctccggttgattcttgggtcgagctggttgaaccacctaagcctgcagcttttgcctgaaaaaaaattatttgtcattttcaggttagctctttacgctatgtagtttttttttgtgcttggtgacacaccattgcagcatgaggcttgtgctagaaattgagaaggtaaaaagcacggatgaattagagagcaagaaaggttgtaaatcaattagtaactagctctagtagtagctctagctcgacaggagagatggaatatattgctctacaagagatatagatgtgatatacacatcagagcagtggacatcatgtattgatgaactgtgtagattgcacctctttgacatgacactctaacaaattaaaattctatctgatcataaaacgaactaaaacacatgccaaagcctcaagtcaaataaacttgctcggatgaattgcaccacgaagaagcaaaccgtacaatgaaccgactcaacccaaagatcgatcaagaactcaagtaaataacacacatatatatcaatcgatcgattgatcatttcttgagcatatgtagatatgtactactatgtgtatatcatgatggcaca

SEQ ID NO: 40545 - DNA, 1053 bp, Oryza sativa
cattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgtcgttgtcagggttatgtatactacatacctaatagtag

SEQ ID NO: 40546 - DNA, 1048 bp, Oryza sativa
ggattcttttgggatttggatcgttctcacaccccgattaggatccaaattttggacccctgacgcatactgagaacatccatcccgacatcatgtgttccagggattattgatcacggatgtctaccaaggtatcgagaaaacaacaagacaaagatccaactaatatgcttgctcctgacgtgtacacatgcatatgcatggactcagtacgtgcttaggcatgcatgcattagttggccgacgtgtacctgcaaagaagaccaacatggctgtctaaattgcaacgtgttgattattcagataaatcaacggccgcccgtgatcaggtatttagtagattgattttttaaaaatggtctactaatttcgtagatacatccggcatgtatctacaaaggtacgcaatattttatatgcaatttatcgtacctattcagatgatacagcattgtcagatctataatttattacgtttacctagagcatgttttttatacaatatctattgcgcggatgtttccgacgttaaaccaactacggtctaacgctgggggctcactctgttttcttctgtataaatcatgcttgttcacggtttacataatgcttaatatttgcatctgcttgttgtatcctgataatactagaagatccatgcagttttttgagtacatactcgatattatctgctatatatcttgccttctaaaaaatatttttcaggaacaattgagcactcgagtaggttatggtcgagtacactccattatcgagaacattttcgacaaatgcggagttatcgcacccaacctaccaacaaagaccgacgacctatctcatagcatctgccatggctagactactcgagaaaaggttgttaacggataattcctcgcgaacgtcgtcggcctgatcacccgacatgattgcgaacggacatccggatatgctataagttgggtacgtgagtcatactagccacatgagaacacttgcaataaaccaactctagcacttccattggtgttcgagagataattctgct

SEQ ID NO: 40547 - DNA, 16162 bp, Oryza sativa
aattttcaaaattgatcgttattgcttagacagctgtgattagttccaggaactcattcagttcatcccacatcctgcttctcagaagacattatctagtatcttgtgcaaggaaaacaacgatgcttctcggtatctgaaagaacatagtcatagttagtctaacgaaaaggtaggaaaagtatcttaaagatacaaaagaagaaattgtcatgagcagacgtactaaaccatgtaactactgactgcagaaaatatacaattgcattttggacattcatctaactcaagtgcacggataaattggaaagatgaaaagttaatcatagcattatgccctctgctgtccaagctgtattggagaatttgatggtagaagtatgccaatgatcagtaacttaaccacaagactgcaaggagcattcccaataggcataaacaaaaaatacacatggaagatcaagagtgtataattatgtaatacccaccaaagtcagtggctacctaagcacagggacccagtgactttaagagttaaaatgattcaagtgtaatgaagattgctttaaagttaacatccgctatactcttgagacttcctattttagtacatcagactacaaagcatggttttcaaaaaaaaaacatcagactacaaagcatgcattttttctgttggccacaattacaatttagcaagttcaaataaaattctgatttttactgcacagatggtacactggtactgcatgaatagtgtatcagaagatactgtctttgaagccccgatcttctgaaggaagttatccagttcagaatacacataatttcaagttacgctgtatctagacagaatcaatggaactgatggcaatattacatagggctaccgctctaaaatctgcagcattttctattgataacaggggcggagcacaatggaccagggggggttcccaggcacctggcccaatttctaaatttactgcttaccgttaagtttcaccataggggcaccccccttggcccaactcagtgtaccccccgttggcccatacgcagaggagaaggctgagaataggctgctcgctgagatcgccagcactcgtcctcgatgccaggaccgacgcctcgatcacttcgttcgcagagacccatctctctttctcttcttttccttttctctaatcgccatcaggaccactcgctgactcgtgttaatgccctcaggcaacagatccgccgtcatcccatcaccgtcgacatcttctcttacgtgtagctggaggaaccgatcgatcagcatggcaagaagcagttcaatccacttgctaagatttgctcatctaaatatgccacaaaaattaaaggtatcgatttttctcctcttatttctgatctagttagtttgattaatttgttccaagcaaatctcaaagttaaatagcgttgtttgaactatgtgactgtttataattctttttttttcatattagggtttgaacaattcaggatacatttttcatagatcgattgttttttttatatttttttatgtttccctccatggcttcctttcatcttttatttcggtaagcacttttcctcgctgctcactgatgttgtagttaaaagttgtctaggaatatttaaataccattatctagagtgttatgccaccatacatatggcaaagtggtgcacccccctcaattgtgctccagctccgccactgattgataacaccataaagcatcggtcttctttcaaaaagagataaaacataggtagcgttcttcgtgttgcaatatggaatgattgacaaattttaacgaattcaagttaccttagcagcaaaagttgtccttagagaggcgtggtaaatttgatagccttgagaattctattttccagttcattatcagcaatccacacagagctcttcctgcccaagagctccctgtcctccgccctcttatctgctttgagcttctccttctccctccagttctccagcttctcacctcttactttcatctgtacatcatctcatctcagttataaagtcatttcgctgatatttttaacatatcgtaccagaaaaaaaaattaaattagtagattcatttctacaaacaagtaacgtaattcacttgatcctctaaaaaaacccgcacggtaatcgtaagactcccactccggcaattcaacaagcaactcatgtgcaacgggtgatcaacgcaaaagaagggggatgaagcgggactaggagggatgtttacgagggcttgaaggaagtagtcctcgaaggcgcggcgctcggcggcgcgcgtctgcgcggcggcggccttgcgctcgtcggtggcgaggcgggcggcctcggcgcgggcctccgccctgcgctgccgctcggcgccgagcagctgcgcctcgtaggcgtactgcccccgcagcccgcacgtcgcgcgcgtagcccttgcgcagccgctccagccgcgcccacgcctcgcggggatccccagcgggctccccccagctgccgaggtgctcgctggggttggagaactcgtgcggctccggcctcgccagggcctgcgcggtggcgtggaggccccggaggagagggcggaggaggtggcgcggccgggaggacgagagcgccatcgccgacgaggggacaggggagagatcgccgcggcggtggccggcgacggcgagttggagcaggaagcccttcctgtgggccgtttgatcatgttctgatggccagctcggcccatgtaaagcccaacaattttttccttgatgggcttaatctgagaccaatattacgatactgtttaagtgtagcaattttagtgcaacctatattaagttgtgatccaaattcatttgcacataataaaggccagtttctaccggagtgaagcggaggtccgtcgccagaggcttgttacgaatcgttatccttttagggtttcaccttcatatatacctgttataagccgttgttcggtgttgttaacctcaccccgatataatgaagatattttgctggctggcgcccgtggtttttctctcctgttttggaagggttttccacgttaaatctcgtgtcttctgtgattgatctcttgttatttatcgtttatttgcctatcgcttcctaacaacctgaaaatataagttctaactgaaattggtctcaacatattctggaactgcagatgctgcacaagacgcatgcccatccaagatacccttctttcttttcaggattcagaatgcatcatgtacaaacatactaactagtgcaagtctattttcactgtttcagttctgttccggtgaccttattaaacctgatacgtcttcactaatgaattacatggtaaatttacattaaaatgatcagctgccctacacttatacactaaaatgcaggagcatcaattacagaatagatgcgtgtcataatgccaattgtagggattgaaggagcaaatcagcaaagggaatctgatgctacctctgcttacatatcccaggctcatccaattcagttgcatcttatcgacattccatcctattactactataataatctgtgaattcatcgcgttttccaccacctgacaccaattttttagcttttgcatcaagctctcttccagctttccacaggtagttcaacccaacaagcagctcaactatggcagcctcgctcttcttctggtcagcaaaatgcagcgtctgcaggagcagcacacctgtaccgctcgacgcaacatttctctgctcgaaattcctctccgattgccatcgcagcatgttgtgagccagcggagctaaccatccgaggatgcgctgcaccgtgccagaccactctgcagccatggcaggatcacaagctgaagaagaagatgatgaagaggctgccatgttcttggcgatcggcctgaggcgagctctgagagatgcccgaatccgatcggtgagcatgttgtacagggcatctctctcgtctgggcagatatggcgaggcgcgacggcgagcttctcgatgaagatgatgagattcgcgtaatgcagggccagcgccgcggcgccgagtgtcgtcaccgcgggcgcgttcatcacccagttgtgcgatgacgactcgaacactattgagagattcgaatttgtgtggtcgccttggaacggggaattgatgctggaataatcgtcgttgctggctgacacgtagtagctgaagctgagtggaagatcaccatctccatggatcttccacctctcgctgtccggagacctgctcccactgaccatgcagccgatgaggtgcttcccggccattggccatttgagttgtctcaagctctggctcctggagacaagaaaccgacgaacatgttcgccgccattggagaccttgccggattttgcatcgagcaatgatctccggggagtatgtgtatctgcggcgaaatctgaaggatagaccaaggaatgcacgctgccgacgaaggaattagtccatgagaggcgggtggtggcgagcgagatcatggcgtcgtcgtccatggtggcgacgttcttgggctccaggccgaacacttgggcgatcctcgcgacgatggtgaagagcgacctggcgaggaggcggacggcgtagtcgaagctccggttccacagcgaggccgcgcggaggcggtcgacctcctgcctctgctgcgccacgcggcgggcggcctctccttctccgccgccgccgctcgccgcgcccttccgtcgggtgcctgatcggcgcaggccccccgcggccgcctgctcgagctcggcgagcacgtcgagctcctgggacaggagcgccgtggacgccacgagccgctgcatcttccgcgccttccggtccatcttcctcgccgcggagtaccgcagccggtgcgggtcggcgagacggccgccacggacgagggcggcgaagagggcgtccaacctgcggagcagcgggtcggcgcacctcgcggacagccgcgcgacggcgcgcgagaggtcggcgcaggcggccgccatctcggcgagcgcgagggacaggagcgccgcgtcgtcgtcggccacgagcaggcgcacgccctcgaggcggacgcggtccccgcggagccgccccacctcggcgtccccgagcgcgcgccacagccccgccgcgcgcgacatgagtgccgccacctcgaacgccaccgcccccaccaccctcctctccccgccgcctccgctcagcttccgcatgtcgtgacgcgacgtgggtgggtgcgtgcgggcagcgcgcggcgcgagtgggttttaggcgaggcgacgaggcgaagcgaaagcataggtggtgtcacgggttgcgtttgcgcggtgggagttgaaaccgagtgaggtgggggggggggggggggagattattcggtggatcgagaagttggggtgatttgggtggattcggcgtgcgtcccgtcgcccagcgctgcgcagcagacggaggggaactattctaacctctcgaatatcgttttcgttatttgcatgtcattatcttttcaatatttacatgtaattaaatagtgaaaggatcttgatatcgtctaaaggggtgaataggcgatttttaaataaatacggaagctaaaacaaaacagggtcggattgtctgatatcaggtcggatagttctatgtgatcggatagtctgaactgagatcagactatctgacctgcacaacaacaatacaaacaagagaacaacctaagatatctagattcaatccacaagcaaagaggtgagctcaaccaacaacaatattagcatgccacaaagcaatgcaacaagaaggtaaagagagtgaggatatcaccgaggtttatgcgccgatgtatttcccggagttctaatccttgaggggattctagtctccgttgaggggctcgcaaagagccgggtctttttcaaccctatcctcgtgaggttgcacaaatggactcctcctttcactaagggtatctctttccttgcggaggcgagatccggccttcacaaacttctcttgaacaaccacacgtagatcggtggcccaagaacgacacctagccgtctaggagtcctcaacctccaagagtaataaacaccacacaactcttggacaaatcctagtgctcaagatcaaaagaaatatacactagactcccaaactccaaattcacacacaaagatccaagtcacaaagaacaagggggatttgagatagagagggagatagctcaaagatccaaagcacttagcacaaagctcaacccaaaacaagatttgaataaaatgagtttgggcaaccctagaaaaggggttagtggggggtttttatagatcccccaaaatgtgaccgttgaaggggaatctttcagtccacgtcggatagtccgatattttaaacctccaaggcaaggagaaacagagaacgaagtttcatgaaatttcggattttccgagacatcagactatctgatattaaatcggagtatctgatattttagaagcaaaaacttcatcttcaaacagagactcaagttccatgaaatttcggagtctctgtatcattggactatctgatccaacatcggatactccgacacttagaaaaactcactcgaaaggatttttcaaacaaagacagagagtgaagttctgtgaaaaatcagatagtccgatacatcggatagtctgatttcaaatcggatagtctaatgttgctcaagcaaaaatgcaataactttttactctgaactccgatttcgaagatcttggactctatggaaagctagtttcgtgggctatcaaacccaacataaaacatggtccaaaaccttcaagagatattgaaaaacttgcaaagaaacccggtgtaagtgttgtgacaagtgaaacaactcgggattaaaaattttggcttaggtttttcaactcacacaaacatgaagcattttgagcactagtatttaaccaattatatgcatgtggtatccctcttaatagtacagcatcctaaactcaaatttaaaaagcaaagttataccaataggagtaccttcacaccatattgattcttcacttggagggttaccaacgtcaaagtcatttgatcatcgggaagatctcatcttcttgatctttgacatttcatcttccatttctcaaatgattaatgtggataatccatggcttcaaatggcctcgcacggttcatcacgacacagtattcactcgcccttcaccaccggtttcggttcgtcggcgccaagccccttgcttgcccttcaccaccgcatggtccatcgcaactgagcgtcgcttgtgcttcaccgtcttgccataggtagtcacttcatacccgcatcttcaatatcttctctttaattctcatccatcgataagtctatttcctagcttcttcataggactaatcacttgcttatacactcaataagtgcattagtcccttaatcgtttgtcatcaataaaccaaaacccactaggggcatagatgctctttcaaatagttacaaaaaatataaaaaaattaataatatatattatgtgataaattactccacaaatatgcagtataaaatttaacttgtgcaagttacaacgaaaacaaatttaactatgagaatacgttaactgatcgtagtttaatttgttttaatttgcatatttgtggagtgatctatcatatacttcctccatatgttattctataacgtcaatgactttttgacttacatttgaccattcgttttattaaaaaaatattatataattataatttattttattgtgactggattatgatcaaatgtttttttaagtatgacataatatgttcatatttgcaaaaaaaatttgcataaaatgaatggttggtaaaaagaaaaagtcaacggcatcatgcactaaaatacgaaaggggtattaataaaataattttattatttcataattatttgataacatgcacctctggaattcaggatccactacccagacggaggcgatgctctgttgcatggctgtgttgtggtgcgggagggagggttgggatgttcgccgcggcgcggggattccaatgatggagagggtggaagcggacagccggttaatttgttcgtctcggtggcaggcctgccactttgatcgcctctttgactggcttatattactgcacggataattacgagtttatcagtagtggagacgggagagtaccgccagtacaatttacaggttttgatgctggtggatttggcgatttccccgtgtctgtgtcatgcggtatgatgtgatgcgtccaaatttaaagttcggtttcatttcttgtgtgtttgtgtgagataccggccgaagtgggttcgattattggtccatcatactagtacagtgtgtgcgatactaacacgttagtgtcaaatatcagtgatctaggtaattattaagtccaaagtatactaataaatccttctcactcaagtattttggctcattctttcttcattttatttatttttttgctatatactttggctcattcgatatcaactaacccaatgatgtactctgaattatttatgtcagttttggatcaccttcgataacaataagtcgtatacgtttgtagtatgaagtatcatgaccctttcgaccaattacaataacaagtttgacatgatgctatataaaaaacaaataaaaaatatgttaactctcatgcaagacttagcttttcacatatttcaaagtaaatggattaaacaggtaaagagagaagagaagaaaattaaagacaacattatatatcatctattatacatatcagtttcaacattagtttcaaccttatagctaatagttagctctactattaaactcgttgttaggtgctacaagcctacaacataatactccatccgtttgaggttagtttgaggttataagacgttttgactttgatcaaaatcaaactactttaaatttgagtaagtttatgcacaaatatagtaatatttataataccaaaatagtttcattaaattaataattgaatatattttcataataaatttgtatcgagttgaaaatattattttcttttctacaaacttagttaaatttaaagcaatttaactttgataaaagtcaagacatcttataactttgaaacggagcctcctaaatccgaactgatccaaaacataacgtcactattggccctgataaatgataacgcatcatccttcggaaccatttcactcggtggatgcctgtgcgtgttgttgacctatttgactggctgcagagatgattgcaatcaatttttcaaaactagttttgatgtaagaggatttggcaatttgccggtgtctatggctaatggcatcatgtaaagcggccaaatataagatcatttctaccggcccaagtaggttggggtatagtaccagactggtccagcttgacgaaagaaagaacagttaggacttaggcaacggcaagctttctactatataccagtagggtatatataactataggtatgttggtctgaaaatgtgtgcaatactagaacatttgactacctgttaagagaagggttaaagttttaagcctcaaacatcagcgagctaaaattaagttcaaagtatatatggtaaatcactaacccttccagagtgaatgttgaatggccgaatgattatgatagttattcgagagcggaaatgaataattaagtattatagagttaaaaataaattatatctcagagagtcatatatataaagttattaaaaaatacaccatttagaattttaaaaagcgtgagcattttatcattccattataaggtgagaagagcgtagagtacagaactagctcattcgaaatcaagtatgtaactcgctacagcttaaactaatatagtgatgtatgaattcatgtcagttttggatcaccttcaataaaaaatatacttttttatatgttgctacctacgcttcctaacagatccaaaacctaacatcaccattgtccttgatgtatcatcctctttggaaccattcagtagcggtgcaccgtctcaccggctcccctgctcaaccagaaacttcttttttttttgcgggatttaaatcgttagtgatccaaacaagccataaactaaaactcttcttcgtcttgtttgttatattaaacctcaacaactttctaaggttctatttaggcctatttagcaaggctctaactctaaatttaagttaaagattaggtctaaagtaacctaaaccacagcttcacatctctagtttattttatgatagcactttaaccagttccaattccattttagatagagctagaaatgttagttggagctagagcgctctaccaaacaaacccttagaatagctccagatcttatatccatgttggatttagagtttgtatattaaattatagtgatttaaaactttatattttatataaaataaaaataaaatgatttatatagatattatcaatgatccagatctatgaatttgtagaactaggaatactcagctctaagaaatatttgagttgtgcctaacatcccctaaatcttgattttccatcgaataacgcaacaattaattccctgtctaccctcctcccatctctctcgttttcataggagacattgtacacatatttcacagaaaaaaacacactcttggctcaaaataccatgctgggatatcatcgatatcttcattcttcatgaacagaccatgcaaattttaacatagcatctttcctcccggaaaatttcacgcaccaattcgaaatgaacgagcgagccatgcggcctcctgggcccatccggcccactgggccggagaatcggtccaatcccacgacgcgatcacgccggcgccgccccacccccaccccacggtgaacggagccgcggccgccggcgatcgaggcgggccgccaccgccggaacggcagaaacccaccattgattcgccggcctcgtcaatcgcccggttccgttaccctcatctgcggcggactgtctccgtctcctccccaagtcgtggacggacgcggcgtcgactctcaaactcctcggctaaatcggtgagacggtgaccctctccggcaatcacttcccacaaactcctccgctcctctcatcttcatgcttgatactaacacagtcactcaacattgtagcgaggttgatgatgctgatccggcacgatcttctgcgtaatcttgttctccgatgtctggggaaatcaagctaggtgttgccggtacgtatgctggtctggatttttctttggggtggcagcaatgcagttcccagaattcgttatgaaattctctcgcgccgaatttaaaattcggtgttctgccgatcattttgttgccatattgtgtttgtgtacttagcataatggttcggaaatcacaggttgatctggaaatgcagcaatgtgtttgccaccctgaattcatcatgatgactacatttgtttcccctttctaccactaacctctagagctaagatgaacaccttttgtgacttgttagaagcatgaattttactgatgatagcacctgtgaaaacactaaggattatagaatgaataatggaaggatatattttgtatttgcatatgaaatctcggttctcactagatgcttaattgaagttgttgatcttggaccactctagttcagtagttatgtttgtttatattttaccacacatgttgcttgcattgtgtattgcggtattacctccgttttgttcagcggagtgatttctgaagttttgcgtcattcccagatctgcactatacatagatcagtttatttattttgtttcagatataaaataacattagtttcattgttttgtgtcagtgaaagccgtatcatagagtcctcatcctcattatgttatttatagaccaatattttttcagcttcaagtcagggtgtgtttagatccacgccaaaattagaagtttaaagaaattggaacgatgcgacggaaaagttaaaagtttgtatatgtatgaaagttcgatgtgacgaaaaagttgaaagtttgaagaaaaagttagaatctaaacagggcctcagttggaaagtacaaactactgtatattacattgaagtcactgaaatatttagtaattgggtgagcgcgatcgccacatgtactatatacatcggcaaggtaggaggtaaacaaccttttgcttttactgtgaacatagatgcaaacccacaggtatgtgctccacatttcattgaatatattgtatactcgaccttagcgtgaatctcaaaacaatactaataacattttgaggaaatctataatagctagcgtgatagacatttttttttcacatatatatcattatcataaagaaggtatgcattttctgatctgaagtcatgaaggatttctcttttcttgagttaacatcgatctgttaactcattcagtaatttttgtattgtccccagacctcagccaagtgggggagcttgttggctgggaagggtgcttgaaggtcatgtgaaaggttagaaaaagcatcatatgatggtactctaggtctgaattctctgtttgttttcactttaattattatctggcagctttataattttggttcccgtattgttttcacttctttagcatattaaaagttgtaaacaacagaggtgtgctagctgcttcctctcgtcctgttttcttttatatctacaataggcttgcaaaaaagtttgagatcagaattccccccttccttgtgttaggataaaataccaccatcatgcctaatttaatcatgaaagccttatcggtaatcaccctattagtattactactattaaactttgggcggcgagttttggctccttgtgagtacttatatcaagcaaagagggctatcaattgatccatactccacatctgccaagtcaaatatctccaaaaacttcaaggatagtctttttctgtcttttttatttctagtttttgtctaccaaaaatgggtttttcataaacttgtcaggtttctaattggtctgttttagtattaagacacaaatttcttttcgagaatacatacaagtattgcgcatctttatattaagacttggggattcacatcaagtatctacacacaaaatcactagtaatgtacgatactatcacaatattttgcattggttttcatgtcgattacacctgtgtcattagtgatcctgcttatgtgggtttggctgaacaaaattatgattgctcagttgttgagatcaagtaatagaaagaaaatgctgttccaaacatttatctgaatagaaatgattgagggaaaaaaaacttaaagaaggtcaaaattattttctgcgtaacaaactaacaactggcaacattatcacgctgaaagtaaaatttatagtagcacatttatcctgttatgtgcatggcccatgtttgcatgagttgtaatgtccttcatgaatggtgatgtccatatggatggcaactgtgttttacaattcctggtttcagacgaataattcctactaacaactaataaagtaagtgcagtaatgaaatacagctcttttgcattgtattttgtttcaattatcagagtatgatctatctttttacccttttcctcataaaggtttccatttctccacaaacatgccatttttgggcagatctctgatcaaatttttgaaatgggcatattgatttctaattaaatattttatacatgtttattttgtttagcaaatacttcctccgtttcacaatgtaaaactttctagcattgtccatattcatttaaatgttaatgaatctagacatatgcatgtgtttagattcattaacatctatatgtatgtgagcaatgctagaaagtcttacattgtgaaacggagggggtatgttataacaggattattatatttagaaaattatttcaattttgaaggggaaaatgtttgtgacagttataggagatcttgcttctttgcaaggtacctattccaaaaagatttggaatagacactaaccgcttgatatgaaaaagctgaaaacaataggcaaatgaatatttggtaatgtggcctgaataatgttgtttacatgggctgtgtttagttcccttcaaacttccaacttttccgtcacatcaaatgtttggacacatgcatgaagcattaaatgtgaacgaaaaaaaccaattgcacagtttgtatgtgaattgcgagacgaatcttttgaacctaattacgctatgatttgacaatgtggtctacagtaaacatttcctaatgatgaattaattaggcttaatagattcatctcgcagtttacacgtggaatctgtaatttgttttattattagtctatatttaatactttaaatatgtgtccgtatacgtaaattttttttaccaaaacaactaaacacggccatgctcaagtatctgaaatgttgtacatggaaaaactgtagtattcattctgaattgtttgtgcatgttccagtatctgaaatgcaataaatgcaacagttattactagtgcattgcgtatccatccttttgatctgcacttcacacatttccatctttcgcagtagatgccggcatgccgcagtagatgctgcagaaaatttgctccagctgctgtacagctccagagttacagctgttgacatcattgtttccaagtaaaattaaaggaaactgaaactccctctcccatgctctcttatatacaaacttccctgcaatttctagtgtagagcatatgttttgatactccagtatttccttttgcttctttgccggaattatcgaaggaggtcattcaatataattaagatagaaagaaatgttacaagaaaagttttacatcaacagctggctgtcgagaaaggatgtgcaccagagcacacgcttcgaaccatgtgccaaccgtccaaacacgctacagagaggaagccaagcacggaaccggccgtcgctatgcgagaccgatcaccaccgggacaacaaaccaccacggcgcgaagactctacaacgacaccctcacgagggtcgtgacgccgaaagacgccgtcgtcatccatccaaagaactggataaggttttcacccagagctcctttccaaggaaggagggggtacctcaacaatgccctcaggaggcttaccacgcccgaaagcgtggtcactgttggcccaaagaaattgggctaagctttcgctcgaaatcccctactgccgtggtccgtcgctcaatccgaatccaccatctaacaccggcggcacatggcttccgccacacctgacctacgcccctccaccggccgacttccagtcctgccaatgacaagactgccatagcaccggtcacctccgccagcgcgctgacccaggctgcctccgccacgccgctcgccggcctcccagtcgaatccggcccaagggtgcctggacaaggaacaacattgcctcagcaaccagagttttccttgtagaccgaccaccaccttcatcctgccaagaagctccccacagagaaggggaggagctccccaaacagggttagcctgcccgaccgcaaggaagacgaccctgccgccagcgccctttaccacgccgctactccctagcacgctgacccaggccacctctgccacgccgcctgtcggcctccacgtcgaatccggcctatgggatctgaccgggaacaacctcgccttggcaacctgagtcttccctgtaggccggccatcgcctctacccgtgcctaaaagctccctataaagaaggggaagagctccttaaatatagtggtaacctggccaaccacaaggaagacgacctcgccgccaaacccaccgccggccttgtcgatgccaccactccgccgccaccttgccgcccaccaacggccactcgggccactcaacgtcgtcggtcgagcctccaagccacatcgcggcggccctaggccgc

SEQ ID NO: 40548 - DNA, 2510 bp, Oryza sativa
cgctatccacaaaggttcgtcgcgccgcccgagcctctgaccgctgtcgccgcccccaccatcgtggacaccagatccgctgccggggggtggatccaccgcgccggctgccagatccatcgcgccaacgcccgaccgtcgcctcccgcttctcgctgccgctaagcaaccccgatgtcctcgccggctgggtatcctcgtggggagagcgccccgcagccgccgtccttgcaaccgtttgactttgctggcgagccgctcgggcggcggcgagtcgaagggggggaggtgggaaggggtggcgggggagagtttttcgccgtccatgtcgcccctgggacgggagcgaggtggatggaagcgactcagagaatccttactttagagcaagtttaatagtatagccaactattggctccaaatcatctatagctaatctaatagaccattcatataataattaactataaaaatatactacatcattaatacccaatcccacttgtcatacacacataatgtcttggagtccatgttgcagctaactacaaatttgtagcccgctttcttctcttttcttctcgatacgtggttatagctagcttatagcatgctattgtacatactcttagtggttcttccttttgcttattagagcaggtacaatagcaagctataagccagctgtaaacatattttaaagagataaaggaagagagagaagagcagcgggctatagatttatagccagctgcaatacggactccaagacgtaatgtgtgtatggcaggtgggaccaggtattcataatatagtaagcaactattgtatgaattggctattagattagctatagatgaattagagctagcagcgggctatactgcaagtttaatagtatagctcactactagctccaattcatctatagccaatctaatagctaattcatataataattgcttactactatactattagtatatggtcccacctatcatacacacattgtgtcttggagttcatgctgcagttggctacagatctgtagcccgctacttttctctcttatcttttatctcattaaaatatgtttatagctggctaatatatagtctactattgtacatgctcttagctcttagagttgtagtctggtcttttgattcctttagcattttctttctatggatgatactagcaggtataataagggctaggatggcatcagtggccttgtttactcagatcatttcattcgttttacagcaacgaggatttcgtgcttttacagttgcagcacatcatggatttgactgggattctttattgttcactttgaattaactccagttttactgatcaaccaaatgaactttcggtcttaccccgtcagaagcctaatggacagctgtacaggcagagtttaaacaaaaacagaattgtttcgctttgtcaattgatgttctcataaagtactacacttttaacagttctcgtactgtacgagagtctcatttggagactgccctgaaggtttactgtaaccgctggaaaatgaatgagggcctatttgggaaacagggacttaaagtccctgtcacatcggatgtttatacactaatttaaagtattaaacatacactaattataaaacctattctataaccttggactaattcgcgagacgaatcttttgagtctaattacaccacgatttgacaatgtgatgctatagtaaacttttcataattatggattaattaggcttaaaaattcatctcacagattagctttcatttatgaaattagtttttttattagtctatatttaatactctaaattagcgtcaaacattcgatgtgacacggactaaaaagttttagccccatctaaacacccccggagtaaacaagaatctgcttttgatgcctttttatgcaagcctgggaattttaaagaggaaggagcatagggaaagctgctctccttgaggtaagaaaaatgtgtggatcctttacttcaatttcatttatatatggtcccaccattttatttcttcacacgtcaatgtctgtaaaccccacatataccaatacaaaataagaaaaattagaatactcatactttattaactctcaatgaaatcattttctacttttataaattctaatacaatgattacttaaaaatatatatttatttcgagataaatgggatgaaccacaaatgaacgaagaaagtaattaatagtagtctctctggtactgtaatttcttaactttgactattaattttttttaaattatttagtttgaacacactaaacaatacatacagacgtattaaaaatatatccaaaagctttgtataagaaggaggaaatatgttttggagaccatattgttcgggaatactctctctgcttcactactaaagtctgaccactaataaaatgaaattgtccagtcaagattgattaatttttatagctttatcatgcaagatg

SEQ ID NO: 40549 - DNA, 18089 bp, Oryza sativa
agtagttaatcgcagtgcaataaatattgctcaaagtaatgaacttcaggcacattctccaacgtgcttgattttctctttactctggaaatatgaacaatgattaaaaaaactggattgagggagagagtacgtccacattttcattcaaaatttgaaatatattcgacgaatttctaagctctcacaacctactcgttagagttaacgagcaagtataatagcatactataaaccatctataaacacattttgaggagataagagaggagagagaagagcagctggttgcatatttgtagccagctgcaacacggacttcaagatgcatgtgtgtatgataggtgggactagatagtaattgtatagtatattttattggtaactattgtatgaattagctattaaattgactatagctgaattggagccagtggtaggctatactattaaacttgctcttatgtgtcgaactttgatcaagatcggttgaaaacttaatttttttaagatattgcaagattcatttatcttgctgccttgttggtactcgaactttagctccaaaacaagattgtaaactacatgcgattttgcatgattttcatataagacaatctaatttgagaaaaaaaatctaatttttcaaatagagctttaaatgtatttgtgtagtttatttcacatattatttcgtttatctatcaatttcttgactgaagatactgtgtgtatgagttctcatcgtactgttcattaagatgggcgtaccctatgctgtagtactccagtacacttttgcagtccaagtgtccaactaatccagctggttggtcaaaggagagagagatagagacagtcacattaaccccgccatttttgtgcagtctccacctccaaaatctcatttttattcatgtcatctccccatcttcaaattctttttcccagctactactatacttgctgtgctgcctggtgataaccagacacaaagcaaaactagagtgaggtgtctcactgtctcactgttgtttgtcttcctccttggtttggttgtgtccaagcaagaaaaccaagaaaaacaagcaagaaaaccttgtctctctctctctctctctctctctctctctctcatgcttgtacatggagggatcaagatcaagggagtgcattgctgtggcaagtggccatgaagcagcagcagcgccagcaggctacggcctgttcatcagaacagcagattgttccatggctgaagcagctgcacaacaagaagccgcagcagcagcgaaagggtaccggtcttctccctcctcgccgtcgtcgatgtcccccactccgtcacctccaccggcggcagctgtccatggaggaggaggagcggaggatgccgccgccgccgccattgcaacgccagccgcgcggagtttgggtgcaggggacagcggcagcatgcaggtgagtggccatggcgagcatgctgggttgagctccagacggcgtcgtggccggccgaaagggtccgggcggcgccagatccttgccaatctaggtcagtatatattgcttcttcagaaatgcagagttcattacatgattttctttggatttggaaaatacccagtttccattttttttcatgtttatgttcttgttattggtgtctcttcttcattttttttgggggtgaatttctgtttcattgcttgcatggggtccagtggagaggatgatgtgtaatgttgccttttgagctgaagagggctctactgcttaccagtcaataaccgttaggaataagcacatttctgctgttcatgctcttgtgtttgtccggattcatctcagtccaaacctttggatatgtatgaattatttggtgattttcctaggtggtttaactaatcgacccaatcctttgggcgatttcgttggttttcatgaggataaacttcagttaaggagtagtctggtagtagacaacaaagtgcacatcgctttgtctgattggtattctcaatgcttgtaaaggggaatggtatgcgttatcagctggagggagcttcacgcctcatgtcatcattgtcgccacaggggaggtaagccataactgaagttttttttttaacagttagcttggcattgtgatttgattatgaaaggatgaacactgactgtttctttggtgcaattcgttggtaggatgtggcggctcgcataatgtccttctcgcagaagggtcctcgctcggtttgcattctcgctgccaatggcaccatctcaaatgttgtattgaaccagcctggctcgtctggtagcaccttctcctacgaggtatgaaatggagttcactccttgcatcgtgtgatagtatgatacttggaaatgttgtgagctaatttgacggctgcctgaacttctgatggagttatgggtatgtctcaagtcggtctattcagtttttttggcctgtctctacctaatctcttagtttcagtatcaccacctttatagtactagatacaataaatggtcttcttgcctaagttgagaaagtattttttctgtaatggtgtcttaagtcttaaccaccttatgcgagccacttttgaagacagatcaagggtgaagtcttcttcccaatttttctatgttcatgatagcacatatacaattccggcagtctgtagtaacatactccctctgtcccataaaaaaaaaagagtaaagtccaccaccggtccctaaacttgtactgctgtgtcatcccggtctctaaactcgcaaattgactgttcaagtcctcaaacttgttcgactgtgtcatcccggtccctaaacttgcatatcacttgtttaggtcctccaacttgttcagttgtgtcaacccggtcccaaaacttggatttgaatatcatttgggtcaaataggacggtctaaagactttatatttaaaaataattcataacttttcatgtgaactctaatgaagacaaactttatatcaaacttgtagccctcgacgcgatctacaactttgtagttgaattattttattttaagtcattttttgtcccaaaatgtaattttaaaattaaaatttcaaaatctataaacatgcaacaatattttgggaccctaaacagttttaattcaaaaacttttcaactacaaagttgtaggtcacgtcgagggatacaattttgatataaagtttgtcttcattagagttcacatgaaaaagttataaattattttttgatataaagtttttagaccgtcctgtttagggaccggggtgacacaactgaacaagttggaggacctaaacgagtgatctgcaagtttagggaccgggatgacacagtcgaacaagtttgaggacctgaacggttgatttgtgagtttagggaccgggatgacacagcggtacaagtttagggatcgatgatggactttactcaaaaaaaatctagaactgtatgtaacatattaatgtgtcacatctggtattatggtgggttttataggacggagggagtatacgctcaagtctgcaaattgtacgcgagtctcaataacgttgtccagaaaacagtcagtgatgcccggccaaaaaaaacagtggtatattactagattagcatgtgatttgtgctaatgtctcccactcccatccccgtttggtagggctccaaactctaactcaagtgagagctagctcctattagagttgaagactcgttgaaaagtgtttggctacgtttcagctctagatatgaaaaaaaaagaaaaaaaattgaaaaaatcgctggccgcgtaccaccagcctaccagccgctcgccgttcccaggcgcttcgtccgccggccggtgttgtcgccaggcgtgccgcgcgccgccggccacacgttgtccccaggcgcgccacccgcccgtggtctccgcgccggcctatcgccccctcccccgctcccgctcccgcagctcggttggcatcgtgaggaagatggggggaggagagagaacgggatgagaggagtgaagggtagttgaatggcattttttataaatagactaaaaaattaaagggtagtaggtattttaggatggagtggagctgtggagcagaaaaacccagctccacccccatagttcattttctaggagtagatctgctagctccactccaaaaaatggaggatctggaccgtttggcacagccccggctccaggtaagttggagttgggagctagagctgtgccaaacagggccctgcctaagagacagagcggctgtatgcctatatcagtgtaggataacaattgaagcgaagttgttacttatcgtacgtgcatacacatttgtgtttacagttatcctcactgaactctaagatggcagcatttatggatatgtggttgccagggctgctttgagattcttcaactgactggctcctttacaattgcggaggaaggcgttcggaggagaaccggcgggctcagtgtctcgcttgccggccctgatggccgtgttgtcggcggtgtagtagctgggatgctgcgagccgccagccctattcaggtaaagaaacaacaacaacaactgaagaacctggacaaaattaatcgatttttcgataacgtaattcagtcgaaccaagtaccatgcttttacaactgaagatagagaacttcgttgttaactctgtcactcatgcatggtagactctgtagccattttttttctctgaagctctaaacacaatatctccatggacaggtgattgtggggagcttcttgcccaacaacctgaagcagcatcagagaagaatgggcctacatccacaaccatctgctgctccggcatttccagcaccgatggctcctcttcatcctcctcctgtgctcacagctgcgatgcccatttctcaggcagctcctggcaacaatggctgccgttcgccgcaggtttcgatctcatccatgcctccacaagcacatgccggtgtggagcagagtagaggcgccatgaacctgaattcatcgagctccagtactggtttcgccatggttgggtggcctgcagctgcaagctcgcagtccatggtgcacaggccttcacctgacatcaatgtctgcttgactcctcaagagtaggatcaatttgtcctatttttttgttgccctcgtgcctgacatgcgttgttgtggcatggctgtcacgtgacatgtgtttgggttcaattctatctaatcacgtgtcttgagtagtttgcagtttggttgggggatgaaacaggccaacataagaacagtttagccagaatctgacagaatgtgatagtttatatgctctcagttagagttggggatgtgtcattttgctgggacatttggatgtgattcattctcgctgtgaccttctcttgtactcctgcttcattgtgttcctcctccgcattgttgctcggtttgtgtccagtatgaatctcatagtctcaaaatctaatatccgtacggttataaacattttactacattatgattacaagatttaattaaactccccacgaaaaaaagatttaattaaacttttaaaatttgagccatcaatcttacaataaaataagttcgtaaaatctactaataagtttttgatactatggtaggtacgtatatcattttcttaaaacaaagaaagcatctgaaaaattattaaatggttggaattatagaagttttatcaaagaggattgctcccatccagcaggtaaccagcccggtaccaaatctcagccattcatttagctcgatcggccggtggaaattatacggtacctccaggtacatatttgcccatgaggtggtactggaatagttagaggggtggaagggtaatgttgtcttttcgcgtagggatccatctcgattcagctctgatccgtgagaggtggcggtggtgctcgacgggagcaacgctcggaggcggcagcagcgacagctgattcgtgggaggcgacgagtaggtggtccatgggaggcgacgagaaggtggtggctggtccgtgggctgcggtggtgaggtggtgttggcggcggtgtgtggtgcttgggcccgtgtcagtgaggtggcggcggcaatggcgtcggcagcgggtggttcgtggtgggcatccttcttcaacctctggttattctgtagcattgcccacagctcaagcactcaactgttatgttgagaaaacgaaggcagaagagataaaatgaagctagagctggaaatggttgaccatgaccggctttcagacatagaaaattcattcaagaagttgtctaagcagaaaaaagagactgatgacattagaaattggttcataggaacagtagttgtagctgtgttccttctcatgaagctatttgataatatgtactatgcttgccattgttgattttgtacatgtcaattaccagaattaatggatggggatcactcagcatgttgatgtctcagcaacctatccatgtgaattctgtttatctatctcccactatttgaaactctaaattacagcttcttcagatgggttgtctaacttatccttcaattttagattcttgctaagttctagttcgttctgtttggctgaaaatttgcagaattctgtttatctatctcccactgtctgaaactctgaattacaacacactagtacgagtatgtttgtttcagtctttcagaatcatgtaaattatactttttttcagtaattattgcccatgtgtctagcactctactccagtgattcctcaacttttacatctatagctggattgctgttcattgaaaacacttgcttgtaaccattgttgtgctgctgatcactccacagaatgatatatattttacaggagatcgagcaaaaacatcagacaaaatattaatggctctcaatacgacatatatatcatgctctgttcacagcagacaaaaattaagtcaaaagctccattcaacgatagatcatgccctgtaaacagcataccaaaaaacggacgacagatgagcttaaaattttccattcaaagattaaagtctccagcaaaagcttgtgcttttctcacaaattcattacaagaaacatggcagattgaattgttaattacaaaataactagaccatatagtggagtagtgtttgagccgtaatgggggcctaggctgcgccatggcagcgggggaggttaggtacttgcttgagctgtcgagggagggggataggggacacagaataccatgacatcttcgctcgtgaatgcggcggcgttgttggtgacactgtcgcggacagcagatggatgggaaaaaatcggcaccggcagaggcatggatgcggggcgagcgcgccgtttctccagtaccgcgaccacggacggcagatggatgggaaaaaaccgttcggcggggcgtggatgcggcgcaactgctccgtttctgcgctcagatggaggaatagatgagaaagaaccgatgcggggagggaggaaagaaagagcgcagcgagggaggaaagcggcggcgtgtgactccggaattgttccgcttctatttgttgttttccaatcgtatcctttcaagttggacggccagatttaatctggtacctcctagtaccagtactggctggtacagactgccggacgggagtaaaactcttcatagatagatgaatctagatagataatcaatatgaatatagaaaatgctataatgacttacattgtgaaatggagagagtagttcgaaagcatgcgcatagaaaagaaagaaataggtcggaaaagtgaaggaaaaaaaaactcagcctataagtagggtgcacgtttatagtttcactaagtgtttatactgtgtttcttgatagaaaataatacgggctttaaatttcccgtgacgctatcgatgcaattcatgcaaccaaccaggcgtgctgcgtgcaacacctggaacaaatcctttcggcgttcgttgcacctggacacacacctgcacatgacgtggccccctatccatccatcccttaccgccttcctctccacgcgtcgccttccgcctccgccacctcctccccctctccacacactcttcttctccactcctccgccgctcgcctcgccgcgcgccgcttatatacccgcgtctctgcgctcatcgattcatcacccagatcgcaatccaaccaccgcaaccaattcgccggagaaagttgtgaataccgacctaccggcggcgaagatcgatgatgtacatgcgcgcgacgcaccgggacgaggaggggaagaaggtgacggagaaggtggcggtgccggagacgcggcacccggacacggccaggcacttcgagcggaagctggaccagcaggggctccaccgcatggagcgccacccggcgaacggctcccgcggcatcggcgcgccgccgcccaagtccggccgcggcggcaagttcacctgggagggccccgacagcatcgtcgacagccagctcgatcccctcccggccgccatcgaccgcaacgaccccaactacgaggaggaggaaggcgaccacgagcgcgaggccgacgtcgtcggcgaggtggaggtcgccaaggtcgccggcgacgccagggatggtgtcgccagggtcgacgtcgtcgcgccgccgcagctgcacgagaaactgcagctgcagccgcagtaggggcgcccagccgccatttgagtggtgttttcgaagtgtgtttgttactttgtttgagtgtttatttacggttttgtatgcgtgttatttatgcctctgtatgaataataatcgagcatcaaactgaacttggatgaactgtggtatctggatttagggattgttcaactcattgccgaaataatgtgttctcccgatcttgtatttggttaaatttatttttgtgtgctgatttcattcaattatttttaaatacacttattttatagagtgatagattttatagagtgctagattgtaataatagactgtagattgtaataatagaatgttgctctgtagcaaatgtcggtgtaactcaatagcattctgaagctctatcatcttactcgagcatcccctttttattttttaggatgctggtctcatgttttaaaccataaagcaaacctgatgggtataaatcctaatagggaccctttatttattttaaagggcaggtaagtaatcttctaatatataaaggacaggtaagtaatctcctaatatcgtttaggggtaattttgatatggattgtttaaataaagggcaggtaagtaatcttctaatatataaagggcaattaagtaatctcctaatatcgtttaggggtaattttaatatggattgttttctttggttcgatcacatcaggtcggactccttatcgcatcgcattaggtccgactccgttgcacgcagtctcgtcgctattcctcccccggcgtcgccgccttgtccaccccctccgtcaccatccgtatcccccgccctctccgtcgccgccttgtccgcctcctcagtcgccgtccgcctcccccaccctcgccgccttctcctctccctccgtccccgtacgttttccctgccctctccgtcgccgtccgtcgcccccgccctctccacctccggcaccgttggcgtctcctccccttcagcgtccttgcctcctccgtcgtcttcctaccacgcgtggcatcaggtcagaggcaggcaccggcaggcggcggcgcggccggcagctagtcctcccggcaggcggcgtcgcggccggtggcacggcgcgtcgcatctgtccgacacaagcaccggcaaaagcggtggcgcggtgaaatcctcaggtgtccactcctccccccccacctgactttctgttccccttcctctcctcagtgttaaacttgtctgaatttttcctctacaaatgcatatacttgcttgtaaatggctgtgtatactagcttgtaactatactagagaatctacatttgcggatgttaaattgaataggagatttattaaatcgattttgtatgttaagttgtaagcatgaacgataaaactgaacaataattttggtcttaagctgcaaatgaaatacacctgtcacttgaaattccactcaaaacagtttgctgaaattgatgtgttactaatataagtccaacattaaacctcagcaaaggtggcaagttaaatcatatcttgtgcaattgatctttgatcttttctaccaaatgattgccttgtcaactggttaaagcatccaacatttcctgctagttcatcagtagtactagtagtacattgaattaatttattagtgcatgccttagttcttttatcatacatacaaaatttgcagccattatgggggaactgtagtaattgttcaatagtttagagtggcaatgaatttatgcagttgatggatctgtgagatggatactcttttatagcaaatcaaacctgtcttcctgaatttggccatctctgcatctgcattacactctgaaactgaaagaataaagaattcagggcataatttggccatctctgcatttgcattatactctgaaactgaggcacttaatttattttagatgtgtacagaggcaaataagctaaaatgctttagaactataaaagaattctttgtcagaaacattacataaatacggaattgagcttgatttaatccattttcagaaaattacagaattgagctgcctcctgtgtcctaacttgacttgttgctgcttggtttctgaaaataggtcctggatgacgatcatggagctgtggtttaccctgtcaggaggtcagtagcccctcctgcagttcagcgttggggcgacgtccctgggcagcataactgtggcgcacctggttaccctgagatgattccggcgcaagcacagttctgttgtttgcgttgcaaggctgcttatttatttttaaaggagtgtaatgaacaaataaatttagttgcctttttaaatattaggattaaatgatctgcaactggaatggtgacttcattttgtgatgcttgtgtgatgctttaatggtgctgtttgctggaatgatgctattgttgatgctggaatgatactgctactattcgaaattgtgctgctgctagaactgcactgttgttgctggaatgaaactgaactgctggtgctgctggtgctgctgaaactgtaatgctgctgctgctgctgctgaaactggttgttttttcatgcagagcctaccagatcaataagaatgcacatgctgctggaggactcattctgtccatatttttctagttccaacttcgaattgcgatagctctattcggagtctcgaagccaccaaaaaggattggtggtgggagatttggcatcctcagccatcaggcctccagaagatgctgattcaggagcgaagcaaaccataggaacagttccagggggaacatgtcgtccccaagaaaaaatgatactgacacatcattttgttctccgtagcatccgattttgatacaacattagcttacacatttgacagtttgacaggatgtaagatgttgcattgagcagcttctttacgtaagatttgcagtgcagaagcacaaaggtgcttcgtcgtggtacgagatgtttctttaaactcgcagaaagtacttatcataaaaaatcatggtttttcaatcgaccgcgcgcatatattatagcagaacattattttttttacaaaagaaagaataagtccccgcatctgacatcgttgaataacgagattgagtatcatttaataaataacagatagagtttaatattaaaaaattaacacctagcttattcgaaatgaacatccgacaagacaaactaagaatctccaaaataaaacatctcaatgataaatgaacatctcagaatttaatgaaagaatatcctcccaatacaaagctgaacatcttagatttcttcggagatggcctgtgcatgattcaaaatttgttggatggagagttgtaaagaatcgctgctagctttcttatgtattcatcgatgccttcctgcatagatcacaacaactatatgttatctttcttattttctacaaatgtccttctgtcataatcaaactttttgtttgctatgatgggcctaccatccagtccgcgtactcatagttcatatttgtatccatttgagaaggagcggtatatgaaaccttacgcttcggggtgactcagggcagtaagcagtcgacgtcaccaacgtgcatctgcttcaatgtcgcacctgaacaccgagaaccccttcgccggcatgtggttcagagtaagtaagtaaaaatgctgttaacattaaccgttctgttatgaaataaacaatgtatttactgaaccaaaacgagcaatataattggtgaaaaggacaccaaagttcaaaggaaagagacaccacgcatcatctactcgtaattaattgatggtggcataacaatgccaatgcaaatatagccactagtaacagccacccattccaaagcccccacaacaggtgaacattagtttcattcagaaagatgacaactttagacatcataattcaatagcacaacattgcgtgccaaatccaattggtacgacgaagcagccacacgtaccttccaagatggcttcgcgcacttgctcttgctccttgcaaatactgaatgctcccaccagcatcccaatgccatggcacctcggagcacccagtaagcatgcctctctcgggatcgccaacgccatggtggagttgttcagatatagatggatcatctcatccttcatgctacagattaataggaaacaggtagcctcggaaatcaaatcaaaatttaagaaaaacaaacaacttgagattgaaagttgaggggcggcattaggggagtgcatcttactgcaaatttccgggcattaccttccgctattgtccaatggcaagtcttcctcatgctccgaaggaggtgcttgaggtggcatggggacgaaggggaaccaggcgtgcgttgccattggatccagaggctgcgtcctccgcttgtgggcgatggattgggggctctcccacgcggctgcaggagcgatggcgggcggagatggacggggctggagccgagcgtgggggaggaggccgacagcgagtaaggggatagcgaggaggacgaaggctcggcggcagcgagtggcgcggtgctggggtctaaggtggaactcgccagaaggtgtgccgacgcgggtagcggcgggatagggcggagctctggagatcccagacggagatgcgggatcgccgagaggagtggagaagggggcaggggttgatggggaggaggacgtggcggcggtggcgggtggaggtgacgcggcggagagggctggtggcgaggagaacgtggcggcagtgacgggtggaggcgcgacgacgtgaggcgactcgctggagaagggagcgggggaggaggatggctaccgagggggctcacaaggcggcgtggagatgcgggcgggggagaaggtggcgatggcggggagacgggcttcgacggagggagcggagaaggcaacggcgctggagggggaggagacgcgaggacgggcgacatagatggcgagggagatggacggcgacggaggcggggatggaggggaatggcgtcgggatggagtgaaatggcgacgatgcgatacgaatccataggatagggatagggtgagtaagagactgataatatacgataataccctacgcgaattatttttcctggatgaaaacaccccttcacatttctactcccactaattctggtgggagtagaactagatcttaagccttcaattaaatatgatcaatggctcagattactttctactccgagtataaagcaccggagtgggactctaaaactaaaactacacgatgaagctaaaataatttggtaaatttgacaagataagatgtggtggcaagttttaatatggtcttttgaggagtttctagaattatcagtatagttttgtgtgagttgatgtttctaaaattaccaagtgagtgaccagaagtttaattatcataagattgtgatggttatgtatggtctgctgcgaataaaaaaatgagaaatgctaaaatttggtgccaacaaggccgaacgcataatcattccactgcgtaatttatgcggcccatacgaaagaaaggcccccttgtctgtcactgactggtgggccaatcctctcatgggccaacgcatgctaaagcttgactctccagttgggccaatataggtctcactgagtaatgggcctcaccgagcaactgatgcaacttaagtgggcccatctagaaaatgtggcccactaccaccggcccggcctttttagtggcttcgctaggttttttccctctgcgtgctcggggtcgcggcggctaaccgtctctctcgccgccgtctcgcacctcgcgtcgccgccgccgccgcgagtgtcggagcggaggagaaggggaggggggccatggcgaagggcgacgacgcgctggcgcggaagcgcaacaaggtgcggcggaagcggatgcgcagcagcgagaacgccgtgtcggcccgcgtcgccggcatcatcgcctccaagcgccgccgcaagtccggcaagcggcgggcctgcgagggcatgtgcttctccctccccaccccggaggaccccttcaacgaccgccacggcaagaagcggaagggcgacgacgagccgaccggagacgcccccgccgccgccgccgcaggcagggacgaatccaagaagaagaagaagaagaagaagaagaaggattcgagcgccaagaagcagccggcgagggaggccgccgccgccgccgccgcgaacgccaagtctagggagaaggacggggcggagtacgaccggccgtccaagttcctggtggtctgcctcaacgccatccgagacgcggcggcgtccgaggacggcggcggcggcggcatccacgacaccgggtcgtggggcgtggagctctggaattgctgctcggctgcgccgcctacgcacgtgctcgacaccagcggcgagtgcgccacccgggagaagacggcttggctcgtctccacagcctgcgacatcgtcgccaggaaggagaagctcgctgtggtcgtctcttgccccttcctactctacctcgtcccctcccaggaaaaggccgtgcaagttagtgccgccatttttgctcgtttggttaattcacttaagattgattcctaaatgatgaatcagtgattcatttgatggtgttttgtgcaggtgcgttcgatttgcaagcctctgaaatcacttggtatccattccgtcagtctgcatcccggcgcttccattgaacaccagatttctgggtatgttttggccaaattaattatcagtctaatcctattatcagtgtcattgttatctgtaagcgtataagcgtgttagggtaggggatgttaatttcatgcacactcaattcagattaaagagttgcgaaccggagttccttatatccacgccagagaggctgcttgaactaatagctttaaaggcgattgacatatcaggcgtatcgatgctggtgagttaatttggttgttgaacttctttgtactaagacagatcatctgtaacacttccattcaccatcttagtgattatgtaatttcagtttgcaaaacgaatgctgttgtcatatcaaattatatttgtatctccaagttttggatactcttagcaattatacaacctagaagcctattcccaacaagcctactcatcctacagtcaagtttaatttaaatatggaaactccatttgacaggtgattgatggtctgaagtgtttcacggaccttaatgtcagcgacaagctttgttctattagggatgccatattgagcaaccctcaaataactatattcagtgaccgttctgaccgaagggtagctgcactggcaacaaaactagtcggtggaaaaaagatcacaaggctttgtacgaatgattcagttacttctagaggtgcattcataacacaaaagatacacatatgcccatcaaaggaccaaaaggcaccgaaggtaattatcataaccaataaccactgatgtattgctagttcattacttatttgctccatgtacttgcctttgaaaaatagttttcctttacagtcatcctggcttcataatatcacttaaaggaatctgcttcctgttactgaagattagtctgttagatcaccttgctaagccttgatctgcctatcttactcttgtagccttgttctctgtgttgttaagccttttaacctcatgtactgttttcacggttgtgattttggaacagaaacagttacaaatctcttgtgcgattaaaatatgcctttttgcctgccatggtaagcttatgggcttttccaacatgcaggtgaaggaaattcttgaacaaattctaaatgatcatgctagaaagactgcaaaggtcctactggtaaccgcaagtgatcatgaagcacagcatctgtcatcatccttgaaattgcaaaattgtaccgtgaccaatgactcgcatggcaactcttttaccatatgcagcaggtatggaaaatatttacagtatgtagtttattgccgaacatcctatctatggggacaaaccaagagctgtgcaatgcacctaacattccctaaactcttccaagctgaaaactggtcactaagactgggggtttacttgaaagggaattgtagtcacaccattatcttttgatttgagattggctgcttttcttttactttgacaacttacatttctctggattttcttcagtgttgggctgattaatgtccttgtgaaagactgggagaacataacaacggcaaattttgaggacttcgacactgtgttggttgcagacttgcctccttcagttgacgaatacattgaaatcctcgctggtgcaagctgtcatgtgcttgtgggggaggtgcattgcatcttttctagcgctgatgctctgcttgcaaaacccttgtctgaggttcttacaagctgtggtcaggtagtgcctgaatttctcaggaaactggcatcctcatagcaggatcggttttctcatggcaatcatcatatagtatacgctaccatattcatggttcttccagtcactaaacatttttgtcagtttactgttccttatcatgtaattctcacagcataacgaggatcttcagccttgttgtatctctgcaactttgtattttttgaatgcgatcaagtcctagtctgtgagaaccaattgcttttgcattcattaacattacatggtacaatagtcaagtgcaaactactaagttactggttttattattgtgaaggttgaatcagcttatgattgtcagggaccgccctgctctcctcttttcaaggggagcaaaagagaggcagtgatagatctcagatctttaaagtgcgtcaatatgtcaaagaactaacttctttcaatgcactttttttttcatcctctcatctacttctgtttcacactacttattctggctttatttttttcatcctctcatctacttctgtttcacactacttattctggctatggcctgttcactttgatgccattttcaaccttaccaaattttgataaagttaccaaaaaagtggctacatttagtttgctgccaaattttagtaactatataagaaatcatgcaaaaattttggcaactataccaaaattttggtaatgccaaaacttggtaaggttttttttggcatcaaagtgaacagacccttatttttcagcaataattttacaaatattaaaaacataccatattatcatattgtagctaaatactctcttcgttttaaattataaggtgttttagtttgaccctaaatcaaatatttagaaaaataaaca

SEQ ID NO: 40550 - DNA, 9056 bp, Oryza sativa
ttccgtcgcggactctatgccttctcgatcgctcgagaacggttgctagatctcgacaaggaatacggaatgaagagatggtgtacccgccgagataaaatttcttgacttcaatccaaattctcgattacagcaagacgggagacttagtcgtacgctctgtactttctcggtcgacatcagagattgacttagacaaactctttcggtgcccgcacgaggctgacaaaggaagtccaacgttctctctaaactcaccgagaactgtcacatgagctcgataatagttactccaatgtctgcgcagttgagaatatgaattcattcatttgcatcgaagtcgggggctactgtcagggttatgtataccacatacctaatagtagttgactaaatctcggcaggacccaccacataccatgtcctatatggaaacaacctgcggatataggaggagttccggataaggaaagacaaccagagttctacatggaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacggattcgaggaggaaggctaccctgttgtcgactacgagtcagatcttcagaccgagatgtcgacaacagttagataggctaccccacatattgtattggtgtgattatggtgaataaaagcaactccggctccagccaacaggatgtagggttatgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcatctcaatcaataaagatctaagcagcggaaaaaaaaagataaacggcgcagacgactccactccacaggtagcttgaccagggctacacctaatcctccacaccatcaacatcactgtagaactcttcctctgatgaatgattgcaaggtgagtatatgacatactcagcaagccacgcagcaaatatgcaagtgcacaggataacaaaggatggcacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgcgtcagcggctagggttcgcggtgaaccgggtgcacggcggcggctcacgaaaacgaacggctgagatctttccatccaaaacgaacggccgagatcgaccggtccacagccggaccacggaagacgacgacgatgacgtcagcggtgacatcaccaccggcggcggctcgggtgcgcaaactcgtcggcgaacgacggcgcgacgacgcgaacggaggacaccaacacgtagagggcgacgcggcgaactcaccggtgaccaaaacaatggcggaagatcaacggacggcgacggcgtcgaggaagaagcggcggcaaccttcggcttgacgacgacggcggagaggtggacgagatcggcgacggcttggtgaccacgacggcgacctccccgagcagcgacgacgaccggagcgacggcggcgcacggctggagctgcggcggcgacagcggcgctaggctacacgatgctagggctctaccggcgacgagaggcgaatgcgagggtggcggcgggtagcggcgggcttgggggtccttttataggagcaaggaggcggcggcgaaggcccacggcgaccggcgacatgaaggaaagtctagggttcggaggagagagatcgatccgaatcgaactcgaatccacgatttccaaacgattttagccgacgattccaaaagagaaaggtagaggagatcccgaagatcatttcccctctattgatttcaccggagaaggaaaggcgtgagcgaatttggaaggagacggcggcgcggctcagctagggttccggccgggcgacgacgcgaggaggacgacgagtccgacaggtgggccccacctgtcagcgggcggacgcgcgcgcgcgagcgggcggctcgactgcgggccggattgggccaggagagagagaaaaggttttgggccgactttcggcccaaagccaaaagaggatttttaaaaccttttacaatttaaattattcattaaatgtaattccatttattaaaaatacttccttagctcaaataaatctcagaaaaatctaggaattatagagttaagcaaagtatttaatgaaattttatctggccccattttatattggaatttattaattaaaattagatcttctcttctaggctttttaaaataaattccaattaaacaacaatttatatatttaggatttttagggtgtgacaggttattacctgacagctcaggggcccgaacctatataaaaatcctcgtctccatctcttttacttcagtctcgtgtatatcctagcaccaacgatccccatactgttcaaataccgtagttgagacatcaaacgtcgacattcgtcttattcaaaaaatttaagtaattattaattctttttctataatttgattcattgttaaatatacttttatgtatacatatagttttacatatttcataaaagtttttgaataagacgaatggtcaaacatgttttaaaaagtcaacggcgtcaaacatttggacaataagggagtataaacgaacagggagacatggcaaaaggcatcgatgaactgaaccaaggaacgagcctctccttctccctggatgcttcctcttcccaaaatccttttctctgaatcccaacctagctatttttccctgtctaattcttctcccagtctacgaacctgtatctcccttcaccacttggtatcttgtgcgatgaatgaaggattaaccctgagttatgctccaacatatcatagaaattaacccgctgattgagaggagcgaagatatcctgttctaataaatgaaattgacgctggttgatttgttaaaaaaacaaaaatacagaggagggaagagagctaattaaagatagggttaattggatccatgccactacaaatataccaaattagaaaaatgtcactacatttcacgatatcagctgagtgccactcgaatttggggaaattggaaccgtgccactccgttgggttttccatccactccctgttaatttcccaactccgacactcggcctcgatgcggcggcgaaggagctcggcgacggtgccatttcccaactccaatggcgagaagagttttggcaatggcggagttcctgcccctctttctcctcatgaactcgtcgtacttcctctttgcttcctcttcttggttccgtccacgtaggtgctgtggaagctgtgcccgcatgccgggagcacgccgccgtccgccagctctgacaggcagatggcacactccacctcggcccacccgccgaccatcgggactccgaacgccgcgccgaccgccctgacctatcggtgttggcgtcgtcgtcggacgccggcctaggtggctgtggttgcgcccactccccggagtcgcgccaacgggcgaggcagcggatgaggcaccgcgcggcggcgtggaggtagaaggcgaggagggagacgcgggcgaagatgatgaggatggtggccacgttggagaagaatgcacgcatcgacagtgaagtgtgaggtgaggaaccacgaggacgacatattgttaacgaccaaatttggtaatatcagcatcggaagaggagactagatcgaggtggagtcgaaggcggagattgattcgagaacagagcaagaatcgactgaagtccatatcggctacgattaggatcggatgggtctaagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctaccgcaaagacttatggtatcttagagtgtgttagagatagtggtcgtgtccggtatggacatatcttgtaattcttgggtataaatagaccccgagccctatgtaatttttaacacacacgttcaatacaatttcggcgcatcgccacctttttgctttagttttgttttcgacgagttcttactttcgggttgagctgcatcggttttgatcttcaacaagaggtaaaacttgttatgacgacttgtgttctcgagattagtgcttccatctttatgacactctaatcttgcctatataattcgtcgagttattatatatcttacattagctttggcaatatcgtcatctaacctacaatcggctgacatctgttaatagaaggcagccgattaggttaaatagcgatgttgtcctagattatataaaatatctaccactttatgaaacatccagcgtcttgattgtctagatattgttcttcttttcatacttaatgttgcatcagttgagtttgatctattaagtcgtgcttagaatatcaatctctagcatgtcctctggttgccgattagggtagtatcggagtttcagccgatcttatctgatttaaccatattcgatctatgtgcctaagtgacatgttaaatccgccctttatgtcaagatcttactgcatttaagtatattaagcttttgtttggtatattatacttgttttgatatctttatgtagagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttactgtctatttataaccgccgatcgattcatatatgacatcggctcaaagataaatgatatgtcatcggcacctagccgatcggctattatttatagatttaaccacgaattctttgtctctatttcttgttgattacaggatcaaatcaactggcacgctcatacattcgaaggtgagctttggacctgcactggagttaagcagatctcccaggcctcgtgttttctgtcaacacatatggaggtcttgacgacacgggagacgacgaccgcgcccctatggtagaaatctacggcagagacgagctccccaggtagcaacacccttccctgccgctgatcatctccgtcgagtggagcagcggtggcggcagcagcggcgacgtccatgcacgggaaagagaaggcgtcgacgaagttggcactgtggacagggagtggatggaaaacgcgaaggagtggcatggatctaatttcccaaaattccagtggcacccagccgatatcgcgaatagtggtggcatttttctaatttggtatatttgtagtggcatgaatccaattagggatacatatacacacatgtgtgcacaacttcacctcagattttacaagcctcataaaacccaaaccttatggcaactttggccatgtaaattgttggattgggatgcactaggaaaatacaacaatgctgaggtgatctcctacctcgtcgtctcatagtcagggttagaaattttggaccaaaatttcggaaattttggtcatttcggtgacccccgatatgatattaattcggctgaaatttttgaatttttcaattttttcatgaatttggataatatttgttcaaattcaactaaattttgtttaaaattttagaaattttgaaccgaaatttctgaaatttcaggatttcggtgaccccaatagaaacccctaaaccgatagagtgaaccctgctcgtagttaggctagcaccttgttttcggccggtgacaaacaagaaagtatcatccacggacaattggcgtgagactacagctgtgttccgacttccggcacgtcggaattacaatcgaaaagctctccacacaatcaacaattgcactcttttttttttagaactcatgattttatttaaggctaatagcacgttatatgatgagttgatacaacttccatagagtaagaggagagcaagcccaaaaaagagaagctgacaagtatgcccacaagcatacgggctggtaaacatacagcacatattgcaaaagaactcctaaaagatagaaaaatgcaaaagggcctagaaaaaagcaaaggacttctaaagataaggaaaaaaaaaagcgatctggtccttgcgctgcttcttcctctaatctggtgaccaggacaacgaaaccgacatcaacaacgacggcgaaagcaagggagactgtaaaatagagctccaagccgtaaaaccatacggggctttcaccacacaaggcggaagttgacgcacgacaaaaagaataggaagaatacagtcgcacattgaagaacgtcgacagcaatgaaatggctcaccacattagtagcaactttgccggagttggttagaatggctggcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaa

SEQ ID NO: 40551 - DNA, 13311 bp, Oryza sativa
ctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagaggcatcagccatcaggttggaagctcgtgaggtggcgcatccctgatgcgagcgaagacggaggaaggtcgtggcgtatcgctggcgtatcgtgatttatttatttttttggaaatcgcaaatatgtgggatacgtacgggatacgtatcggagcgtatccgatacgtatccgtatccgttgccgtatccgatacggatacgtgactatgcagccgtatcagggtaacccagatagctactagtagacctgtaccctagctatgtagggtacttattatggcggagcctagtagcctagctacgtgtctaagatgagttgcatctatttgttgtgtcctataccatgcacggattagaccagacaaataattacctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggcgtgcccatccgactccgacgacgttcttccgcctcgccgccgatgatccccgccggccagccatgtgtcctaccctacccacccaccagcagccgattgcacctgccactgccgtttcttccctcaactgtagagtggtcagcggagatggccggcagacggcaggggggcaaccttgcctggggaccgcgcctcgcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatctaaagccaacactacctattgctttatatcttagggctggtttagttcccaactttttcttcaaactttcaacttttccatcacatcaaaacttttctacacacacaaacttccaactttttcgtcacatcattccaatttcaatcaaacctccaattttgacgtaaactaaacacatccttaatatggtggtagagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtccgtggtgccatcgaacccggcggcgtcgtcgtcgtcggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaaggcaagggcgtgcagccaggccggccaggcagcgccggcatgcgcagcgacgacggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagatgatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctctgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgtctttggtttagttatactttatttattttgctctttgacctttgc

SEQ ID NO: 40552 - DNA, 10000 bp, Oryza sativa
tggaaaatcgtaaaactacatatttagtaacaaagttatcacagaattacatatttaatatcaatttaatcacaaaacttagatatatataactcaaacatagcattagtgctaaggatttgaacccaaaatatatagttttgtgataatttcattagtaaatccatagtttagcgatacttagcctaaaatctatagttttctgataaatttattgttaaatctgtagttttgtgataaatcaccttaaatctatagttttgtgataatttagtcaaatatctgtagttttgtgaaatttactttaaaaattaatatgtgaaaaagacatgacataatttatcagaagactgttttttttgtctttgcttaatggaagcaaatcttttgcgttcattaaaaaaagatttatcaataaagatattttcatgcagttatataatatttattgaatatatagtcaaaaagacaatgatcaaattaacgtatataacatgtcctaaaacaacaggtaaaatagaatgaagtgagcaccttttcagggagcactaagcctctttaatgtgattccttagaatttgcatggtttgccaccatgccaaaacctaagcaaacttttgttatggcccaagttttggcaagttatatatgttattgtcacattttagtagcaaaaccaaacactaaccaaaatactatttaaagtgccaataatttggtaggggtgtattttaacttcaaaccaaaatggctctaattagtttgttcttgattcatacttggacgatgcatcttatgcgatcatctcgggggaactatgcgtggaacggtatatgtgcccatagtttccaaagtccaaatcagacaaatactctattcctagtccacgattcttccaaggtggctgcggttacggaaacttagatgattttgcatatcattttataattggacacctttacattagtcctattgtttaatttattatttccattttcacatgcttatgggtgaacatgtctagcttcaactggctgctaaaaggtcaaaaagatagaaagataagagcaagtttaatagtatagccagctactgactccaaatcatctatagctaatctaatagtctattcttataatagttaattataaaaatatactacaccattaatgcccggtcctacctctcatacacacataacgttttgaagtctgtgttgcagccggctacaaatctgtagcctgctttcttctctctcttcttttttctttttgatatgtggttatatctgatttatagtttgctgttttacctgctctaacaaaacaaaaccaaaaaaacgacgagaaagggatcaacaataatgcaggtgcagatagaatgctgtctacctcaaccgtcatggcagcgaattaaaagatgatagaaaggccaaccaactactccacgtaccctggactggatagatagctagcaaagcaaaagttgctagattctcaagcgtgatggcatttcatggcctgactttagagagacatggactagtgcaattggattcatcaatgtacagccgtgatgcagacaaaatccttgatccctgatgattccggtaaagaagaagaagaggtcgtagaaactatacaagtgttctcacctgcttctgaactctcaagcctgacgaagaaacaaatttgtccagtcctttcacacaattccttcgtgtgatctgctcccaatctgtggttactggggtggagaggaatagcgccgtatacctgtgtctcgtcgtggatgggcggaggtgtcgaactgcggtggcggcaggaggacgccggagttggcacggcgcccgccgtcaaactgccgccgccggttacctactcgaggtggttggtgaaatggtgacttgtggactgatggagtgggagctagttgggccttggagtattagcccaataggcccacgaggaggcagtgtttgggcttatacggcccataagaaggctatggtatcacggcctggcccagaagtgactgggtctgagtaggctaacggaaaaagtacaccgaaggcccctcaacttgcaatcgagttacaaaatcgtccccaaccacaaaatcagatatatgacatccctcatcttacaaaatcgttcattttaggtccctcggtggttttgaccccagttttgtccgacgtgatggctgagtcagcgtgggacccacgtgggccccacatgtcaggttgttcacgtcatcactctctttcacctcttctcccccttcctcctctctcaccttttcttctcaatccgagcaagacggccggcggggcgagggcgccaggcaggagaggaggatgtcgggaggccggcgaccggcggcagccgcgacgatgtgggagcaggacgtcctcgcgctccccgtcggcaccatccgcatccgcctcgtcctcccgcgcccgccctcccacgccgccggcctccgtcgcctttccacgtgtcgccatggatgacgacggcggcgacttccctctccccgtcggcgccatccgcctccgcctcgtccacccatgccgccagcctccatcgtctctccaagtgcggacatggatgacgacggcggcgacctccctctccctgttggcgccatctgcctccgcctcgtcaacccgtgcttgccctcccacaccgccagcctccatcgtctctccacgtgcggccatggatgacgacggcggcatccttcctctccccgtcggcgccatccgcctccgcctcgtcctcccacgccgccggagcaggagggcctccccaacaccgccgccgttgaggcgcgggcgccagatctgcagcgggcggcgtccagcaggggagcaactgcacggcatcctcgcgctggtcgggtcctggcaggccgtgcggacgagcgtcctgccgcgtgcaggagcgagggtgtggcggtggtgggctgcgatggcttacaggacttcgccgacggttccgcctcacctcgcaggcctcctccccaccagccgaccaacctctgcagagctcgcgtgctctgacctcgtcgaccggggggacttcgatggggcacgccgtgtcgcggatgccgtgcttgccgccgccggccctcggggcgaggttagtgaccgcctcgtgcatcacttcgcccgcacgctcctcgctctacgcggtgaagacaagggaggccatagcggtgatgaaggcgcgtcagagacaagggaggccatggcggcgctcgaccgcgacgtgctcctctgttgcaccgacgaccgcgctcgtcacactgtcctgtcgcgccctggctgctctccgccggccatcgacgtggagaggagaggagagaggaagtgagttgaaagggagggtaagaagtggctgacgtggactgtctgacatgcaggcctcctccccacgctgactcagccgccacgttggataaaaccgggtcaaaaccaccgaggaacctaaaatgaacggtacctaaaatgaacggttttgtggttgggggtgattttgtaacccgattacaagttgatggaccttcggtgtacttttcctaggctaactaactaggcttgtgtagggacaaggctttggcccaaaaaaaaaggaataagttcaccggaggtccctcaacttaacagcgagattattttgagatccctcaactataaaactagaaatgttcacccctaaactcactcaaaccgttcactggaggtcccatggtagtatttgctcccggttttgctgacgtggcatcctagtcagcaaaaaataaaaaaataaatatgtgggggcccacatgtaagtgagagaaaatgatgtagccccacatctctctttcttttctttttctcttctcttctctccttctcttgagtaggcgcggtggtagactcgatgtgaggcggccggcggcggagcaggggctgcggcggcgggagagggggaaagagacggctggcgcgatggcgagctcggcggcggataagaggccgatgcagacgccggcgacggcgatgagtaggggcggcgatggtgggagaggggagagagacggtgcacgctcgactcggtgcggagtcggcggaggcatcgcaggcgccgccgccgtcccccctctgccggcctattccggccgctccgccccgccgccggtcccccctcttccgcgcttgctcgccgccgctctcccctctatcgcgctcgtccgccgccggtcccccctctgccgaaatcgatttcgagggcgacggcgacgagtcccacctcaccgacggcggcaatggaggggaggaacaaaagcgttatgaggctcccgatgcgccatccttctttctcggcatcgactccgacagcgacggcgataaggagcgccgccgggaggagcaacggcgaagttatgaggctcccaacgtaccctccttctccctcggtattaactctgatggcggcgacccggagccgccgctcgcccgctgccacacttgcccaccgcttgccgccgccaacgccgatgctccgcagccgcgctcgcctaccaccgccgatgctccgcggtcgccgctcacccgcccctttgctcctcccgtgcccagagccgtcgctcgcccgccaccgccgcggttgcccgccgctccgcctgcctccggccgcgagccactaccgctccccatccgtggcaaagaaaacggcgactgagaagaagattgctgactggattattgaccccacatttttctctcacttacatgtgggccccacatattattattattttttttctgactaggatgccacgtcaataaaaccaggtgcaaatactgtcatgggacctccggtgaacggtttgagtgagtttaggaatgaatatttctagttttgtaattgagggattttaaaaaatctcgttgttaagttgaggaacctctggtgaacttattccaaaaaaaaaaaaagattggttttggatcatggctcgtttagtagtgtatttgctgttatcgagatgaccaggtggattaaacttgattgcgtttgcgttgcgtacaaggacaagccaacaaccttgctttcgtaacaccctcatcatctttcgatgcatcattctttgccccaacccacactactactactaatccccaccaaaatcaattatctttgattacaaactcgatggttgtcacaatctatacgcaatacagtctaacaacgcagttaaaaacaaaacgtgggaaggaccaaaaggaatcgttaccatcacacaagtagacgtactctctgtagtcaaaaaatagagttctagatttttcacaagccaacaaggacaatgaagcttgtgtgaaaatggtttagcaactgccccgatcgaaaatgatcgatgtggttaaaaggtagcggcctaaaattaaacaaagtttttttaaaataaaataccagtacatcttttgacattatattagacagatggtaatcaaatttaacttgcgctcgacctaaagcaagtattttttgatgaccgagggatagatcgtgcttgacttgactcatacttaacccctccaaacacagccgaatttataggccccacacctcaacttcaaccctccccctcccatccacttcttccttcccctctccacacgcacaacacaattgccacaaaccacactactaatttgtacttacttcgtctcaaaaatatattaatctactataaaatataatatttcctgaatcgaaacgatattatattagtaataggttaagttctactttaaaaaaaataatttagtattggatgagtttctatccgttctgatttgttgtattggaaaaataatttagtattggatgagtttctatctgttctgatttgttgtattagaaaatttttctttcaatattaggttaagtagttttttttataggatggagaggagtactactccctccattttacaatgtaagtcattaatattaatataaatgtaagaaatgctataataacttatatattatgaaatagggaaatagtaatcacattgctttccgtccaattggaagcagccaaactccgtgcatttccctttcaaatgacctcctcataaatacctcctcgtcttctccctcgaggtgtctccgtctcctcctcctctccgccacctcgtctcgtctcccctcctcccgcgcgcgtaagctccatggccatggcgaggtagtatacaggtagtagtagtggtactactagtgccggtgctactgcttcgtcggtggggggatcgatcgatgcgatgatggtggggtcgacgtcggcggcgaagcggctggcgcggggggtgatgaggaggccgctggagaaggccggggcggcggggctggtcgcgatgctggccgccgccgccgcgctgctcctgctcgtgtgcgccgcctcgctccgctgctcggccgccgtcggctcggcgctggcggcgcccaagaagctcctcagcggcggggtctccatcgaggagccccgcggcggcggcgccggcggaggcggcggaggcgaggagtgcgacctgttcgacggggagtgggtgtgggacgacggctacccgctctacgcctccagggattgccccttcctcgacgtcggcttccgctgctccgagaacggccgccccgacgactcctacaccaagtggcgatggcgcccctcccgctgcgatctccccaggttgggtttgcttcctcctcttccatcgatttctacttcttcctctcatctttggtactcttgcatattatgcttccattgattccattgttggattggggtggcgagtttggaggtttagatagaaatcgattttagtaaatgtttacttcgagagcttgacgaagatcaatgaagaaatctttaatgagatctcttgctgcaatccaagcatctagaacggtgcggagatggcgaatgattaattgattagtataaattaattaaggagatgtggattggagaccgtgctacttaattttgtctgctggaatgttctacaacttgagtgttaacttataaaggcaaagaaattaagacggacttaaataaacttgggttgaatctagaacccaaacatgctgctctgctggcatgatgaggattaagtttgggttagtgcttctgacttcaatcttccagtgggatattcttgctgagattggatcagtgggcgtgcattttacaatcttcaccctggttaaaattagattattggaacatgggatgatcatgatgctgtcaacgaccaactccactttggaactgtgcgccacgattggaaattcgatgcccttttgcttcccacatgattacaaaagtaggaaacaatgttacccgtatggttattgcttagtcctgcagaagatatattttattaaatcagtattgtttacttgatctgcgactgtcatgctgttgcaatcatctttaccttcgatggagaggtggtcttgtcctgttaattgttgagggctctgttttgttgtgttctaactgcctttgttgcagttaagtggttgcttgattcaatttggaaaagtaaagtggttccaagattagatttctaccttttgaaaagaatatttaatcttgattcttgtcaccataaatgtcagtagctatacttggagggtaagtttgtcatccttcataagtgctaattgtatgaaattttgcaaaggtggaatattataacattagggatgtgttacatagtaccatgtaaaaggactcgcatttttttgttagaagcataatctcgttgtacttatgttttttaatgtattgcatgccttttgatttctcagtgaattattttataaggaaagagcatgcttgtgaccttgtaagttcattattttgtgaccttgtatggtactcccttgatacctgtggactgagatgtaccattatcaataaattcaaatgcccatattagcaatgctggtgtctcactctaatttcgtctccttttctgtttcttagatttaatgccagaaatatgctagagaaactcagaaacagaagagttgtatttgttggggattcgattgcaagaaaccaatgggagtctctgctttgtatgctcgctgctgctgttcctgacaagagctccatctttgaagttaatgggaatcctattacaaaacacatgggtttcttaattttcaagtttagagagtacaattgcactgtggagtattacaggtctcctttcatagtccttcaaggtcgtgcaccagctggagcccctgcagtcgtaaaatatacaattagagtagatgccatggattggatgtctggccggggtaagtggaaggatgctgatcttttgatctttaacacggggcactggtggaaccatgagaaaacaatcaaagggtaagcataaatgtttgaattctattgactgaacagcattctctacttaatgtcttatggctgagagatcatgctattcttactgttatgtcttgcaccagtggcgcctatttccaagaaggcaacgaggtcaaaatggagatgactgttagagatgcttaccaaagatccatgcagacattgtttcattggcttcgcaatgaagttaacacaaacaagacccagatcatcttccgtacatatgctcctgtgcatttcaggtctgtgaatcaccaactctaattactcaaatagtgagtgtttcccttggttttaattccttgctcaaacattatttgacagtcttgattgattgtgtatgttgtatcgaatgatatcagatgcttttgaccatacattgtttcattgttttatgtgaattgtgccaatatattgttagcatcatgaaacaatgctgatggtatttattgttggacttgtgaacaaacatcatagtatctttcaaatattcagtcaaactatttctttaactagattagatatttcttacagaggtggtgactggaagactggagggacctgccacttggaaactctaccagatgtaactccaattaaatcgctggaaccgtgggctgacctgcttgaacccataaatcatgtactggggaacagcatcacgaccaagcttgtcgggctggatatactgaatgtgactcagatgacagctctgcgtaaagacgggcacctctcggtgtacctgagtccttcagggcctgcatctcatcacaggcaggattgcagccactggtgcctgcctggtgtccctgatgcatggaatgaactcctctatgccttgttcttgagaagaaagatggtgatgccccacaatgtttcaagtgtgggagctaaaagactcaacactgggtgataaaagccaaaggagtactgctggatggccatgtcctctcttactgaagcaaagctttcataactcataagctaggtagctgagctggggaggacacatttttggtagtacattagtacagtttggttggcaagaagttaagctgcaccactgtgctgtgattttcaattgcggaggttagcgaaaagagctgggcaaaggtaacagtagctctttttttttttccgatagtgaaaatcattgcaacctctacatccaagtgtatatccggtcatggtaacaatagcttagcctgtattatgacggtgatttgtgtgtttcatacagaatgattggtgtaaatatatagcagctgcgaaatgggcagcttgtttcagttgtgtactactatgtaatttgaagaatttgtttgctgacgcatatggttctgacttctcatttgtgagcgcacatgtagcagactccgcttaattttggtttatctctgcatgttcgttgtttggtagtattattacgcttggttgtcttgtccggttgtccctgccccgtctagcgggcgttgacggtgataattaggggtgaaaaactaaaagtgttgcagggtaaccatgagaa

SEQ ID NO: 40553 - DNA, 8569 bp, Oryza sativa
cactgctctcgctgtcatgatattacaagattgtcacggcgctgcaggtggtgtgtcagtgttgttttgccactccagagcgtggcctaaatgttcagattttgaaaataagtttttggaagggtttatttttaaaattaaaaataaaaaaggtcaaaaaaatataacaaaaattcaacaaacagatccatagtagcacatggaccatactgagtagttgggcttggcaacgagttagaagttgaatgaagcccacgaaggtacgaatgcggctcgtcatctctctcatccacctctctgtcttcgctgccgtccttggactggatggaccacccaagtgaaagtgaagagggaacaccacgtcgtcgcgctgcacgatcccccggtgaagtgccgagctaagctctcgtctcctcgagccatccgcctccaaatccgcggaccagccgcctgcccgccgtcccgcaccgatggccgtgctggaagaagatccggccccggtacccgccgccgattctacctccggtgagtgagtctcccgctttctctcgcactccctacaccctgggggcgtgtctgtcttgtgtttggtgtggtgagttggatcggttggttcggcaggctgttgttttgaatccccgtgcggaatcgtagcatatatgtgcttttttatgggattcggaaaattaggcgcctttggttgtaaaatgtccggtttgggtttaaactagattcagtctcttgaggacgccaaattcatctcaaattcaaatcattttgcagtttgcaccttgccgaatgaaccccgaatgctcgaatcaagtgctatcgagtgtgcacttcaatactactggagtagtttgtaagcagttaggcgggattattatggcatgacagcatattatgtcatatcccgttgattttgacgatagtaccgacaattagttctgataaatctgtccaattttctggagttgctaaaagtctctaagatttatacaagtgcaatgcaattatgtaacgtaccaactaaacagtaacctagctgttcttggcacatgattcatgctttacagggttaggttatgctacttgattgagtagttgacactacaccatataagtacataggcatagatggtgtagcactgggacctttggcctatggtgtttctaagcaaaacagatgtaaatactcctgtatccatgggcgcacatctagaaaactgtaagtatatcttccgtgttgggttagtcccacatcgaatgatgcgcaatccttttgtgtattccccaaaaaactggggcgcatcaaatgtttgatgttggatgtagttcacagtactttgaatctcctttataaaatggccacactacagaacagtgaattgtcttattcaagaaattcagtactatgtctgaacatgtgttttggttgtttaggtgctagcgatgatgagataacagtgcaagcaacttcctttgtgcatactgagcctcctcaagatggcactgctccacctgtggttacatctgatatggaagtccttaatgataaagtcataaagcaagtcatcaaggaaggccatggcaagaaaccctcaaggtttgccacatgctttggtaagtatgccataagtagtcagtttgttccatttgcttaggattgtgattagaatgaggataatatattatacctgattttgcaaattatttttttcccaatctttgtcttgcagttcactatagagcatgggttcaaggttcttcgcacaaattcgaggatacttggcaagaacagcattcaattgaactagtacttggaaaaggtaacactaaagttaattcctttattttatcctcagcttttctgtgcacatatgcatatcatccgtaaattccatgaactcaaacagcttactttgcatcacatagttccataatgccaatcaaaatgaggtttttgagggggaaaaaacttttcccaccagtaactttcccacttgcctcaccttgcaaaggctaaagacgaagtatgatatttctattgctagtaattttacctcctctttttcatgcctcaataaatctgctggacagggtaactagataactaaccgagtagtattgtacgaacagacgtgagcatcaattacacttgcctttagtataaatctttgaagcttttttttttcttctcatcaacagagaaaaaggaaatgactggtttaggcattggtgtcagtaacatgagaagtggggagcgtgcattgttacatgttaactgggagcttggctatgggaaagaaggaagcttttcattcccaaatgtccctccaatggcagaccttgtatatgaagttgaacttattgggtttgatgatgtcaaagaggtaggataaatatccctcttatcacccttgattttgattttttttaaaaaaatatttgtgaaccaaaggttcctaggaagcttacagataatgtaaaactacagggaaaagcccgaagtgatatgacagtggaagaaaggattgaagcagcagacaggaggaagattgaaggcaatgaatatttcaaagaaaagaagttcgaggaggctatgcagcaatatgaaatggttagttgtctactgatgtcattcttcagctattgtaagatgctcaatcataatccccctagctgttcttctttacaggcaattgcatacatgggggatgatttcatgtttcaattgtttgggaagtacagagacatggccttagctgtgaaaaatccctgccatctcaacatggccgcatgcctgatcaaactgaagagatttgatgaagctatcgcacagtgtacaattgtatgttattcttctacattgcataaaatttactcttacactcatgctttaacattacatgtataacacaagaaaaaactgaatttgatttgtcattcagacactaaaaatttgcaaaataaatatggaaaacaggcatatggctaaagcagggagaaatatttgtccatgattcttcatgaaagacactcttctgatcttagtgtacttgtgtaatcttttccaactcatttgtgtaaaacaaccatgattttggttttgtattgattcacggacctgttgattgaccatttgaataagaatcaaagaattgctgatcatgatcaactgcataatctcattcttcaggtgttgtcagaggatgaaaacaacgtgaaagcgttgttcagacgaggaaaagctagagctgaacttggtcaaacagaatcagcaagggaggacttcctgaaggccaagaagtattctccagaagacaaggagatccagcgcgagcttcggtcgctcgcggagcaggataaagctctgtaccagaaacaaaaggagctatacaaaggtctgttcgggccaaggcctgaacccaaaccgaaggcgtcaaatttcctagttctcttctggcgatggctggtctccttaattggctatcttgttaaactgttcaaacgcaaggatgagtagggataggacatgttttactggaaaaattatgcagtattgaccatcttgtactgtaggttggaaattcgagttgtgcagcacgcaatcggtgtcaaatattgttgttagaaactcctgacatttttgtgcttcgtgagcattggagctatggttcgtatagagcttttaaccttttgcttgtgggtacactttttttgaacaatatgtggcttgatgctatagtttctactcaaggcgagtaggcgacaacgacaaggcgtcccttgatttcatttatttatttgcgttgatgtttagaacttttagtccattaggaataccttgaagggaaggtttttatcttttgcaaattaccttcgaatgaagtttgaaataagcattgtttgcctatgaatgcaagggattccttcactcaacgtcaaggatccatttgctttcatcggaggaacagcacactcactccctttctaaatgcagcactatttattttttttcttaaactttgatcgacaatgtttatttaattacttaggtaagtaaaaatgaaaagagtgataatagatgacccatcaaaagtacttttagcatgcttttttatatttgtctaatttatataaatattttttaaaaaaacgaaaataaattaaaagaagttaaggatgccgtatatttaaacccggggtagtatgcaaaattcattcccaccaaacgtacatgatcaatactcaaatgtaaaatcatacgaaacagttcaatttaacaagaaaaaaaaacataatgctgtgcctatttatattgccggaatgaccaaaggaggtcattcaaaggtcattcaatgtaattaagatggaaagaaaaagttacaagaaaagttttacatcgacagctggcagaaaggatgtacgttttacatcgacagctggctgtcgagaaaggatgtgcaccagagcacacgccccaaaccatgtgtcaaccgtccaaacacacactacagagaggaaagccaagcaccgaaccggccatcactatgcgagaccgatcgccaccgagctaacgacaccactacgacacgaagactccaaaacaacgccctcacgagggtcacgacgccaaaagacgccgacgtcatccatccaaagactggacaaggttttcacccagagctccttgccgagggaggagggatacctcaacagtgccctcaagagggttactatgcccgaaggcaaagtcactgttggcccaaagaattgggctaagctttcgctcggaaccccctaccaccatggtacgtcacccaatccgaatccaccatctgaacatcggcagcacatggcttccgccatacccgaccgacgcccctctgtcggccggcttcatcgaaccaccatccctgagaactggcccaggacctctccgttccaccacccgccggcctcctcgccagatctggccgaaggagaacccgggattggatggcattgcttcagcagcctgagcttctcccgctaacaagctgccgcctcaatccagcttagaaactccccacagagaaggggaggagctctaggaagggtgagggtgctgaccggcaacgaggaagacgacctatcgccgccagctcccttagcacaaccatctgggcctgcgccgacgccggaaacattgccgctttggctccggtgccacccgccggcgctcccattgcccggccgccgctccccacctggccaccacggcggcatcggttgcccagccaccgaggcctggccgctcgcgctcacaccggcgaggcacggccgccgcgcccggaacaccgccgccgtgccgcttggctacgcgcaccgctgccacgacggccgcacgtcgcctagcagcctccacgcctgggacggcgctgctcggcagaacgccagccatcaccgcttctgacgtggaggagcagaacgcccgtcgtcgccgcctctgacgcggaggagggagaacgccagccgccgcgccccaccaccacggccgcacgccaccacgccgctcggcagccgcgcgccgccaccacggtcgcatgccgcccagccgcctcgcgccgccgccgcgccagctccaggcgggggatggccggatccggccttgggggcgccggatccgccgcctccccacacatccccgccgttgccgcctttgaccacgccggtggggagcttcgtcatcatctcgtccacgtcgcgccgaggagggagaacgccacaaagaaggcctcgccgccgccttccctgctcgctgccggctttgccgccggcaagctccggcggcggcgaggtggggggggggggggaagggatggaggcgcgggcggctagggtttttcgctccccgagccgcccgcgtgagatagtattatgtggaaactgtttacttaaggcattttaccaaaggcaaactggtgataaaggaaaggtaggctcagatagtctagcccacttagaaaattgcagagatgaagataacctttgctgaaacggacgtcgcgaccagtctcacaaaactgaatcaataaatcatgattataatgttcaaattgaatgatcaagcttcctaaagggatgtgataacttttttcctcttacattctgtatctgtatcaagtgtgaagctctgccttagcaacttattaattctacttggaaattgttataggtgttgtagaattaggcaggaattcatttttttaattcacaaataaccctttttttgtagttcccgcaaaaaaacaagtgaatatacttctttgatagtatattctagcattgcaaatcctatcattacttctttctaaaccttttctctttgtattaagtcttgatatggctatggcttcctccattgattggtctgaataatttcgtcattacaggatgtaccaaaatcattgggaagtgaccaggaagatgttagctacctaacttgcaagcaagaacaattttcacagatgagatttctctcacgccaatccaaccggattgcatcctccgccgccaattgcctccagattctattagtcaagtaattcgttacaagagttcgagtattaatacagcaccactcactcacgccacctctcctctcttgccagctacttagcccattcaggcccactcaaaagtttgttaggaaacctggcccgcttcctctgtggtgataagtccttccttcctccttcgttctcatcaccatcaaacagagtcttggcgccattgtcttgcggcagagcatcatcaccatcattcctgacagaagactggtcactatttactagtgtggatgaaaatttgaaccatgttcgaactacaaaccacattgaaacttgtaagtccacaggtcctaatgatgcagccatacttgacctgtacaaagaaactgagctggttgatgctgtacacatgacacaaagttcttcagaaagtgtgcagagcccttctgatatgttctcaaataatgaaatggtgagtatttttgctattttgagtttgctatcacccccctctttttaatttcatgtgatgtacactaatgatcagtgatcagaactcttcatttgaaacagatgaaaatcattcaattaaatcttcaagcgataggactttgattgatttctaccataagctgagggaagaaacactgacagtaatatttcggaatgggaaggattttaaggtcagtaaccactgattacattcagttgataaatcactggtatttttctgtttgtaattttgcaattcatttgataacattttttttgaacggaaaacaacacaagatagtgccttttcatttgataacatggagtccagaagagttctatgctttctaatgaaaacagggaagttcagcaattgcaagggagattcaggtgtgctccgcactcaagcacttgaaactattgtttggcacaaaaaaaaatgaatttaatatagtccgtcatttaaacattttccataatctccaggaaatctgtgagaaactacctgaaggtttttgtatagaggaacatactgcaaaggatgtattcatttctgaactgcttgacagtgccagagaggttcatttgaaggattttgaggaagaatatcatttaatagaaaagataccgatggtatgcattctcctatggggaatataatgtttcggcacactgcctatcttattactagtacttgttaggaattacctccttgagctagacccaaaataaactatttcattagatggtcaaatcttgcaatttattctcaagttactcgagatcaatacacttgttttgttaggtggatagcatgtaataatcacatgcacaattttctataagtgataaacataattatgtggaaatgaatggattagtgcttttccatattccgcattagaattgcctcctaactgatctgtagattatacaaaacaacgaaaatctgtagatggcacacaactaatttttctttgtttcagtatacaatatgtgcagttaatcttgcagtttaccattctaccttctgcttcttgttttcgtgggtcataatgcgatctttcttgggttattaaatttttataattcttatctgatactcaaatataagcactggaagacatgagtttggcagttgaactctacaagcacagcgtgtcaacattacataccttggagcaagcatccaaggaggagcaacgtgattacgtccgtgcctggtacagaatgcttctgttctgtgctcaagaattgcagcatggtgtggtgctttggcaagaatcctgtcaatcaaatgtctgcagcgtagtaatttcccaaggtgcaaaaacttggaacaatgagcagagcttatcatttcctttctcactgatcatttaaaagaagattgactataacatgctttctgctggtttcacaggtggccaattctttattgctcttggggagatttacagagttgcacagattctaaatttatccttgcagtccttcaagccctgggttcttgctgatcctgg

SEQ ID NO: 40554 - DNA, 7505 bp, Oryza sativa
attcctgcagcccttggtgtacttacatggctatggtaagatcatattattcctaggtggtactactagatcatatcattatgtaaagaaaatttttagcatgtaacatatttcaataatataatacatttttaaacatttaaaatatttttgttaaaataggagtggttaaggttgtggtatgaatagtatccggcaacaagcataactgcataagacacaatcacagtgataacaaacaagaaaaacttatttgcaacacaactacattcaactgacacagctgggcctgaagttcatttccgcctgaacagcataggatacagatcatacacacacccaaacactgaaaagtgctaaccatgctggcagcactagtctttacggaagatgatgatacagatcagatgcatgccttgcgactatgttacaccaccatttacagactacagagttttcctttcccaacaacagctggagatccaaaaatctcctaatgcagcgctgtgaggattgtagatccttccacctgcatatatcaaatcaaaagtgttaattaacagtgcacccaaaaatgtctattgagttcagacgaaatgcaggagaaaatagtcagttacaatgttttttttttttgaacaaaggcagaagctctgcctcatttcattgataaagaagagatgcacatcgacccaagaaagggttgaaaacaccatttgacatcagtcggttacaatgtattcagttaagtatttaggttgccatcaattattattattatttttttaccttgaaggttgcaccgcaaatttcttcttctttggcaggaactgcggtcaccttgtgctttgggttctcatagcacttcaagcctccaactccaagagcattggaatagaagcagcctgcaaccgaaatgaattagtgaacagaaacaaagaaaaggtcaattgtgcctaactaaatcaatagttagagatcaaattttatagtaaatgcttcatctttcgtcgctgcattactgttcaaagtttaaacattaccttgtgggaaaggtgcaagagacttgccacacgatcctttaagcaggtcaatgttgtcagagaaggcaacagatccatcagcagtaatcccccaatacagagacacctttccctccggatcctgaaaaagcaaatcacagcacaagaacacgtcataatctgtaaccaaaatcaaccaaatcttcaggcactgacaatgcaagtgaagtgatgcagcaacagcattcagtgatgaacaaaacttacagaggccacaaggagggtggaggtggacttgtcgaagagcacaaaggcgtagctgccggcgagctgcgagagcatgaagctagcagggtaaggtgctctgtctctcagcgtcttgtacgcctcgatcacaaggagcacctcattggcacccttggacagaccatactgctggttcaggttgccaagattgtccaggactccctcgaacaggcagaagatgtcatcttttgctgcaaatgacctgcacaaatcaagacagctgcatatgttactcaaccagctactgtttttcaggaataggcaaaagatttgtgtatctttgtattaagaggaataaaggtttttacagaaaggaaaaggacataactactgtattatgatgcatgcatcttaatagtaacataggagaaaagaacatatattggcattcaggaacagcattagtatgcttgattagtgctcagcatttctactctttaagaataattggagagtgaaaagaattaggtgcaacatcaatgatttgatctgggtaagatgtacctaacattgaattgtactacattgaagattgtactactactagttacaataaggacaaagatgcttgtactggaaaaattggagcaatggagtggaattccttggatgctacttcttcactgaatctgtctagtactagataagatatgaacaaagagtaaccaggcccacaaatcatagtggtggattgattgaccatatgggtcacctagtccagccttttcctttcagatctgtgggtatcaaaactggatagacttctggtattagcaactgattgcaaagttagtgccctctactatgaactgggccatgtgaacagcacaataataccaggtaaatgcataaatcaagagaggttttcataagcaacctagtaagttgtccaacaaccaacactatcttgtctcctttttcttttgaaagacttggaaatagatcatcctggcctatcccttttcttaaactatatctaatacattgaaataccattagattcctagtgaagaatataagttcttgttcgttgttaggtcaattaacaccttgtttgtggaaggtggcatgatgtggacttcttccattgatatgtgatgatgtccacatcgacatagacattttgattatattttttctttcatgtcttcttctgctctcgttttttataccaaggcaccaaccatttgatgccaggataccgtaacacgtggcaagagagtcctagttaccggagtgccatggcaagaaagattcagatatcgtagcaccaaggcaaaactactatttttgatagttacttttgtgcatttagttctcaaaaaatctctgcatattcttctttgtttagcattctacttctgaaacaaacaaatctataccatagttaatcatgtaattatcatctcagacatgcgacccataattcggatgagaatctatgaactgaatatgaggtttggtagcttggcccctcaacctacagaaatggattatggagttgtatttattgttcagtttgtcttacgaaagcaaacctgcctttatatgaggagaaaaactgcccaattattgactcaagatgtgtgccgtacccagaaaaaaaaaccattttgtgtttttttttgtggtaaaagcctgtttaagttactgaattacttgagatgaaatcatttttttccccagatgggtaccacatcccaaacacccgctcattctaagcatatgttttaccaaccccgtgatttttttcccttcgaaacaatcagcaaagtgttacgataagaaactattttttctctgatttagtcagacactcggatcttgggatttgggagtcccctttaaaataaaataaaatattgagagctattatgacatgatcagttgatcatcactagctaaagaagacttcactaaccaaagagtaaaagcatatagtaaatgactctgactcaggaagaacacatgaaagcaatcactgattctgtccttggttagatcttgagaaatccatggtgaagaacagtagaacttaagcaaattcagctacaattaatcaaaagctgtattattcagaggaacaggatgattagtaccttgggcggaggagggcttggttggcatgggagtaggcgaggtggccgaggtcgccgagctgcacggacacggccggctcggcgccgccgaggaagcggctgaccagctccgacgcccgcgtcttcggcgacggcgtccggctgccggcggccaccagctccgccggcacctccaccacgtcgccgctgaacactcccaacatcttctttactctccaactaattaaaccaactaatcaagctacgctagccactgaattaatcctactgctaatcaaattagcatagatataatcttggcgtgtggccttccacactccttggattgatgaaacaagaagaaaacgaagctaacaacacgacatggatggatggatggagaaatggaggagaagaagcggcttaaatagccacaaagcctttgttttttttccttcttttttttttgctaattacgtggggaccacaccaatgtttttcttttcttgtggttcatcatcatttcagttgtacaaattcctttttatttttggtttttgcatagacgaaacaaaacagcaacaaaaaaagtacaaacttctcgtgcatttggacgtgtcaatgcccactttttaccggtgctaatcatgtcttgtataatctgtgggtattggtgcacatatttgacacgggaagttagagctttgttactttttctttccctggagaaattaaaatgagtaactttatggccttttctgaaacaaaagtctgaactttctgttgctagtatatatggacaattggggatttatggaattaatggatgtgagattacaagaaacggaacctagaaatttctagagaaaatattgtgtgcacggagaccggttagctatattgatgataaaaagagaaaaacaaacgcatgtaatgaattagtgaggtgtgaagatggtgacggatgatgcatcgtgtgcagttttatttttatttgatttattgcgatttattgtgaacaacacgcaagccaggaaaacgctcaacggccattttggcctcttgggcagatattttacttgttcagcacacatccccattcgccaagtaataaaatgttcttcttttactttgatgcctttttcttcctcgaagggtgcagttttagattgtcttcgaaatgtttaaataggtaccgattctcaaatatcgagagtataccgatgcaatgctcgtatttacagtttttttttcgcgaacgtgcgaaaagattgcacgttaatatattagaagaaaaaagttatagttacacaacgcaattaaccagaccagtttatgccaagggaagggagaaaaagcgaaataaaaaactgaagctagaaaactacggcggctaaacacaaactccaagtagcgggaagggctgagccacgctacactcctaacaagtcccaaaaagcggctacaccagctaaagaccacatatgaccctccgagtggatggactccagaaccacggtgactgaaaatagtgcaaagtcgaaaaccttagagttccgttcattccacagctgccaagagacaaggagcaccagggagtcgaagctagcgcggagatgctcaggtaaataggccctggaggacggccaccagtcctagaaccagctgccacgagggagagagggcaacccatccagaagacgacagtacacggagccagacctgctgagcaaacacgcagtcgaggagaatgtggttcgccgtctcaagatcctgagcgcaaaagaggcatccgagtgactattgatgctgcgtttctggaggagatcaaccatccactagcttacagttaattaatttttaatggttgatgtgatcatgagatatcaatagtaactttgttaatattaagatattaccaacccaatcttataaacgtgtttatagggataagctttatatgcgcttattcataaaagaacgtagatataaacgcttgtgtttgtaccgtattttgcaaagggatggagaaaaaaaagaaatccagtattggcccggtcttgttggcacaagcaaaaacttgtgacacaccagatttggcggagtagacaacaataatgctctagattaggttctctcttgatgttgacccgcttgttatacctttcagaaaagaattcagtatgtgaccaatcactaggagagtctcactacgaagatttccctccctaattccgtgattagatatatctgaatgacaatgactcttttctctctgtcgaaaatattaatggcagctatgcctgttcaatcaaggaggagcagcaaagaaagatacataagatgtttatgtgattatacagataaaaggtgataatgactcttagttacttgcttaatcaaaagtaatctactcatttcatccctcatcccctactggttgatcaattgtaaatgcagccgatgacaaattcagatccacacgccaattagtggacataagtagccacactgttctgcagaaaacgactgacgtggaaccccaagttcatccagtccattaaggcaaccccttgccatgcaatgctttgtcataacaatgacttacactaatcatctaatatctcagactttcagttccgttaattaggtgccactgattatgtgtgattgtgggtgctcgcactaagaaaatcgagaaaccaaattaatttcttaatcacggcagggaatcaagattcaagaatccaccattatttatggggaaaagctataaatataaacttttacttactaaattcttattactaacaataatgtgtcacgcaataattgcatctagaattttttaattttcatctatctaaatcaaacggttaagacgattgttagtaaaaatttagtaagaaaaaaatagaacatgtagcggtgctcttattatttatgtcaacttgttaagggtttcgagctttagagaaagaaatggatagaaccacactgcgggaacatgataaatttgtgaaacaatgtgcataaatttccatgtaaaaattactcccttcatccgaaaatattatactattagatagcaatatttttttagaaagggtgggggtataaagaaatggcctttctgttagcaaacaaatcaacagatacaacactttttcacagagataagggcactaagttctgcaaaccttactctactttctacctttagtgactagcagagctcatgcttctcttttttagaaggggaaaaaaacctgacggagttaatttaataacacatgggtctgcatgatatatttatgtcatcatcaatgttttttaataatagtacaatagacctgaaaattaatggcactagtcaaacatactaacttcgtactcactactatctgaataaagcatggtaataccagcatttgctacacgtgttcttttaattagcagttgtatgtatgaacatttttccttagaaaagaattaacatcaaacttatataatatattaatttactctattaataaattgccgaagtttaataagaatcttaagtgaagctgccatttgttgtgatttagaggaagctgcattatcatttgaggtacagtattaacaaccggagatattgtaattcttcactaaattttaccaccgcactagaaatactgaccgaaaaagggatagataaattcactgtgtttggtctattcagtttatccatcactatcagtccatgtctgtagatcgtaagcaccagacaatttaacactccatttttttatctaaagtaattaaatactccattattttgatctcaagtaagtaatttaatcaatgggagtactaggtaagagcaagcttacgtatgccatgatatatgctgatagtcacatttatgtttaagaaaaaggagtaacaaacaaacccagcttgctagatcgagtggcatccaacatcagacgccatgttcattgctcaaaacaaaaagaaattctgaagaatattcttgggtcaccaacgagtacataatcattgacaactggcaaggatttgacaaggtgacatgacaggtaaatgaacggtcaag

SEQ ID NO: 40555 - DNA, 2162 bp, Oryza sativa
ggataagagcaaggttaatagtagcataggcagttggtgtcaatttcatccaccttgtggatacaataagtgacttgcaatgctcgacccatcaacttcacatcatattaaaataacttaagcttcctctcacatgcagctcactccctctgcactcatcacttttctctcgaagctggtgctggagccagcgataaagttgtcgcccactctcactctctctcctctcctctcctctcatccagctcatcactgtagctgacgtgtttctcctatcaccagtccagcttgtactattgtactcgctctaagaggaggtgtaaggtgggagctggagatgtaggctggagaatgcatggaggctttatggtggggaaggggaagaagaatcttgccgacgctgtattatttgcttgcaatggggatggagttgctccaacaattgcagcctgtcaatgggctatgggaggacgatggtgaggtgcgactgcaaccggcagaaaggtgttggaaggcatccatggcaccacagtttacctaacacatgttcatactggcagttgccaagatggccccctcaggaagattgttggtctgcctactgcaggaggcactcagtgatcttgctgtcagaacagagggggggagggggggggtgggcaagatgaaaaagaaggaataaatacatggttgtttgtaaactatagttgtataagtcataaagtcaagttgagtcatccctgtgttgacttgtgcactagtcctgattgagttgactagtccattacaagggatcatgctcatgaaaaaagagggagcagatggggaaaggaaggccattggcagccctgtgcagctctctgtcaagcttctctacctggctccgctcctgccaaagtgatgggcaactgcatcctgagcaccaatgtccagcgtgtagctcttgctgcttcctctaaccttgctctcgttctggctctagcatctaactatgtacgtgggatcctatctccctttctgattgactatgccggcccaatttgctctcaagcggcccaagtctggtcgtgccctcaagttgtgctctgtctgactagttgcacaacttgaccgcagtgaatagatagatattgataaaatgatagaaagttgcaaatcctataggctatgtatagctatgggatgtaattggtgtaagatatctattgcattccaaacagtgacactctgcatgtgctgtgactagtttgtagcatatcatccctatgtaactccagcaggtgacaggatcactggataataaaactttgttgtttagattgatctggcacatgaattgactttattacacccagtgatagcggaagttagaaattatgagcaattatatgtaaattatccatcatatgacattttgtcttaaagcttagcagcatttataactccttgatcaaaaagggtgtcatttggtatagataaagcagggatagtttttctacatagggataaagcagggataaagcagggatagcttagacagcacagtagccagcttgtggaaagcgatgtaaccatttgattatagtgtcttcaaggaacataggttttcatgttgcatggggcaaactcatatctgtatctggccgatcaatatcataggtcaatttagtcattagcagtggaattttcagttatgttccatcagagcaactgcatataatcactattatttgttggccgcatttacctaacacttcccaatgtggtagtccatattcatatgttgcatcaatctaatcactgtagtgtcatgtttgttcaaacatggcatctgtatctcttgctaactgatgacatgtatacctaaaactttccactgtgattgcagatagctaatacactgtactacaatccttcattgacattgggaacattgcataagcttggagttgctactgaaatcttcaatctttggtttggcatgttacagcaagtaaagaaaagtggcataagggcaaactttaagaggtaggtcttgttagcatatgtttgtaccttgtagtactatacatgttgtgttttatgctgcactgactccgtacattatttttctttatttgcagagaacatgataagaaggtttgttgcttgggattgacttc

SEQ ID NO: 40556 - DNA, 4810 bp, Oryza sativa
aaagaacagcatgtttcgatttcccttcgatgaagtatgaggtcagcgagcaaggcggagtcacggcggctggggtgcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaatagggctgtgcaggacacgtactcccctaggtttgaaccttacctagatccatcgcagtggccaagttatgatggagagttcttcgtttcggacttgtcattgaagaacaacacacgaggaagaagaaggacaagaaggttcaagaacgacatggacaaagtgtacaaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtaagacggggggaggtggtgagggtagcacacaggtgggattggatgacattcatattttttaatgttttaaatttagtttgcattacatttgttaagttcatattgttgcttcaatgtttactttctgttgtcctcctttccgttctcattgtgatttttccatttattttttttttttttgcaattactgatgattccattttcatttgcaggatggagcactttccggggttggaggatttctacgaggagaagcacagggctccccagattgtgagcggagaggttagcatcaacaatattccattttttttatggttgaatttattttttcttctttgatttgattctgtatagatagatcaaccatcatagagatatctcaaatcaaacacacacaaaaaagaaaaaaccccattttttttgttctgtttttttcacactgtacatagagagagatcatgattcatgagcctcaaagcagagcatgtaaacacacacaaacaacaaaaactgatctgaatttgtttgattcattttgaaatctcagcttctctttgtccccgttccagaacgcccaaatctgagcaggaaatagttcgatttccgtatgaagcaggtcccaaatgggccttaaacttgatgagttcagttaagctgcctgaagtgtgacacaacaaatttgatgatattttgtacgtcactgtatatctgttttgcttgggaacacaccagttggacgatctggcagcctggcacaattcatcaaattttatcattttgtttatttatttatttataacgtatgcaaggatgccatagatcttcttttcagttttctttttcctagaaaaatggcgtccatgcaacaaagcatcttaatcagataagctaattttcatatggctaagataatcttgccactgaattaagatgtgctttttccatgactttttttagtacttgggaacatgcttaccagtatggtaagtattagtgctggtttttaaaaatagtatttgagatgccaattctactggtcatacagaactagtacttagctcaagattgctcataatgagtagtagttgcttgtattacttgatcataatcacagagattcctgctgacccaatcccaaaattaaagttcccagttgcttgatatattttccacaacccttgtatatgatatattgtcgctaactatatgttgttatgtttgtctattgatgcagcgcttgaagaccctttgagttagaggtcacacggcgcacatactgttcgacgaccggtacgtcccgtacctacagcgggcgaagctcttggcgttcgtgaccatggcccagcgaccgatgcctctatacaacgccgctgctctgacggccctcgtggaccggtggcgtccagagacacacaccttccacctaccgtgcggggagctgacggtcactctggaggacgtcgccatgatcctgggtctacctatccggggtcaggcggtcacaagtgacacagcgtcagggaactggagggagagggtcgaggagtaccttggtgtggagcctccagtggcacctgatggtcagaggcagacgaagacatcaggggttcctttgagttggttgcgagccaacttcggtcagtgtcccgccgaggcagacaaggccacggtacagcgatactgcagggcgtacgtcttgtacatcttcggcagtattctgttccctgactctggtggagacatggcctcttggatgtggctgccgttgctcgcggactgggacgaggcgggtaccttcagctgggggtctgctgccctagcctggtttaccggcaactctgtgatgcttgccgaaggcaaggcggggacgcgaacctagcaggctgtgtttggttgctacaggttagttcacgcatattatgtttcgtaacatttcaatttcttgctaaaaagttggaagctaacgtatgtgacgcaggtttggatgtggatgaggcttcctgttggttggcccatgtggaggacccatcaggtttggccgcaccaggatgccgaccgacgtcccactgtagctcacctatgggaatcggtcccatctccagtagtaggccgcaggaatttggcctactaccactacacaaacgagatggactatctacagccagaacatgtaagcaattcaccattctatcacacatgaagatggtttcttactatatagtactaaatgtgcttcaatgtgttttatttttgttgctgcaggtggtgtggatgccatatgaggcacaggaagtgctcgagctagaactaaatcccatgtgccatatagaggatgcgttgaagaccctacggtgcccactgatctgcttctatgcagtggagttccagatgtgccaccgcgtgatgtggcagttcgggaggcttcaaacaatcccgcaccgtttctccacaagtgtcgacctacacaagttagtaatttcacttaaaaatttattttgcttgctcagttattttcacatcaacatttattaaatactcgagttggatattttgcatatgtgcagggtggaccgtcggaagaacaagaaggtgactgattgggcttactaccatcaggatcatatcacgcaatgggagaagttcgaggagaatggagtaccagaccagggtcagcacaacaggacagagttcgacgtgtacttggcgtggctccacaggacctaccgtcttgtcctacgtccggcctggacgctagccgacatagcggatgaccccgaggatgttgagaagcagagcgagtacgatactcgtacccgtcaaggtaccacggtcgagacgggacctgttcgcgacagagtggttagttctagcattaatgttgtgacttacttcatttcaacgccataaatgttgtgacttacttcatttcaatcctgcaggctcgagagctcttgcggaccgtcaacgatgcgggagtggcgctaggcacggctcctggctccgaaggagagggcggcaccctccgcaacgccctacaggtaatcgttggaataagagatgaaactacgttgttttcttcaaaatcgataacttaacagggattatttttgatacagagactacggcagcggtgtcagaagttggcaacaaggctcggctgcaggtcgaccgatgtggtcgaacatgctcatgcccaccaagagagggatgaagaaggggaggtgggtgacgaggagggcgagcaagacaaggaggcggaggaagaaggagatgaggaggaagaaggggatgaggaggaagaatgggatgaggaggaagaagaggaggcggatgagctcggtccctcgcagctggaggacgcaccagagtcatcacagctagatctctcgcaactcggcccgtctcgaccacgacgccggcaggctccttcgcaggactggaggtacacccccgatgtgcctcatcctcgcactagaggtaggaggaggtgagtgcatggttcaatggatggatggatggatggatggacttgatgcatggttcgatggatgtatggactagaacttttgcttgttgtgcatgaatggatggatggatggatggatgggatgtttttatttgttatatgtatggagttaatgtatggatgtattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatccagaaggcttgctgggccgggccatggccgattcggccaagtcccatccctaggtccagcgccattatggctagcgttgagttcccagcccgcaagccatccagaaggcttgccgggctgggccatggccgattcggccaagtcccacctcagcgccgggtgggctggcgctgaggtccctaggtccagcgccattatgcctggcgctgagttccaagcccgcaaggggtccagcgccattatggttggcgctgagttcctagcccgcaagccatccagaaggcttgccgggctgggccatggccgattcggccaagtcccacctcagcaccaggtgggctggcgctgaagt

SEQ ID NO: 40557 - DNA, 13992 bp, Oryza sativa
cagcccacctggcgctgaggtccctaggtccagtgccaatgcagttggcgctgagattggccatcttagcgccgatgcagctggcactgaggtagctgccacgtcagctgggggatcggcccggccgccacggtggcacgatatcagcgccagccccattgacgctgacacgaccaacctcagcgccaatgcgcttggcgctgagtcgacggcctatttttggttgaagtttttgacaggggttagtttcgaaataagtttttgaaaagggtcaatttgtcaaaaaaaacggggaggagtacttgtgtaagaactaagaatattgtattgcttcagtttaatacaataaatcgattttgattcgttttcttataattttaaagttaaattaagtctacagataaatgtagtaatatttcttaacacaaaacaaatatattatcagaatatattaaatgttacttcccctccatatttttatgtattatgacgttgttgacattttaaccaaaatttaactattcattttatttaaaaaaatttatgtgattattatttattttattttgacttgatttatcatcaaatgttctttaagcattacataaatatttttatatttacataaaaatttgaataaaatgaatgatcaaatgttgataaaaagtcaacagcgtcatatattaaaatatggagggagtagtatttaggaaactaatttacaagtagtatgaaggggagtagttacaattatttctgtaatgatgcccacacgtaataccatatatgtcatgacagagaagctaattaagctgatcatttttatctctgctacatttgtgtagaaaaaaccgactaggggaatgacgcattggcgacgacaaaggtgcagcaaacaatgctctctctttccttccccttcattgccaagtcagatcgatgagcgccagaccacccactgccagatctaagggacgtgtcaggttcttgatgttggtggagcttcggaatagatgacgtcacgacccgcaccctctttatatttttcaaactagctaaagaaagatctgggtgcccaataaatacctatatacaaaaaaatcatttatagggtgggcctcttaacagatccacctacgaaaataaatctattttcgcagggcagcccgtcctccccctactcttttctctcctctcttaaaaaaaatctaagccctcactactctcccatcctccaccggttagcgacgacaagagcagccgcgatgatgggaggggtggcgatggcagctacaacatgagcttgagctggcgctggtggccccgtgcctagctgattcggtattgtagtgggtggatctgttggtggcggcctcatggtgtgattctggcagtagctcatgtggcgggttctaggcagctgactctgggaggggccaatccggaaatggtggccagcgcttcgaggggtggaggcggtgggctactggcaatggcggcaaagcctgggcgacgacacttcatttggtgagctctgggcttcttgtgggcctcaggagttccaggaacaacgacgatgggggagtggtggatccaccaccacggagcttgagttcaaaagtaggatttcatgattttggaacttttatttatgttattttgtgttttattttgtgaaagcagtcaatataacttaatcgtctgtgaaaatcactttttgcatacaattgtgcagccggcttgaaaaatgctgatttctacatatacctgggttcaggcagttgctctacccatttgcaaaaatgacttttgaccatgtataaacatcaattttcctcatatacctcttcccacgcatcaagcagtcaatactaagggtgtaagtgactaatccacgaaatctacttatggaccaaaataaatcatgaacccacttatttagacttacaagtaggttcgaggtttatccacttgcacgatgagccaccgcatcctcgttggtcaccacaaccgcatctaagttctccttaggcctggtttagttcccaaattttttttctaaaaatattacatcgaatctttggacacatgcacggagcattaaatatggattaaaaaaactaattgcacagttagggagaaaatcacggacaaatctgtttagcctaattagtccatgcatgattagccataagtattacagtaacccacatttactaatgacggattaattgtgctcagaagattcatctcgtggttaatggatagtgtcggtaggagtggtaataaacctaactttttaggttataaaattttgagagttgggtctaaaataaggtgggctcaatttctataatgtttctttgtctaaaaatatctgaggtacctagagttgtgaaaaaacaaaagggtcttgacccattaacatctctaagtgtccagtgtataagttgatggctggatgaaatttagaccagttcaaaaagtttaaggatgtaaaaataaacttccttccatatataaactgcttatttgttactttgtatgctagtggtagtcattagctcacgacaacagttttcagtttaatttcaccaccccactgaatagtcttcccaccaatcacggttcacaaggtaaaggtaacataggattagacatgatagtggttaatttgaacaaacatgttaataacacaaattaaaactggtgatggcaacactttatttaatattaccacacattctgcgtgcaatgcacaagcttatgaaacggcgcttcactcaagtaagttttacgcgcaaattaaacatcacgaaagcatatgacacaacacgctacgcatagatcgacaggtcagctcattccaaatacacgcgatgtagaagaacaggagcaagcaacgcgtctgatgaaacacttctgatgaaatcttgtgcaacgctcttccattttgaaccagctattttgaaccaggaactgtatttgaacagacgaaaatgatttactcggatttccaagacgacaagggaggggtctcagagtcctgccaagtagtgttagccatcatcagaggataccggtcgccatggacattgctagcataagactcgagttcagccatttctgcaggggtgagtttcacagatagtgctgcaacattttggttgaaattctcgatttttgttgtcccgggtatggggcacacatcacgcccctgatgatggatccaggccaatgcgagttgtgacggtgtgcatccttttctggctgccatttcgttaacacgctcaaatatttcagcattcttctcgatattacctggttgaaatctagggataagctgcaaaaggcaccaatacaagttgttagttaattgaatgagaattcattatagttctacttcatttttcaaagactaaatagacgagacgtgaatatgcagcacaaagattagcttaattggaaaaggcttatgtccgatcaatacaaagtaaaaatttctaatgaacataaatgtaatttgctctactgaacatataagtgtaatttgtactaccgaatataagtgtaatttgtactaccgatgcagaagtacagaaaatgagaatacagaagaaggtacatatataataattactcccatcatccaaacaacaaggcatataattatgttacaaggtttcaaaatataaggtctgaatgcctatttaatgatctttcttctcgtttttcctacattaatcattcatttctactccatgtatgagtaaactcataaacaagatttgtttcaagaaaggaaacaaattaatttctgttcttcttattctaaaagacattaacacgacaggtatcacagcattttccctaacccgttctgctattttaatgacctccttcaaagccattcttagggaaaactgagtgattagtaatcatggaaatataccttgcgaaaatcatggtctggtagagaatccactagtttagctccactagaaaaaaaccctttaccaagtggactgtaagctactattccaattccaagttctctgaaatgaaaattagaaaaatagttaaaatgcagcatgtgatttttttttctcaacagacaaactaatttgttttttcaatgcctgcaagttggaacaatatcttcttcgacgtctctagaccataatgaccactcaagctgaactgcagtgataggatgtacagcatgagcccttctgattgttgatgccgatgcttcacataagccaatatatcttatctttccttcttcaactagtttcttgagttcaccaatctaacaatgtgaaagggaaatcaactggataatcttgagaagaaaggtcattacttaaaaggagtgcatggttctcaggacaaaaataaaagatagttcagtttatagacaataattacatgcaacgattatatttgtaaagaaaggcaaaacaactagataatcttgagaagaaagattattacttaaaaaaagtgcatggttctcaggacaaaaataaaagatagttcagtttatacacaataattacatgcaacgattcgaaaatatcaggagtaatagcagttcaggtgctacctcttatgcgctatcaaaaagatatagcacaccaaaatgatgaaaatgcatgtgttggtggatatgttctaataactattgctagtttgtagttaaatattctgaaagaaaagaagtcttcttcactgaagatatattttggttcatgtatttcttcattggtttttcgattgttaaactttgaaatgttgggttggttggtggtggttaagatcccagctattacaacaaccacaatgtgtgttgtaacttcccagtgatatgtcagtgaatttactttatgttctttacccttcaaaatcccacagctaatgtctaaaaattgaaaccctgccctatatctaaaaaaatgcaatacataaagggaaagaaaacattgttaaattatagaaaccatctgtcacatagggagtactgtaactgcccagtgacatgacagttacaatggaagatattcataagatatttttcacgcatttgtgctaaacagagagatcttaaggcaaataatattgtacttcatacctttataaatgtatgattcaaacacttgttatgaaaaaacaaaaagaaatatatgcttcattttgtattacaatgaaaaataatagcttattacaatgaaaatttaatacatgaggttaaaaaaataacgacaaaaggacaggtgccagaaaatggagcttgatttggccttccagaattcaggccaagttgctgccggaacaaaaagtcattgtacaattaaccaaacagacgtaggattttaagggtgcatcgagccgggttaaattttcctcccttcaaaattgacgtctcctacattttgttttattttaacgaccaataccacaaagtgcgatgattcattaaatagaataggaaaaaaaaaggctagcaccctggaaagcagtagctaggaaaaaaaacaacaccaccacgcaccgatgatgcctatataggatccaagaaaaggctagcgtcgtcggactggccgccgctagactaataaagaagctaccaccaaaccgcccaaaaccaaaacctaaaaagtgaacaacacactcaactctatacgtatcaaaaggattggaggggagagggaaccactctccccctcaaggcccaccaacatggtcagcttgcattggctaggtgctgccgcaagcccgcaagaggataaacatctagagagagcacgcgcaagctatcagagagaggtttcagcaggggggcctcctagacgacgtctccaaggagaaaagcgacagaacccaagagggaaaacgatgtccgaaacgccatcacagccggctggcaagaccaggctaggttttacacctgccacgcactccctatcgatccgcggatatcactccattgctccaccaccagccatcctccatcggcatgtggccaatactacaccgaccccccttccacccctggtcagtcagcctcggcatgccttgtggcacacaccaccatcaccggcctcattgttgtcaccgtgtagacctcccgtgccgtcggctgggctagcctccctgcagttgcgcacgccaacctcctaacgccttttgcgccgacccgcccacattgacctctcccaccattgccccgtcaccgccaggcgtgcctcctagcgccgctgcgtcggcctaccaccgccaccagctgctcccaaccagcaccacgcttcctcctatccctaccattgtttccagtacctttctcccgccgacggcacttcacgagcgtgccctctgtcgacggcacgtcgtcgtgcccttactgcctcgccccgccacctccacgcagccgtaccccttcgccttgtcatcgttgctggctcaggagttagcttcccaaggcgaggaggcaaaatccggatgggatgggaccagatttggcagctgcacccctgcggcctccacgttcacgcctccgcatccacgtagccgtgccccgctgtcttgctaccgcatccggcttggggaccgacctactgcaccggggagcccggatccatccaggacggggctggatataggagtcgatgccagatccagtggcgccgccttgccgtcgtcaccccggtccacctaggcatcgacgctaccactctcctctttaacgccggcagctccatcctagcaccattatggctgtcgtcacccggagctagtcggggtcgtgggctccgaccccgctaccacggaaaaggaaggcctcgctgctgccgttcttgtggccgcacggtttatggcagcccgctcgaccctgccctagagagcgacacggagccgttactaataatgagtcttatagtttgttttcagcaacatcataatcctccctccaattagtttttccaatgatttttttgtgtgtttggcgggtgttgagggtgggggcagggggcatcaataaaagatgtctcttgacaacaacctaccaccacctacattccctttcagatacagatggatgtttcacttacatataacaaaataaaagaaagggaacacaaacatagaggggaaggggcaccgaccgtgacctcgatgggcaccttcttgtcgacgcggtgctggtagtaaaggtcgatgcaatcgacgccgagccgccggaggctgccctcgcacgccgcgcgcacgtacgccgggtcgccgcggatccccggcttgccgccggcgaagaacttgccgaacttggtggccagctcaaccctgtcgcgcacgccgccgccctgcagcgcctgacatttcgtcgagcaccttcagcgcgcgctcgcgcatgcacaaattaagcccaacccctacccgagcaatggcggggacacagtggagaggtaggtacgtaccttgccgaggaggacctcgttggtgtgggggccgtagaggtcggaggtgtcgaagaacgtgacgccggcggcgatggcgtggcggatgagcgccaccatgtcggcctccggcttgggcggctcgaaggccgggcacatgcccatgcagccgagcccctgcgccgagacctccatcccctgagagcccagcttcacccgcggcaccgccaccgtcgccattgcagcagctgccattgccacggccgctgtacttcttggctgatgcctatatatatatttttctgctgtgtgtcactcacttatataatgctgcacactgggagatggaaaaatggctatattcaagatgattgaacatttcaattgctgctgctgcaggcaggaccaaacatgtcagcatcgaccaacaactggctcactctggcctgcttctgaattttttgttgacgaataccaccctctctgacagtctgactgactacctgaagaagataagctgatatcctgtgaagcagatagatctttaaatttgcttgtgaatttttgttcactgtaggttcttattttgatggagtgcacatatagttttgacagtggtgcagtagctcatagcttacacatagctgaagctgagtacacttttctttggtttgaatcatatatatatactgcaagatgtggattttaatgcttcggtttcaggggaaagtgaaatcatcccgatatcctctcgtttcgtgcatatcacctaaatagtcatcaaaaaatatgaaaaaaaaattggcaacatagactaatatgaaatatatcaaagtttaaattcaacttctacaagttgtaaaaaaaataataaatatagttgcgaatgtgagataactattttcagtttaatttattatttttgttgcaacttatagaagttgaatttggtcttgtatgtttgtggagtgatatatttcgtattaatctatgttgtcaatttttttcaaattttttaacaactatttagatgacatgcaaacaacgaggggatgtcccctagggataaaaatccacatcccggtttcagatatgtttcagagatatgcaactttcttaattagctggttcttgtttgtagagattaagaaatatagaaattcagacatgtttcatgccaaatgcaggtactccatgtccgagccagcttcctgatataaccacactggattctgatgctacatccgaggcggcaacttctagtcgatggggctccggcactttaaagttacaaatagtttccatttttttggcagaaatttgccatgtgagtatgacgaatttgaattccatcagtattatggaatagtgccagtagagtgatctgagcatgacaaatttgtactttgtcagtatgatatatagtaattgtttccgtgatgccgattggaataatggtggctgctcgcggatggaatctaaatgtcagtttgtttaattgcatgtttcttcgttctgaatgacaatctgaatgtctgaacaagtgccaactgccattgcattagtctgaagctactcacaacctagaactacatgagtgaaattgaagctactgattgcatgagcaatctgaatatactgaagctatattcagatatctgatgcttcatgagcatcatgtgattttttttaatatactgaagctaaactgaaaatgttctgtcttttggactcctttcacacatcaatcaaggtttcacaataattagtactccaactaaatctaattactcaatacttcaattcagaaaaagtacattcagagagaatataatactagtacttcagttttgaaaaaaaaaatatttcttgtgtcagttatttcattgtgtatgtaaaactgattctaatcaaaacactgctgttcaatccaattcaattactccaattcaacaaaatctacaaacttcgctgctcgtatttgaaacgagcaatccagatcatctggcacatatcatgtgggactggtacatgtcagtgagcagtactgcggagtaccctcactcttgaaacgagtgatagagacggtcgagaagagggaggaagaggcagcagctagtggaagtggttggcgagcccttgaggtgttcattctcaacgcaaaactttccggattcccaattaagcttcttgggccgtcgtcgttggagatcatcacgccatcctgcagcgacaactgtttgctgttgggtttcccggccatcaccggcgatctgcggcggcggccaccgcggcatcgacggaaactctgccactgattgcaaaaacatcaacacaccaacaaacctcgatgttagttaaaacatcactagctctcccatatctatgctcccgcctttgttggagtggcgaaaaagtttgttttttttttaatcaagatgacatacgcccatgcattaagattttagaacgtgtctatctacttccaacgaatatttggaacagagaattactcagaaaaagagaattattttttttctaatccaccatgtcggcctccggcattggacgggccgtagaaagcggacatgcccatgcagcccaggcccactgcgttgagatatccggcccctgcgagcccagcttcacgtgacgtgaggcaccgccactgccgccgtccccgagaagccggctgccgctgccatgcatggctggccggatcagtcgatttcttactttgtagtgatgctacctgggctctgcatggccactcacatatataaggttaatgctataacaatgtaactgtagtatgtaagggtattgtttagaagagattaagattctaaaaagctgctggttggtaatcagtttttagaatatagaaaagtcggggttcccagcttccgactttattcttttttggattcaacagctatagctttttaggatctaaacgaaaatgtcaactgtttagagagcttatgattataagagaagttgcacctgccaaaaactttctcaaacagatcctaagcgtcactgcatgggtgggagcaggagcatgtgtaagagcttatgcgtgcgacgtgactcgttttgaattgctaactatcacccgtagggctatcaaaaaaagctcgaggctcgtgagtcacctcagactcgattcgagctcggctcgaactcttaacaagccgaaccaaagcctagctgcaagctcacgagttttgtcaagccaagctcgagattcttatgagtctaactatgtgtgtaaattttttatcttttatatgataagttagtagctcaaggacaaattagtatatattcatgtgaaaaattagtgtattttggcatcatatataactttatcttcaatattattgattaaattttttttactaaatcttatcaacaaaatatacattatcctataatcgatcgagctcgcgagcctaaacgagctcgagccgagcctgcttaaaagctcaaaagagaattaagctcggctcgagctttgtcgagcttgagcccagacgagcaagctcggctcgctgatagccctaaccattgacttagcatattaattgctcctatagttttgggttatacgacaaaaagtaggtaaacctctctttcttactgtcaacgtaaaccagaggcggatctaggaacaaaaaattaagggactcaattatacagtttcttcaacctccagccatttaggaagctttagtttatcattcatggtgaaaaaattagagggggcgctctgcgggtatatatccatgggtcttgtgggtgtaggggaacctaagtccccctgcaccacgttggatccacccctgaacataacagctggaaggaacatttcaatttgcaaagtggccatcctgccttgaattttccatcttagacacttccctttctaaacgatattgcatataatcagttaactagttactccgtgtgtcctgtgtagtctttggactaaagatttgtccctagagtttagttttatagacctcttcaatagtaattttatcgttttcttctcgttatcaaccattgagacactttaaactctgtaaagagacttcttagaataaaaatatatactaaatgactaaatataagtaactgaagacaaatacatataagtgatgacttgggattgagttggttagtgccttgaagataagtatgatttgtgcaattgatcatgagttcaaggattgcaaaaacaagagaaaatattttattttattttattttttcattaatttcatattattgtggtacaatttaatgtatctagaaaatgcctctaccatcttatagacattttataaaatgcctcttcgtttgtacagataattcaccgtaaggcaattattagatatttttttaatatatctctatagtattgtaaaggcattttaaaagtgtctctatagtattagaaaaatgtctctacaaagcgtttttcctgtaataatgttcggctggaaattccacacccatttcctaattaaaaagcaacggattcaatatacctatgttgcagcttcatttgtactattaaaaatttatcccacaaagactatttatagcgttatagcctatcaagttagagcaggtacaataggattcagatagctggaataaaacactccacgtaagcatgcacgctgagttgtcgaaaaaagagaggagagacaccatcagttgctgagtaatttgccactagtgccacacgcactctaagaaaacatagtctcgccatctgatctctgcaccatcccacagtgagataggtatgaaaggcaagagaagataaagtaaataaagaatataacattatttatatggacagatgggtaaatgcattagagcgtacgcgctgcatgtaccagcatctatattatatttacctgacgtgagaaggattggagccagcagcgagcgcttttattagacttgctcttaacacatacacatttagttgaagcctagaaaatggtaccaagagtactaaaagcaaggtaatagtaagtaagtcaactatatgcatatgtgaaaaacagagatttattactcaaattaacagactcataatcggtacaatgagcaaataattattgcaagctctcgataaagaacaatctattgttcaacatggtttgggtgttgccagaactgtcattagttaaaactagaacatgctaatttgattcatgtatgaagatcgcatgagtttagggtttatttatggactgctctatgtggtgttctaactagttttaacacagttgagatgaacatatacatgctcggttttcaaataactgaacaatttaactttactattataaactttaaccaataattacttggacataatacacacttaattatcagtgtattttattagtgtctgtaaatattttgctaaaaaagaccgatggtgtcaaagctcgaaagcagtatatattcgctgactaagcagtatatattgagtaatatctttttttttttggctaggagtattgagtaagaataactcctgtcaatcggcaaaacaaaagcattttcgtgtgtatgcatggataaatagatagtttattttaaacattgagatgatccttcgccctttgctttaattaaaaggctataaccaattattgcataggctataggacgaatgactgcgacttacaaattcaccatttgattaaaaacaagaaagctatttaaactatttagaataccaccttaaaaattagatagcaaaataatactcagttgctgcatctatcctacgaagccggccggctgcatggacagataagatactaatataagagtacagagagtacaaatgcttacaaataaattatcagctgagccggctgagagagagttcatgtatatatgtgtgtggatcataaaaagctaagagaagaagagggagcgtacagccttggtgaaaagggtagtaggcgtcgcaagtacttccaccatctaacaactaaaccgcccaaagctgtactctctctcttctccatttagccttcacgatatgatcgtctatcgatctccttctcttagttgctctagaagttggatccctctgggtttatatagcacactagcatcggcaaaatgacactattgtgacgaatccatttattgtaatgcaacaggaaattaataattgcaccctccatcccaaaatatagaatcggatggaactcaacttagtactagattcatcgtaatatgttgagttacatccaatcctatgttgttactacctccgtcccataataaatgtcgctttgactttttgcttacaacgtttgaccattcgttttatttgaaaaattggtgcaaatataaaaaagtataagtcatacttacggtacttttgataataaagcaagtcacaaacaaaataaacaatagttccaaaaaaatttttgaataagacgaatgatcaaacattacaaactcaaatttaaagcaccaagta

SEQ ID NO: 40558 - DNA, 2284 bp, Oryza sativa
  unsure (1)..(2284): unsure at all n locations
tgtttaaaacattgtaaaggagaaataatattgttatagcggtaaagtcgtcagcgtgtgattccaaccgtaaacatttctaatcgcttgggctaaaaaaccaaaatttaaatttttgaagttgattttaaaattggttttaagatatttttaatgtaaatttttttaacattatataaaaaatttacgtataaattaatttttattttctaataaaccttttgaatttattagggaatacgagctgccacgaggctctgtgtgtgcatgaccagtttcattgtccttggaaaatataacaatggctagtagtgtcacgtacgcgtgtgatggatccaagttgggcatgtggcatgcagtgcaggctgtagctaaggccattccgtcgtttttcgcgagcctccgggctaacagcagccgtccaaaatggccggccggctttggaattggtccatcaactagctagctcaacactgtacaagccgtaaattttttaccaacctgcactacaccgatcctctgcactccaccgatcctctcctggagtttgcattactccctctgtcccattataagtgacaccgtaagttttcgtgcctaactttaatcgtctatcttatttaaatttttttataattagtatttttattgttatgagatgataaaatactttactcatgacttatgtttttaaatttttttaaaaaaatcttcaaataagatggacggttaaaattggacacggaaaatcatagctacatttaaaatgggatgggatggagtacctaatttcgcattacccaaaagggcatatccaacaacctttgtaatggagataacgatgagaatctttaaaagcacttgagaatctaaacgtgtgtttggttcggaatgagttgagatgggtcacaccaatttatgctttttatggaatggttctattatcttttggcatgagattttttttagagatgggagggtatagccagcatgttattgaaaaagaagtgacttagattagtaagctacttaagcttagttagataaggaaacattcccattcagaaatcaacccatcctacctattctcaaactgaacaccccgaaaaataaaaatgaattcccgtcctatcccatcccaatgttcacatgctaaactgttggcaacagctttttcacaaactacctattctcaaactaaacatccttaaaaataaaaataaattcccgacctatcaaaccaaacacccttaaaaataaaaataaattcctgacctatcacatccactgtccgcatgctaaactgttgggaacagctttttcaccaatagagcaaatagattgaggcatggagttcatagaagcttgtagagatctatttagcacggactccagctcttctggaactagagcccaaccaaacagttttacctctacaaaataaaattggaactggatgaaacactctcacaaaacaaactagaagggtggagttaggtttatactactccacaactccacgactgaagctaaatttaggagttgaagcattctatctttaacaaaaagagaataaaaaaggncatataagcttttattgccggaatgcctatctgtatataaaaagagagcttttgctcaagattactatttgtggattccagccgttcagtatgcagtgatctgttcacagcagctattcgccaccaccagatctgcacccacgtttctgatctcgcacagaagaatttgcaaccaagttgtgtgtatagcatagtaatgtttaccagatccaacatacaagctcactggaccgtaagaatgccaaggcttattccaccagccgcagtcccaggatacagagacatgcttaagcaatgttaacaaatggaggaccaaaattcgaccgaaaaaaaagaagagaaggaacacatatctcgactgtcgtattgataatccaccaacaattgcccaatcatatacactctacatttggagaccttcctaaaagatgtagctgtcaccttggggcttggggaggttcgacaacaagcatccatcaaccaaaaaggagatgagactttggatcaaaacagtatgacaagtatcaatatagctcccaccatgacccactggagaaatgaactgagtctgcttctctcccaagaacatctgtgcctcaaaattggccgccaaaaacaactaggccaagcctgcaaaagaataactcaccgcctgcgatcaccgaatcacaggatactgaccagtgccagtgtcacggatt

SEQ ID NO: 40559 - DNA, 1444 bp, Oryza sativa
ttatatatgttacattattactctcaaaacatgcatggtgatttctgaaatttacttcctaactaaaatactacaggtgaatcaattcgagcctatgcatcgatcgattaattaccttatatccggaaatgtcattcatgaaacgcccgatttttgcacacgaaatgatggcgtcggtgctagtgacagcctactcgaaagcctctcttgttgttgctgcatcgctcatgccgagcattacacccgcagctagtaatcgcgcgcctgtggtctcggtcgcgagagccacctgctcactgaagcttggcttgtaattccggtgggaccattccgctgcctccagataataactagacaacttttggaactatgcatatgcatatatgcacagaacatattaaattaattaacgatcggaatgtagctatccatgaaacaaatgaactccctcagttttaggttataagatgttttgactttggtcaaagtcaagatgctttaactttgaccaagtttatagtgaaaagtactaacattttcaacccaaaacaaatttattatgaaaatatattcaattattaatttaatgaaactaatttaatattataaatattattatatttgtctataaacttagtcaaacttaaaatagtttgactttgaccaaagttaaaatgtcttataacctgaaacggagggagtactagctagctagtaattgatattgttccaatatatactatatattaattacgccaaatatacaacaaaatatagtgtgtgtgtatatatatataggtaggtaggttttatgcgtttacctctgccttgttgaaagcaactaggtacctcttattgcttagcatttgatcctcaaactccctaaaggtgctcaacattatttcataaaactttctcaggtattctggtacaagggagacagcgctgtcatcccatctgcatgatattatatatattagtcagaacggtattaattataagttaatctgtgtggattatattttcaaatgtaaacttaacaaataagttcaaacaaatggtctaggtaatacaatactagaagaattttcttgtagaaaatatgtttcttgaagctagcgtggaataaaccattacacaataacatatactgcgaataagttaaattgaagaatagaacatatgcccttaattaactagcgcgaggtgttaaccagttaatacatatccatgctcaaatatcatacaataatgagtatattaagattatattgagatcgatgtgagacgtagaaataccccacccttgaatggctgcgtttagtgtccggcactcctcgatggaggtaaacgcatagacatcatatgtgtcatctaatagggtaattatcacaactatcttagcaaagagcatccgtgcaaacgacaattcttcctcatggta

SEQ ID NO: 40560 - DNA, 1668 bp, Oryza sativa
tatagcacggtacatacatgtatcccataatgcttaaaaaatatatttgtcatatcagatcgatttctataaaatgtgcaacacattctctccatagtgcgattattttctatatctttccgactattctggagctacctatgatctatcgatgatatacatatttgaatccattggcagttgtaacaatttataataaaagattgtcatttgtattgattttattgcatatttctttgagttttgtacagctagccatgaactgtcattacctatccttagatattatccttatacaaaataacaaagttattatgcatattagtacctagaaatttccttaagctctttcaagtgaacatgttgcaggaggttgaaatccaactttgctagttcaagaagaaccggattgtgcccattgtcttggtcatactcaaacatataatgtaacatttccactctcttgagagtccttggcagtggcaagcgaatcgcatgcttcacttgatcagctaaagggcccttcaaaacactatcccaaatcattgattcgagatggttccttgcaaaagaaatagtttcctcgaattctgctcaccatgtatgaagagatgggctgcgttgtataacgagattagaccccttgggtcatcagctaattcatttaagaaattaccatcatctcccttgaatttctggaatacatctgcatgtgagatttgatataaaagtgtttgtgaagttccaacatttagcttggcatgttatgctcaatctctttaatttgaacatttttatatatatggtccttgtgattgtaatcaacagttccaaaacaactatactcaatccattaactaagtagagaaatacctggagatacccaaaaaccacgctccctgagcaaacgaaaccgaagagcaacctcgtggaggttagagctagcgaattcgctttcatggatgtcttttagtgcagtttcaatctctttttcaaagaggtgatcgattcccagatgcactatttcatccactaagtacatcctccttaacatgtccttagtgggtgtaaatagtgtgcatacatcctctttcaatttgtcggccctatccctcatccattctgtcgattgctgcatgaatgtactgatttgttagtttggattgcaggaaaaaaaaagatagacttgaagagattcgtcaaaagcagtagcaatagtttagaagctatatatgacaaagagaaacataacaatttgagtaaattataccctcagtacaagaatatagtaggcagtggtcatctagtacaacaacttgaaaaataagcatgccggtacatggacatggcaatcacccgcgtttgtcaaagatagtgttactgatgattcattctgttttctttttctgcattctaaacatatcagctagattgttttgtattttgcagtgttcattattggagatagaagatatgtttgaggagtcgaattggttggaaattatgttagtttgcatgttctcagtcttaaaacaataagttgtgaatcacgagacttaggcaaggactggagatatgaatcatgacaaaactgcattgtcgagagacgataacatttaatatattgttatggagtgtaacactgtggtttctttccttgcacatgct

SEQ ID NO: 40561 - DNA, 3612 bp, Oryza sativa
cacacatttttcgtagtgttaaccacgagatgctactttgatcacaatatatttattagagaagtttaaaaaatgattcaattttacgagagtaatttgcatttatgtatgacaaatttattagaaaagtttagaacatttatgcattcatttgtaatatataaatgcatttgaaacatacaaatggtgtatacatttgaaagattttttaaacttttataacaaaaaataagaatggtgtgtattgtgtatgtacatcacgtacacaagataaatgtatatatatatacgtacacaccatttttatgtttaaagcatactaatttatattaaagcaaatattaaaattattgaacgagaaaaaatgagtcttttgctgatttgcctacaatacaaaaaatgaaaatgttctctagtcaagtgagtactccctccatcccaaaatataagcatttttggctatgaatctggacaactgtgtatctatattcatagctaaaagttgttatattttaggacggagatagtatatatgtatataggtagtaatctagattactacctattcaatggtaattggttacttcctccgtttcatattataagactttctagttttgcccacattcatatagatattaatgaatctagacatatatgtgtgcctcgattcattaacatctatactaatgtgggcaatgctagaaagtttttataaccttaacggaggttgtggagattatgcatttcttctcaacagtttgatggattattgtcactgacatcatcaccagcacccctacttcatcggccctgacgtctccgccgttgctaaggggtgactacatcctcgctgtcggttgcttttgtcatcatagactttcatcgctgacttgttatttcgtcttcatggttggcctactacgcaactgccgatgggagacctcatcgttatcattgactgctacactgctattgactgaatcaatgatatgatcatcttcatcaacatcctaccatgcctatttgcctatgcctactctgctgctgttgatggtcaacttcgtcatcacagccggctatcttggttgccgccaattgtcattatcgccgattgcatttgccatcgccaattgttttcttcttttgcatgattgatggatttcgccattgctattgatgagcgtctacgtcttcaccaccggcttgcctctgccaccgcccatggtgtcatcgctttcaccgctggcttattatgcctctactgatgggcgtcttcgtcttcttcaccgggcacctcgtctgttatctactgtttatttcactgccatggctgcataactctgtcgccgttgctgggcgccttcgtcttcactgctggctgacttgactgttgccaactggtttcttcgtctccatggcaatgtgacttcatcacctttgattggtgtcattgtctttaccaccaccaacatcattgtcagctttgatgggtgatatcatctttgtcgacgggtggtaccgcgactagggtatttggatagtttggggatcgttggtaccagggtatatgcgagattaaggtaaaaaacatggggacgaggatttttatacaggttcgggcccctgaattgtcaggtaataaccctactcctgttggccgaagtcggtcgttgctcttattcactataatcacactagtacaatatttggggtagcctatctaactgttgtcgacttggcggtctgaagtgctgactcgtagtcgacaacagggtagccttcctcctcgaatctgcatccgacgagatcaaagataacgctatgtctctcctgacagtatccgtagacaccgtaggggactagccatgcttatctctgaaatcgatatccgccgtcttgtcttggcgcatgtttgcttgtatgttgatcttgtgtcttgatctattgttccgtgtcccctctcctcctagggggccttgtatttatacccataggtgtccccttgtcgaagtagaactagggaaaccaatatggatacaatccgagtagtccttgtcgtttccatgtagaactctattcatccttccttatgcgaaactcctcctatatccgaaagttgtttccgtataagacatggtatgtggtgggtcttattgagatttagtcaactaatattaggtatgtggtatccataaccctgacagtagccctcgacttcaatgcaaatgaatgagttcatattctccatccgaagacctcggaataactgttatcgatctcacgtgacctttctcggtgagttcagagataacgttagacttcccttatcatccttgtgcgggcaccgtatagggtttgtctgagtcaatctctgacgtcaactaggaatgtacagagcatacgactaagtctcccgtcttgctgtaatcgagaatttggattgaagtcaagaaattttatctcggcggatacaccatctcttcattccgtattccttgtcgagatccaccaaccattctcgagtgatcgatgttggtatttcttaacgacgttactagaaatataattctcagcaatgacgtagaaatactccaggtatattatggtcacagagtttatccgcaagcgcacggatataccattgtagcatttcacccgagagtattccaagggtattgtatttattttatcccgtgggaagatcatgtagagagaactcaattaataatttatatattacttgtgatatttatattctaagcaggggttaagataatcaaagggtagagtgacacacaagcattactactcattctcataatatattatctgagttaagtggaaagaaaagagaaagaaaatctattcctatacttctaatatacatagtatacatacattctagttaactgatatactagctaataccctctatccgatgccctcctagtacttcgagaagccacccctgactgccgagttacttacgacagcccgtcatgaccatacaaccggggctaaatatggaggaataccctccccagggaattaactttggattataaaccggcgtggaggaatatccgtacagagctgtcaccatcagcggcccacctctcatccgcaatatataaccctaaataatgatatcccgtaatctagacaccacgtctaaactaccagatactactctaatatcatagtcatgacatagagtaattgcataagcaaacattatacccacaccaaagcatctcccagataagctagccatatattcagtataacatgaacataatgtaaagtaggtactcatatacttggaaagtatttcaataccataaatgtatttagaagagtattctaataaaagtacaaatcttacaaaagagaaaagaaaagctactagagccatacccgaattcttccgaaggcttccggactcctgatttctactctattcctattccaccagctagatactactaaactaaacttgagagaaatgagagagctattgcttgaggtgtgtgagtgaagtgagaaggtgaagtccttttatagctgaactatgacgggtgtgacggttggaatggtcggtaataccct

SEQ ID NO: 40562 - DNA, 1922 bp, Oryza sativa
tgttgtgtcaattctgagttcttggcccattcatacataagtctggttttcgacatcgtccgattgatttatcgtttgagttgatgtcgattctcctccactttattgtcattctctgcaaaaggttagtatacctaatactagtggaatattattattctaacaaacatatgcattgcaagcatcactagttctcctctattttggtaatattaacggtcgaaactgatcgataacgaccgtcaacaatcgagaaggggcagagtctgcgacggagccttgtcaacatttgtcgtactcgccttagtcgatcttggtatagaaccatagagacatggagtctttgacaatgtcgaatagaattttcctgaaatcaattcttagaaaagaatattagatagaaatagcccccgagtgaacgctcaaagggtgacatgttataatatgtatggaaaactgaaaatgaattaaatttacagaccaatgttttgtatatgagcgtcttctcttttaccgacttcgataagtcagtttgttgagtcatacactctccctagcccccagccttgtcatcagagataagttctcgaaggataaggctcttggacccttgaccggccttggttgaaaaagcgcttaccctagcccccagccgtgaagttggaaaacccaatttccgattaatggcttggttaatacgcacggtgagaactcttacatgaccagatcttacatggtcattcgtctctgcattacctgacaaggccttatccgctctgggcgtccccagtcgaagttcccttaggttcctcggagtccttgctagggcggcgtaaagggacagtaggattggtttcaactctaggtgttgtcgtggtaagggatctctgggtaaaacacttggcgatattgtgtacctgatatcaactttgttggagtagaggtaatgggaggatcgctacaccgctggttgaaaaccagttgtagccccaactcgaccacttgaagtaaaggtagtgggagaatcgctataccactggtcgaggaccatgtagtagttgtaactcaaccactagaagtcgatgtagtgggaggaattgctacaccgctggtggagaaccaggtgtagccttaactcgaccacgagaagtaaagctagtgggagtatcgctacaccgcttggtcgaaaaccagatgtagccttaactcgaccacgagaagtaaagctagtgggagtatcgctacaccgcttggtcggaaactaggtgtagccttaactcgaccacgagaagtaaagctagtgggagtatccctacatagctggtcgaaaaccaggtgtagccttaactcgaccactagaagtagaggtgcgagagatcgctacagcctactggtccgagaaccaggagtagcctcatccgtttgccgattgatgtcgaggtacgagagatcgctacggcctactggtctgagaaccaggagtagccttatttctcgaccaattgaagtggtgcgaggaccactacgctactggtcgaagaccactcatagtcgtacctcgaccatctgaagtcgtggtgcgaggaccgctacgctattgccgtagtcgtacctcgaccatctgaagttaaggtgcgagagattgctatgatttactggttcgagaaccagcgagtagaattatctctcgaacaccaatgggggcactagagttggtttattacatgtgcatctcatgtggccagcatgactcacatacccaacttgtagcatatccggatgtccgtccgcaatcatgtcgggtgatcaagccgacatcgttcgcgagcaattatccgttaacaacccttttctcaaatagcccagccatagccggtgctatgagatagatcattggtcttcgttggtaggttgggtgcgac

SEQ ID NO: 40563 - DNA, 1457 bp, Oryza sativa
cacatcatcattgcttctctgcggcgtcggcatcttgaattttgttgatctccataggtcaaattattgacggcgatagctccgatcttgttggaagacatactccggttgggttagatctccccacaaccgaagtcgtcgagtagcttgttgttggagaattcatctcttaaacccatctcgtcgtaaccttgaagcaccaagaccccctacctagcgcgccactgtcgacgcgtggtaccgcgactagggtatttggatagtatggggatcgttggtaccagggtatatgcgagattaaggtaaaaaagatggggacgaggatttttatacaggttcgggccactgaattgtcagataataaccctactcctgttggccgaagccggtcgttgctcttattcaccataatacaccagtacaatatttggggtagcctatctaactgttgtcgacttggcggtctgaagtgctgactcgtagtcgacaacagggtagcgttcctcctcgaatccgcatctggcgagatcaaagacagcgctatgtctctccagactatatccgtagacattgtaggggactagccatgcttatgtctgaaatcgatatccggcgtcttgtcttggcgcatgttggcttgtatgttgatcttgtgtcttgatctattgtttcgtgtcccctctcctcctagagggccttgtatttatacccataggtgtctccttgtccaagtagaactagggaaaacaatatggatacaatccgagtagtccttgtcgtttccatgtagaactctattcatccttccttctgcagaactcctcctatattcgaaggttatttctatataagacatggtatgtggtgggtcctaccgagatttagtcaactacaattaggcatgtggtatccataaccctgaccatcttcatgttggtcatttcgtctccatgccgactgcgtcagctaacatcaatggacaattgtgactacaatagaaggataagctacatgcttaggggcacatcaacacaagcgcgaggattatatcttcaatttggacttgttccagatacattcaacatggattcatggtcatgagtcgatttctcatgctcaaacgattagactattcattattccccacgagggacatcagctgagtgcttgcactagtcgggattcaattatcacatctactttggtattcttcatgagggataattacgcgatctacatcacccaggatatttatcacttgggatcatattaattggtgtgttctatacgtcatattttaagggtatcggtagatatattttaggtctaggcctaatatgtctgcagcccatattttcaggtgtggcctgtcacgtttttttagggactaaggcatttttttgcttaggcaaaagtgcgcgtgattaagtgcccaataccttaaaatccttttatac

SEQ ID NO: 40564 - DNA, 12860 bp, Oryza sativa
tggtaaatcctttatgagtttatttactcggatttttcaccacatgtgccatacatttccaggtgtggtaaaaccatgtgtcttttagggacttaagcacatcttttaaagcagtgtgcgtatggtgtgtgcccgatactttggaaatttctttattcacaacatacaagcttctttatagctgttctgctatgtgaatcttcaatgatgaagtcaactttagcttgcacgcatcatattttacaaagcagtcggtatatcacttgtatcatgttattcggggattcacactacatatgccatatattaatatcaagtcacttggttgactataattatcgaaaaccactcagttggttggattatttactccttaaatatatgttcagtttgttcaactaaccacatagtcgggggctacacctattaggtgcatctaatcgatgcacctaagattacatttaattatttctcagccctccacagtcttcagatttggtaaaagtacttgggagatcttggcggagatgattgaagcactcggctttggagtaatctagtttgagagaagattatcttttcaacagtaaaggtctcaggggtactgtggagattatgggtaccccatacacatacggcatggttatccgactggttataggagataacttatatctatgaaatatgtaacggatcatgacttgggtattatgttttcttgtatattatggaatggcctaaagtcctggtttgataatattgtaaagtagatttaggaaaccgataccgtattggttaaggtttctatcttgtaatcttgccccccatcttatataaggtggacaggaggccctctagagtgcatgtgacataaacagttcatcagatcaatatacacccagcggattcaaatccccaaacaggagtagggtattacctctcatcgagagggcttgaacctgtctaaatgcttgtctccgcatccatccacttttaggtctcgtgcgctaccccttttattattgccgaattcttgtttcggcagttggcgcgccaggtgggggtgcgtcgagtttaccgtcgacgagtgcgatggaacaaatctcagaagttgtcggcctcatcgttgctttaggccgggaagatcaatcccgacgggttcgatgaatgcaatctctctcgctgccgagttctttccttgatcagtttccatgaagagcactgcagcgatcagcatccagtttaatttgtctggcgagatcaaactatcaagcaacagatccattcccaagaatcggcgtcttttctcatcaacatcaaaactcctggcgatatccaatttttagcgtgtttgcttgaatcggagtcgacgtggaatcagccgacccaattgattgagcaattatcttgaagtgttgcactgtcccgtatgcatgtatggctcgtgcatgtacatgtatgcatactcgccaagaagtcatcaccgagcaacaggagcgctcaaacaaatatgcatgcattggttgatatgctacaagagtaataatataatcgtgcaacgatgcatgagctggatactacgaactattccgaatagctaagtcgctttattttctcattaattttatattctcatctgagttatattttatatgctcttgtctttttgacaagattattctacttattgctttctttggcatgtaagtatacgacaatcaagatcaatcggtcatccgtggctaggcgagatggtcgttaacctactgtcatgcacatgtatcacctacgtgggattcacagtagcatgtatggatcaacacacatgatcatccatgccgtcaggatttttgcatgaatttgtcaagggctgtgtgctgccaccatcgctattgatgggtgtcctcatcgtcaccaccggctcgcctcgtccgtaaccgattggtgttctcgccatcacggttgaatggtcacaccaccgttgataggtgtcatcatcttcaccgaccggccatctcgtccggtgtcaactggtgtgtttgcctatacggttggttggtcacaccgccattcatgggcgtccacgtcttcaccgaccggcttgccttcgccgccaccgactgctgtctccatctacatggctggcctattatgccgtcgttgttgggcgtctacgacttcaccgccggcctgcctccgtcgccgccgactggtgtcctcgtctatacggttggttggtcacaccaccgttcatgggcgttcacgtcttcaccgaccggcttgccttcgctgccgccgactggtgtctccgtctacacggctggcgtattatgccgccgttgttgggcgtctatgacttcatcgccggcctgcctctatcaccgccgactggtgtcctcgcctatacggttggttggtcacaccatcgtccatgggcgtccacgtcttctgcaaccggcttgccttcgttgccgccgattggtatctccacctatacggttggcctattatactgccgttgttgggcgtctacgacttcaccaccagcttgccttcgccgccgtcgactggtgtcctcgcctacacagttggttggtcacaccaccgttgatgggcatttatttacctacatcgctggttgcctcagccgcttacacggttggtgctttcattgccattgatggacgactttgttctcacatcgactacctccgccgtcaccagcgggaatactaaaaagctaagtctttgttagttctattctttatatgtattttccttttcctctgcctcactacatcaactggttcgccttgactagtgagtcgggggctaaagatgttatatcatattttttctacaattttcatatatctatcttgattgcttgcgacataatctgagtaaaataaagtgcctatcgagttatggagctctttttccctatgctttccgttttgtttgtcgatggatagttgcctttggaccgattcctagcacccggggctcgttggatggacgaagtaacgcaaggtgctaagtattaatcggaagaaatcaaaagcatagagataagataatttattttctggtcttaacaattgcaaaagtatccaagtagtaaattctgatccgtgaaactttgttccattaatgacgaactcatgtcactcatttgcatgtctgggaagtgcctccgccgactcccgatgcgtgggagcaatgactagtcgggcaaagtgtttaaacgtaaggagtcatcggttcggggagatcaaaattgacaagagaagaaatacatatttataaacattttaaaattcttgaattttaaacattttaaaattcttgaatttttctcgagtattatatttacatcagatactactcatcctatatgtttgttctgtaggatccagatccagatatacataaaagggattcatggctttaagcttatctcctacgctctaggaatggatcagtcagaatcaccaccggcttgccgtcgtcgccgccgactggtgtcctcacctatacggttgggtggtcacaccgccattgttgggcgtcgttgtcttcactgaccggccgctgactggtgtcttcgcctatacggttggttggtcacaccactgttgttgagcgtctacttcttcaccgccggcttgccttctccatcgccgactagtgtctctgcctacagggctggcctattatgccgccgttgttgggcgtccacgccttcaccgaccggccgcctcgtccgtcgccgactggtgttttcgcctatacgattggttggtcacaccaccgttattaagcgtctacgtcttcaccactggcttgccttcgccgccgccgactggtgtcttcgcctgcacggctggcctattatgccgccgttgttgggtgtctacgtcttcaccaccggtttgccttcgccaccgccggctggtgtgctcgccttcacggttggttggtcacaccactgttgttgggtgtctatgtcttcaccattggcttgcctttgtcgccaccgactggcgtctctgcctgcacgcctggcctatcatgccaccgttgttggacgtttacatcttcaccgaccggccgcctcgtatgatgccaactggtgctatcgtcttcacggctggccacgtcgccgccaccgctaataggcgtgatcatcttcaacacaagctatctatttcttctgccgacgagtttcttcacttaaatggctgcatgattctgccagtgttgattggccttatcgtcttcaccgccggtcgtctcatctgctgctgactagtgccctcgcctctacggctggtttataccgctaccataactgatggacgtcatcgtcttctttgctggccgccttatctgacgccgactagcttgttcgcctccacggttgcacgtcttcgtcaccattgactagcgtcatcgtcatcgccggtttgcattcgccgccgcccatggtgtcttccctttcatgggtggcctattttgccgccattcaaggacgtcttcgttttcgtcatcattctacttcttccatcgccgactggttatgccgccgtcgactggtgtttttatcttcacaactacgcgtcttcactaccggtttgcttatcttaccgccgacttgtattcacttcatcacggctatgcaactttgtcaccatggtggagcgacttcatctttattatcttcggcaccggcaaactctattgcctctacttcgcaagctttgctacttcaccatccacgacatctacaggagcttcgacatcttggcatgcatcaccaaatatgatgccgtgttattttattacaacaagtggtgttttaatcttcaatatttctactcggacatcttcaacatgcatcttcactcaagcaatgactactcgacgacaagaagctacagttctcgactctatgttcagttgtttcccaactaatcaaagagtcgggggctacacaaatacaagactttcaaaattcgacaaattttatgtcaagacaaaacaatcgactaatcagccaacgagttctatgcaatctacttcgggaatcaaaagttttgctccagagcaggctttccacttcagcaactccaattatttcactggcaattttggcttctccaaagtttctcaagtatcaagtccaagatttaatctacatgacctgtcagggagtttggagttatcgaccaatcagctcagtttcaacgagttggacaacagtttctactttcttccaagtgaagcatctgcaatagctacaacactaatttttactgctacctttataaatcaagaggcgttgcatcaatcttcgtcacgcacatgccaacattaagaaaatacttgagcatggttttcttctcaacagtttgatggattattatcactgacatcatcatcagcacctctacttcatcggccctggcgtcttgctaaggggtgactacgtcctcgtcgtcggttgcttttatcatcatagactttcatcgccgacttgttatttcgtcttcatggttggcctactatgcaactgtcgatgggacacctcattgttatcattgactgctacactactattcactggatcaacgatatcatcaacttcatcaacatcctaccttgcctctttgcctatgcctactctgctactgttgatggtcaacttcgtcatcatagctggctatctttattgctgccaatggtcattatcgccgattgcatttgccatcgccaattgttttcttcttttgcatgattgatggatttcgctattgctattgatgagcgtctacgtcttcaccaccggcttgcgtccaccgccgcccatggtttcttcgctttcacggctggcttattatgcctctactgatgggcatcttcgtcttcttcaccgggcgcctcgtctgttatcgactgattatttcgctgccatggctgcacaactctatcgccgttgctgggcgccttcgtcttcactactggctgacatgactgctgccaactagtttcttcgcctccatggctatgtgacttcatcacctttgattggtgtcattatctttaccaccaccatcatctttgtcagctttgatgggtgatatcatgttcatgttggtcatttcgtctccatactgactgcgtcaactaccatcaatggacaattgtgactacaacagaagaataagctacatgcttaggggcgatcaacacaagcgcgaggattatatcttcaatttggacttgttccagatacattcaacatggattcatggtcatgagtcgatttctcatgctcaaacgactggacaattcattattccccacgagggacatcagctgagtgtttgcgccagtcgggattcaattatcacatctactttggtattctttatgagggataattacgcttgatctacatcatgcatgatattcatcacttggagtcatattaattggtgtgttctatacgtcatattttaagggtatcggtatacataatttaggtctaggcctaatacgtctgcagctcatattttcaggtgtggcctgtcacgttcttttagggacttaggcatttttttttgcttaggcaaaggtgcgggagattaagtgcccaataccttaaaatccttttataccgcagttactcaactttttaggagttggtacaatgcattttaaaaggtgtcgaacagtgaagctttatatagctgccccgttgactttttattagtcaaggcactgtttggttttataaagcaattgattggatacaatatcgttgttttttttgccatgtaagtgtgcatttttattgaccaatattatggcttaggctgattatatattatggtacgtcattttccaggcggttggtaaatcctttatgagtttatttagtcggatttttcatcacatgtgccatacatttccagtggtaaaaccatgtgtcttttaagttcttaagtacatctgttaaagcagtgtgcgcatggtgtgtgtgcccgatactctggaaatttctttattcacaacatacaagcttctttatagctgttctgctatttgaatcttcaatgatgaagtcaactttaggttgcacgcatcatattttacaaagcagtcggtatatcacttggatcatgttattcggagattcacactgcatatgctatatattaatatcaagccacttggttgactataattatcaaaaaccactcagttggttgcattatttactccttgactatatgttcagtttgttcaactaaccacataatcgggggctacacctattaggtgcatctagtcgatgcacctaagattacatttaattatttctcagccctccacagtcttcagatttgataaaagtactcgggagatcttggcaaagatgattgaagcactcggctttggagtaatctagtttgagagaagattattttttcgactgtaaaggtctcaggggctactgtggagattatgggtaccccgtacacatacgacatggttatccgactggttataggggataacttatatctatgaaatatgtaacggatcatggtttgggtattacgtttccttgtatattatggaacggtctaaagtcctgatttgataatattgtaaagtagatttaggaaaccgatactgtattggttaaggtttctatcttgtaatcctgcccccatcttatataaggtgagcagaaggccctctagagggcatgtgacacaaccagatcgtcagatcaatatacacccggcggattcaaatcctccaacaagagtaggatattacctctcatcaagagagcctgaatctgtctaaaaccttgtctccgtatctatccacttttaggtctcgtgcgctattctcttttattatttgccgaattcttgtttcgacagaggtagtaattattaacctccataaaacttaaccgactcaatgcatgacaattatctataaatatttaagcagtacgttgtttgtggttgagaaaaattcacacacacacacatacggtatagataatataaactttcctgcgttggccgaggttcataatggacgaaaaaatcaccccacacggagggcttgaaactgggagcctgggcagcagccggggcagatgacggtgctgcatgacaagacaccacacgcttgctgctgctgcgatgcttaatgcacgcgatgttgttatttccagctgccgcggtagtgctggtggtgttcatccgcacgcaggcagatgcaggcggcggtggctgcgaaatggtgaaagcacacgctaagcggtgagccataatatcggtcgagtatatgatctagatagctctgctaattaatgcttatagcaagttaagttaaccaccctgccacccagcctatatatatagagcaattaatggacatactacttctgctagctagctagctatgcaaggataatactccctctccgtcccatttgaagtagttttcgtatctaattttaatcgtttgtattatttaaaattgttttaaaaaaatgagacactttaagtcacacataaagtaatattcatgttttatgatctaataataataaaagtattaatcataaaatagtttaaaataagacgggcgatcaaagttgacatcgaaacttatgactgcgcttaaaatttgacgaagggagtgattagaatatgttgcccaatttagttaattcggcatagaaacattaatttttgtggtctcaagccggttacgtacgttacgtctcattttttttgtggggtttgaaattaaattctagtcgtaattagcacatagtacttaacctgcagtacgattgcatgcattttacacaactttcctttgtttttctcttcacgtgtttgattttttagcggtcgtacgctgccgtaagttagccctgcaactgcaaacatgcgatgaaccaccaaatcgcagcatgcgtgccaaacctttcgaagttatccaattattgatctttctagtacagcatttggtcagtgatcattgatctggttttacttcagcagagataatttgcgaggacagatagaaaacgtgttaataaacaaatggcaagatatatacaaacacagcacgacaagagtttgtaattggcgtacgtacgtacgttgttgaaccggcaccactgcagaaaccacctttgtcggtgtcggccaaatcccacgatagccccgattttttaataaaccaggacgactaaaaagcacttttattcccggtttataagtgcaacggaactatatgatatttagtcgcggttcacctcatgtcagaggatattaggccgcctgggatctttagtcctggttagtattaccaaccgacactgaatgtacgttggcacaccgactcagcctcccatccgcagtggcacggcatttagcgccagttgacgtggtgttaaggtgtctaagtttagcgccatacgatttgaccctgaacaaaagggtcatttctgaaataagttttggccatggttcgtttgtaaaattattttttgcaaagggtcaaatcatcaaaatttgtgtagaaccggcaccttttaggtttgccgaataaaaaaaaaagccggctcgatgcgtcagctcgatcgagccgagcagtccctccaaccacatccgcaagaaaagaatgaacacatcacacaatcacaaaatttggcaacattcatgcatcacacaatcaaatattcatcaacaagtttacatcactgaatcaaacatcaaacatcattggatcatcaaatcaaacatcaacaatgaaggagacgattgggggtgctcacctgtggcagaagagacaagggagcccgtggggagcccgatgtcgtcgttgccgctgcctgccccctaccggatctggtggcggagagggctccgctgccgccgctgcctcccctcccgccggatatagcggaggggaggttgccgccgccgcggcccgtgagccacgccacttactactgctgcccctcctgccgccgagccgtcaccgactccactcctggccagatctagcggagcggaggcgctacctcccctcccgctggatctattggaggggagggcgtcgccgccgccttccctctggcggccgggccgccgcgggctcccctccagcagccgggccgcagtgggctcccctccagcagtcgggccgccgcgggctcccctccagctccccgctgccacttcccctccagccgccgccgtcagccctctcaccggatctagcggagggaaaggcgcggtcgccgctgccgcctccgccggccagcagctggcagcgctcgggagagaagggagggagagagagagaagatcgtcatggtggggcccatcggtcggctcatccgatgctggctcggctcgatttctacaggtgtcggtgttttaaaaaaaaaacggcacctataatatattataggtgtcggtttttaattaaccggcacctataatatactataggtgtcgtttttaaaaaaccaacacaaaatataataggtgtcagtttttatttagaaccgacacctatacttagttaaaggagccggttttttacgatttcaacccgcaaaggtgggaaaaggcctataggtgccggttttagcactaccggcacctatagtggcaacacctatttgatattttgtagtagtgtgtcacgtctagaaattcatgaaccagaatttttaagctaaatgtgcattaaaacccctttccaggaccaaccagggtacacaaacgataatttttgacgtacagatccacgacttacaaaaatataaaagattataaatgcagcggaaaagataaaggcgagataaacttgaaagcttgactcctgcaacgggtcgactccactctacaggcaatccttgacggcagtgacgataccaacttctctgagaaggctccaactgagaaggactctagctctggtgtggggaagagagagcaagactgagtactacccactgtactcagcaagtcataccgggagagaaggcacgatgcaagatatatccaaagaaggctaaaggctcatttgcataaagcaggcatttaaaagcagtagttgaaagcagtaaaactgttgtagtaaattaagcaatactgatcatcacagtccaacactacaccacattgcaacaggcccaaccaaccacctgaactacaccagtccattaagccaattattaaggatgagactagtcacggtgaatctggttgatcgcccataaccgcgggcacggctattcgaatagttttactctggccagaggtgtacaactgtacccataagacatgattccacacatgtcgtcatgccccaaagtaccaccatggcactgcaaatggtggaatcatgacaagaccctttgcataaccctcctctaaccatccacaccacgctaaggtttcacccccacccctcaacaggcagtgggcagccccctcgtgcgccgcggtgaacccagcagttggacaaccggacacccagccgacctaactccatcatgccctcccttgccaccggtgcctaggaaagggtcgagctatattacaagtcaaacagttacccactcccgcttatggtaataagcacgataagtctcctagggtttcccgtgaaccggtccttaattgccatgggtgcgaccagcaaagccatgcatccacagcccaccattcaatcgcattttaattggataattacggccaatgaaacatggccggatgtctcgagcacgcagctcgtcatgaagctaaatgtctaataatataattatctaattatgtgagctagtggatctaagcatggctaagcattttctaaaccaacatcttatccgattaatacccaaattatcaatggcataaggtgaacaacatatggctgagtaataggacccatcccatatgatattgtaaaataatataacatttaatagaaaacggaacatttgtaaattgagtacatcatgatcatttgtaatgcatgacttgccttgctctcgcactgataggacctcagcaacgtcttcgaagaaccgcagatcgacgaaacggccgaaatctatgcgactaacattggacaataccatgcgatcgccagacaactaccaggtaaacgttctgaaatccggtttgtacgcacaagatatcatattaaatccttagttttcataacccactaccagtgaaccacagcgcagctatcctttgctgcagggtcacagtaccagcgtatgcatgcaccgtgcgatctcgccatctcggttccatccgaccatccatcagcacgttgtggctccgaaagattctctctcccattccccatttccccacccatgctactctcaaatccccaatccccatcccaaaatcctcaccacctccgccccaagaatcctcgctgccgaccggcgccgccgtcttctcgcagagcaagcagtgagcgctacaaccgccgtgttgccgagccagccagcattgtcgccttcttgccttacttgccagcgacccggtgccgcttcgtcatcgtcgagccagcggtgccgctcccttcccttggagccactattctgcgccacctccctgtggagccgactgccgctgtcgtcttctcgtggagccaatataatggtcagcactgccaccaaccatctcgtccatggccatctcctcgcttcttgtggctgctgctcatcggctcctccacacctctccaattggtactgccatcctctactactt

SEQ ID NO: 40565 - DNA, 10462 bp, Oryza sativa
  unsure (1)..(10462): unsure at all n locations
ttttctttcagtaaccgatgtttatgaccaagggagtgaactgccacaagtcttccaggttcttctctctgaagaaaataacacatttatctgtggtaacaccatttgtaattatgagcacaaattatattcaaagtattttagcaatcgtttaatttctttgggatagctcagttattaattttgaaaaaggatgaatgtcatgtgtgcatcctcgccatttatccagtggttggtcataatgcatatgttgactgtgcagaaagatccttaacactgttattggcgctcatcattatttagattcctgcagtcttaatagttccctttgtcaggctatagagtatagtattattctaatttacatatactcatttagttgcaagcgtacaatacgttttgtgtaccaactattctattggatttgtagagctacttttgaaatagaggatttctacagctacatatgcacattctcctatactcttgcagattgatttcaaccgtttctagaaacaaattgccgcaatctaaccattttaggtcagtttggtttcctcaaagttaaaacaaaaaggcagcttagttaaacaccgtgttagcctatgggctactccataccataactatacatgtaaatatcacttacaagatagtcaagattatgttaatattttacaattagttgtcaatccttcacaatcaagtgcatatggaagtaacaaaagttccatatcggtggtggcctttggttaagaaactttcagcctcatctatggatggttttcagaaggccaatttgtatgcaaaatagctttgtttggtttatccgctggccaattgataacaaaatggtttggggtggattgaccagagccttcaacacggttgtatgtggttgtaaatggcgtaacgggcatatgtgtgctacagagcttgtggttgcaaatgatataatcgtttaaaagtttggtaaattaactatggccaaaatctttgtgatggcattcaatgatgttattcggtataagtttgatggaaatattttgaaagcttgaagcttaatatgaatcgtgggaaccttctcctcttacctcacagttttaaatatatatatatttgttatgcccgcggcaacccgcggggtcccggctagtatagcttatttgtaggacaaatgagcagtctctgagtacagatgcggataggtgtccgatgtcactagctgccgacttccgaaaaaaaaaaaaaggtcactagctgcctgcctaatttctctcaggtgaccttgaccggccgtttgactagtaggtagcagaattgtatactagtaaaacctttggtacctaatatactaattactccctcaatttcgaaatgtataacgctattaatttttcgtacaatattttaccattcgtcttattaaaaaatttatataaatatcatttatttcattataacttgttttatcatcaaataaaatataatgttaacttttacttttgcatattatactaattttttaataaaacgaatgattaattattatgtgaaaagttaacgatgtcatacattttaaaacggataaaatactatctattttgtttggtaccaccaataccttctaaaattatccttcactatcagtagaacgtgcagagaacgtccaaggaaatgaaatgtgtgtgggaggcaagcagccgtcgctccatcccggtgagctccagtttgtcccatttccatctgtccactccaattagggactatactccttcggtcctaaaatataataaattttaaatggatgggatattttctagtacaacaaatcatgtactaagaaatgccccatctgtccaagaaatatctacatactgtgttagttaccaatatcaatatttaacctttctctgcctaatatatacggcgtactacatattgagttccaaagtcactctcattactgctagaaagttagaaaagtctaaatctagagtatctcatagtcgtgctgttaagccacataaaattatacaaaaacaaacaaaaaaagttataaatttaatttttatttctctattatttgaggcttaaaaacaggtcacgaagatgataagaaagcggcaagatatttatcttagaaagtaattaaaacagtaagagtaggtacaataagttgcaataacagacattaggagctccacttacggttttggatgacccagaggagagagaagggaatagcgaaaatgagtgggcgacaaattagtcgaccggctcgccccacgcgtggcctgaggttgtgggcctaccatggcaatagtgcacctgcgctagccgcgtcgcaagccatcgtcaccgcggccattgcatgccatcatcgcctgcgtgagccatgcctacctccctcctccactgtggccgccgccgtcacctacatatgtcagaccttttccctcatgctcgttcacgcggctggtgcgatcacttgtgtctgccttgcccacgaccgttatccgcctgcgaccacactcattgcccttgtctatctcggctactccttgttcgccgtagcttcttccatcatcaccatcgcttgcatctgcctcggctgttgctgttgtgcgcctcgccctgtctacctcgtccaccttggctaccgctacactggtggagaaactatctttggtcggtcgaccagatttcacaatagttccggtcgtattaaaaaccgggactaaaaacatctttagtcccggtttaaaagctccagggcacttttcaatctttagttaccaaccgatactaaagatctatttgtagtcccggttgataacatcaaccgggataaaagatcgccatacgctttactcacggttaccaaccgagactaaagatctatttatagtcccggttggtaacaccaaccgggaaaaaagatcgacgtggagatcagagaggcgtgcgcgatcggatcgaggtatctcctcctctcctcctctccttttaactcctctcctcaaccttatctattcctctccttctcctcctactgccaggccgaaggccaggccggcgcgacgacggcggggcgcggtgggccggccggccggcgtggctgtggcgcggcgcgcggtgaggcggcggcctacggcggcggccagcacgagggcggcagggcacggagggctgcgtggcggcggggcgcggagggccagcgggccggcgcggcggcggctggtggcctcgcggcgggcggggcggcgcgcggcgagggagcggcctgcggcggcggtttttttctttttttttttgagaatctgagattgttgtgcgatgtatttgattggatctgagattgttgtgtgatgtatttgatttgtgtgtgatgcgaatatgtgatgaattttgtagaagttgtgatgtaatttttttaatattttgtgatgtatctgagtatttgagatgatcgatttgtggatttagaggcaatttgaggatgattgatttgggattttggggatgggatgggggtgaaatcaatttattaaaaacaatgaagaaaagaaaagaataaagagcaaccggatctggcctctttagtaccgggactaaagatgctttatctttagtcccagttggtaacaactccaaatgggcccaactatcatgccaatgggctgagggcctcaaaattagtgtccacgatgaaaaacgggccaaatggagccgtcccgggttcggccgaaccattttggtggccgttgatcgccaaatttcatgtggatggtcctgatcacatcctaatggcggttccggggtagtttggtcatttcgcataggctgtaaccgtcatacctgcctataaaaggaggagctcactctcattttcaatacacaactttgagctgaattacaagagactgtattgtatcttttgtacattagaataaggtagagagctctggaggagtgcccagaagtttggcgctcatccgacttctacctcgacgagtgtagcttcctaggaggaattctagaggagtactggagctgtcggtacaatctgctccgggttcggagaaacttcttctattaagtaagcattcgtgtttctttcttatgttatttaattactttgtttaagtaagatatgtttccatctttgcggattaattgtttagtatttatactaagtactctagtactaggactccggatagagaaggaagttcttgcgcaagtattagagtagtaattaataacttagacgtggtgtctaagttagagattacctttgtttgttgtgtatgccacggatttgtcagaggtaggcggcatgtggtgacagccctgaatcccgtcctagtaatcctccacgttcggatacatcaaagagctatagcaggaaccacgctggtagaccagcgggggtcggttcccgaagcaacagatagggaattacctttgcttagcttagataattaaaccacatagaaagtcctctctagcctagtctacctatcatcagttgttgtccttggatcgtcttacgcttaggtagattacatacgttccctgagtttgatatccttttggggtcaaccgaagatgaagtgctacagcggtattccgtgcgcttgcggatttctctgtggtcgtaagaaataccaacaccacccgccgccggtcatcccctccgccttcgtcttagccttcgactcagccgccgtgctagtgagatggtgagcggagggatttgagagagagggggggttgagatagaggagagagatagagaggggtggggaactgacagtgggtcccactaatttttttaataaaattactgactggactgccacgcatatgccacgtaggaccaaaaccaccgcggattgagccgggggggttatttgtcctgtttcaatagttggggggtgtagaatgtccggttttcgagttcgggggtgtaatttggtcgacctcgatagttcaggggggtaattcgtactttttctgaaactttatatgtgaattgtagatagtgtccatattcaattttgtagtgtaacgttttttcattccagattgtttatgtggctataaattcgttacaaactttcactattttgataaaatgaatttttgaatttttaaaatgagctcaaatggagacatgctctgtagagctcgacgctgcaagtttatagttgataactttttaatttgatggcccttggagtaaaaaatatatgttacaagttttatgaaggatgaagtcaaatgaatagcatctatgggatagtcaccaaagatcctgggttggaattctatgccatagtaacgaaagctatatgccatagtcccgtgttggaattctatgccatagtaaggaaagctatgccatatatacagtccatgggttggaatattctatgccatgcatagtcgtccccggtcatagtcctttcgttagtgactatggcatagcaaggaaactatggcactgagtgagaggccctgggttcgaattctatataccgcccgtgcgcatatttcacatctaaaattatgtacttgtgattaaaaaaaataaaaaactggaaatcccgtgtaatagaaaatttttcacacgcccaaggttgcgggtgggatcgtaaaatacctatgtaaatgggttatggaccatccgcaaaaatattaatttgctgtagtagcgtcggagatatatttaattcactacaaaatacaaaattgttaaaatttttagtgtgcaatgggagtgttgtaattggatgttaaaataactagctgaatatataccccaccgcgttgctgcgggaaattaaattatgtaatgtgtacaaataagatgcaatataattattaaaacccaaacaaattaatacttataaattttgagccaaaaataattcagattgcatggtgttatgagagaagaaagaatagacaatttgaaccatagatctattatctaaaagctataaataattaggatgatatggtttgatgagagaagagagaaataacattaaccgacacttggtggacgaaggatctcggagcccatgcatcgctatatatagtacacctgctgtagtacttggcaactggagactggagtagtagctattgctagtgcgtacagcacatcgtacggacatggaggacaaggtggtgctcgccatgggcgcatccatcctgttggttgtcgtcgtctccaagctgatgatatcatttgcggcaaagccgaggctcaacctgccgccggggccatggacgctgccgctgatcggcagcatccaccacgtcgtgtcctccagggagagcgtccacagcgcgatgcggaggctggcccggaggcacggcgccccgctgatgcagctctggttcggcgaggtgggcacggtggtcgcgtcgtcgccggaggcggcgcgggaggtcctccggagccacgacctcgcgttcgccgaccgccacctgaccgccgccgccgcggcgttcagcttcggcggccgggacgtcgtgctgtccccgtacggcgagcggtggcgccagctccgcaagctgctcacccaggagctcctcaccgcgtcgcgggtgcgctcgttccgccgcgtccgcgaggaggaggtggcgcggctcatgcgcgacctgtccgccgccgccaccgccggcgccgccgtcaacctcagcgagatggtcaccaggatggtcaacgacaccgtgctccggtgctccgtggggagccggtgcgagcacagcggcgagtacctcgccgcgctgcacgccgtggtgcgcctcacgtcggggctcagcgtcgccgacctgttcccgtcgtcgaggctcgcggcgatggtgtccgcggcgccgcgcgccgcgatcgccaaccgcgacaagatggtgcgcatcatagagcagatcatccgagaacgcaaggcccaaatcgaggcggatgatcgcgcggccgacagcaagtcatgcgcatgctctctggacgacctgctcaggctccagaaggaaggcggctcgccgatcccaatcacaaatgaggttatagtcgtgcttttgatggtaagcaagcctcacaacactgtctttatgttctacttacctccgtttttctaattattcgtcttatttaatttttttgtgcaaatataaaatatttgtgtcatgcttaaacaatatttgatgataaatcaagttacagtaaaatagatgtataattacataatttcgaatgagacgaatggtcaaatatatcttaaaaaatcaatggcgttatacgttaaacaaacaacaaacggagggagtagttacacggacgacgtaccaaagtaccgacaaaaacatctttaatttttataatagtagagatgaagatagacacaaaacctaccatataaacaaattataataatattttttctctcacaaggaacatgattacatcctaattaacctctatacctagctaggatatatacactactacaaacaaaatttttcatgcgggtaatgcgtgcaggtgcacacacccaggggtctgcgaaaattggattttcacgtgcggacgcttatgttgcccgcacgggaaaaaaactgaaaaaaaaaaaccttgaatcggcggcgccgcctcctcctccccgtcgtcggcggcggcctccgcgcaagctcgcctccgcgcagcccacctaccgctggcctccgcgccgcccgcctccacaccgcccgccttccgctggcctccacgccgccggccgccggatccgcgctcccctccggtcagaccaccgccgacgcccctcctctccgccggatcaggggaggggaggggagtggttcccgcgtggggggagggcggccggccgctggatccgtgcggacggctgccgccgccggtccgtgtggggacggccactgcccgccggatcctgcgccttcaccgccgtggagctgagttcgccgcacgccaacgccgactgccgccgtcagcgaagcgcggacccgcaaagtcgttggagagaagagaggcatgagagagagagagagaggggtgaggcgtgggagagaagagaggtctcgcagataaagataagaaaaagagaggagggaggggtgaggagagaaagaggggaaattttgaagtgggtgagagggaaagagggagtactattttcgcatgcggctctcttaataggcctgcacgggaaaactgacttattttcgcgtgcggtccatttaagattttcccatgcggtccttttaaatagaccgcacgtgaaaatgagccgattttcccatgcaggctgagttaccacccgcacgcaatctaaaagtgtccctgtctaggaaaatcattcatatagtagtgatacccaatcatcataaagttttagttcaagaaaacagtctatatatgtagttttagttaagtattctcgaacaaatggcatacttcttagtaatgaattaagtttaggctatatatgtaggcacgtattatgtgcattaggtggtatggataaaaaaattattcaggatgattagtaattgattaaaaaatcattattccaggatatgtttgcggggggcaccgatacatcgtcaacaacactaatatgggccatggcagagctgatccgttccccaagagtaatggcaaaggtgcaatcagagatgcggcaaatcttcgatggaaaaaacaccatcactgaagatgaccttgtccaactgagctatctcaagatggtaataaaggagaccttgagactgcattgtccattgcccctcttagcccctcgcaaatgccgtgagacatgtaagattatgggctatgatgtacccaagggtacatctgcattcgtgaatgtgtgggcaatatgcagggatagtaagtattgggaggatgccgaagaattcaagccagagaggtttgaaaacaacgatatagaattcaaagggagcaactttgagtttctccctttcggctctggccgcagagtatgccctggaataaatcttgggctagctaacatggagtttgccttggctaaccttctctaccattttgattggaagctgcccaatggaatgttgcacaaggatcttgacatgagggaggcacctggactactggtttataaacacactagcctaaatgtgtgtccggtcactcacattgcttccagctgtgcgtaaataccagtgtaacagataatgcatcttccaaaagaccataacagcacaaggtaaaatatgtgctgtcagagacatgtggtcttcgtgatttcaaaataacttatgtgcctgagcagaaaagcatagtgaacctacttatgtactcatgcgtaatatttttttctgccaaagaaattataagtgtgtatttttgtgcccataaatactaggtgcaccatgaaattacatcctatagtaattaaagagctcattgtacttgtatatttgtcgtcctcccagaaatatagttaagcgtgtacgtatatattttcacggacaacatatgctttctttcctatatatcattcattttggtccagctccgaatacatgcgaactccaaggcgcctacgcacgtacggctttcgtttgattgatcactccaagtttctactccgtatcagattgttggtacggactatgtgttatatcgatcactggcctgttgctgaagttaattttgcaccggctatttaattcatatgtatccggccatcaccatcagtttctgtgttctccacggaaggggcggagctagaatgaaatggagggtgatgccacttaaattattttactttagatcgaatttaaactgacgcgggtgcctaagtttgtattgagggggtgcatacatggtgaaaatagatgagtatagcttaaaaaattttcttgaccgggttcctgggcaccccctagtatactctagctccgcccctgctccacagctggcgcctatgctaatgctaccgcgtctcttgctcggcctactctggtttcaagactgtgggatcctcctccatattggccacagatacaccaatattggtggtctcatgtacggttccttattggaggtctttttttttcctctttaagaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40566 - DNA, 6401 bp, Oryza sativa
tagaccaatatattttatctttccttcttcaactagtttcttgagttcaccaatctaataatgaaaaggtaaacatcaactagataatattgggaagaaataaaggtcattacttaaaaggcagacaaaaatacaatgaaaggtagtacactttatttgtacacaataattccatccaacggtttggaaatatcataagtaatagtagttcaggtgctagtatccgctttcagaaacacagtagttcatgtgctcgtattgatagtttgtagttagacgttctgtaggtcctattttggattctcacattttctgcaagaaaacaagtcctcttcggcaaagatatttgcaccaatttcagtcctctcatatctatttattttggttatgtattgctgcattggatcttaaaattgttaaactttgaaatgttggtttggtttgtggttaacatctcagctaatacaagaacagcattgtatgttgcaactgccgagtgagacatgcatgtcggtgaaaattaattattggctcagtcttgtctttacgtcttcaccttcaaaatcccacagctattgtctaataaaacaagccctcctctgtatctaagataaatgtactatataaatgaaaataaaacatttatcaattatagaaaaccatcgagaccaaatatggagtaatgtaaccgtccagtcacatgtcatcgacagtgaaagatattcatgtaaggttttccacgcaattatgatttatggcacacagtccagatcttaatgcaaataattttgtgctacatatctttacaaatgtatggttcatatctttacaaatgtatggttccaaattcttctcgagaaaaaagaaaaagaaatttatgcttcatgttgctattacaacaaaacctaataacttatcctttcagaattaagagaccaagttgctgcgaacgaaagaaaggatgtcaaatgtataatataatcagctaaacaaacttaagaatttaagtgtgcttcaagccgggttcaagttttcctttgatcaaaattctctcttacattttttttcagtaacttcctaatcctctctccattctagttttactaatgaatatgaaattaattatctacgagatctagaaaacaaactaaatgccttttttttcattgatagaaagatgtccatttttctggcagttgtcccaataatactactacctccgttctaaaatgtaacaacttttggctatgaatctggacacacagttatattttggaacggagggagtatataccacatcacctcaaatttttataacccacggatgattaatctataggcgaaatcgtcttcctcttttttcttctccgatgaatccacaacaccgcagttttgtctttggatgatccatctatattatttcccttgtttttcttctctcatgaagttacgtaactttagttttactttaaatggtcaatttatataagatttaaattatcacaaaccatatcatctgaattatttataacttttttaacatgatcgatcaaatattcagtccagctaaaaaacaaacccatcttacatcttatttacaaaccttatttctatcattatcatgcaaactttccccactaccacgcatctggttatgtataatcttgacaccaacccattgacaaatcaacacatcactacctactttccctttcggattcatcagccgtcacttacacatgtatgcctttcatccaaaaaaaaaaagatatttcctccgtaaaaaaaatcaaaccactttccatttaaaatctattcaaaataagtaacaattttataatattatatttatcttattagtcaccaatcattcaattgttttttacccttataaccttgttcacaaacagcccttatttaatttaggccatataagtgatattttttctgtgacggagaaagtagtaaaaagaaaaaaagtaaaaaaaaaagcagaaaggaactgaaagacaggagagagggaagggggggcactcaccgtgacctcgatgggcaccttcttgtcgacacggtgctggtagtaaaggtctacgcaatcgacgccgagccgccggaggctgccctcgcacgccgcccgcacgtacgccgggtcgccgcggatctccaccttcccgtcggcgaacgagacggcgaacttcgtggccacctccaccttctccctcacgccgccctgcagagcctgcatgcatattggcgcacatgagcattccgtcgagcaccttcagcgcgtatcccagtacccaaaaaaacaaccgaagcgtgcacgaagaaacttattataactgaccttgccgaggaggagctcgttggtgtgggggccgtacatgtcggaggtgtcgaggtgggtgacgccggcggcgacggcgtggtggatgagcgcaaccatgtcggcctccggcttgggtggcccgtagaaggcggacatgcccatgcagcccagcccctgcgccgagacctccagaccctgcgagcccagcttcatgcgccgcaccgccgccgtcgccggagcagcagctgccatggccggccggaatcggatcgatcgatcgatcgattaatttctctccgccgcgcgcgcgattccggtggtgatgctacgtgggctctggccactcacatatataggggttaatgctagtaccatacaactcactgcaagcgtcgctgcacagtgtgcgtaagagcttacgcacgtgcttctccgttcctaaattagccaagagttactctgagagctattttttatcacaagaaaataacactttaataaaatagctctaagttatttggatcaagtgttattttgagagctatttggctttaatgtaccttcccatgaaaagagatagagagaaaagacactttttcagaggacctcacccgaaatatcctcaattagcacttcttggatgtgatagttttttggtggattattttcaaatagccctcaaatagctcacccttttggatctttttgggctatttaagagaggactaaaaaatatcccttggatccaaatagggccttttgaccatcaatttattacatattgtatttcttaaaaaaataaaattagtgtcatataaaagtatattttaaaatataaatctagtgatatattatatagtatgtataatacttagtatatagtatatatagttagtatgattattagtcgaaagttaacgagtttaattttatttaaaaagatgtcatcatatagttaccgagaccaaggagtatcagtttttccatggccatacgtcggattcacattcccatggccgcgcgtgcgggtaaggagtgtcgcggtcgaagacttggaagtctttcttggataatgatggtcgttgggcgaccgggcgggggaggaaaaatcgttcgctacccccaaccctgtccccgcgcgcacgctgatgtcgctggtcccaccacaatacctgcctccacctctaacaaatcaaccacatattttaaaaaccctctagtaaggaaaatttggtttattttttgttccaccaaaaatattccatctagtgtactcataatgtttcactatgtatagatgtaacgttgcagtgaattgaaatattccattgcaacaaaaaaaacccacatattttagaaacccctattaagagaattcgttttatttgttgttccaccaaaaaatgtttcgcctagtgcatttataatgttttactatgtatggatcaaatgttgcaatgaactgaaacaatctttcgctatttgctgaaacattatttttatatacggtgaaacaacacccaatttaaacgagtgaaacattttcgatctacttagcgaaacaattccgatatatctggtggaacatcgtacaacatttaaaaataattcaataataagcttaaaaaagttgtcgccggaatatatctatgtgtggtcttgttttgaagatttaattgcaacaaatttaatggtgcaatcggatcatgatttggataagtaatttaagaaaaaaatcagtttaaagtaatttttgcacgtaaatcaggcgcggacgtcagcgcccgatttttctccgaatcattgggcgtccgagccgtaggcagccccgtctttcttcgcgcgagaattctcaggcattatccgtggcaaattaatacagtagcatattaccccctgtagttttggataatacgagaaaaaaaaataaggtaaagagttccaagtttttttttattcttctcaacgtaagagatgaaaggaacgtttcagtttgcaaaggacaaaatttcatacaagacactaaagaacataaaaacgcgttacggctaaaaaaacactaaagaactggtaatttgttgggggacaaaagcttttgagttaagactagagtgaagatggaatataatggatcctaatgatgtacttggggtgatggtaaatttagatttttcataatttctaaatttttactttaacatcatgtttgaagcatgtgattttaggggctttctcgttttattaagaatttatcattccagtgtcatctagtaaattaccagtcttttaaggatgtcttttagttgtgacatatttttttatgtctatcaataaattacataaaattttttgtgtgttttgtagcaaattttgccacaaaaggtggtcgtgctgccttaaatttccaactgtgtcgctttcctttcttttttttcccctcacgataatagcagatggccagatgctcatatatacgctaatacgcacgagctcactcaccatatatataacatacacgcacacgctatctttacgagtacctctaaacactggactgttataatattttaatattgacgaagtaattaaccacatgaatgcatctcagtatcaacgggtacatcgtctatcgatgatagaataattagcttaaatatgagcacctattctggctagggacttaaactcggattacccagatagatgttttctctttctaaacaatattgcataggggtcatcccttaattagttaatctactttgttttaggtaaaaaggggatgaaagcaacataatgctttcatttgtagacatagtaatatgccgtggtaacactacgataccatttaataatacaataatacgcgagtctttccaaaccatgtaacccccaatatacaacttcataatcagtgagtggacagatgtaggtttttttttctaattgtacagagagctgggattttggaaaaggaatgtgaattcgtaaaatgcaatatcttggtcccgcacagcggcgaataaagctcccaggccggacaaatggccgcctgggctctgtcgctgggacctccatcatttatttattaacaaaaagtatataaaaaataatgttaagagccaatctatatatctctatctatatctatatctatatctaaatctatttctgtatctttatctatatctatatctatatctatattatatctatatctatctatatctatacactttctattagctctcatgttaatcagcaaaaaaaattgaccattgattaatatcatgatatatcatgaccgttagatcctaagatctaatctgcatgtaatttatgggccaattttcaaacccaacatcgatctaatctgcatgtaatttatgggccaattttcaagcccaacatctagccaccgtacttcctatttccttctactaccaatctggagtaagagttactctctccttcctaaattgatcgtcatatctatttatacacaaagacgaaaaataatttaaatcacataaatcaagacactatgcacacattctctcacaatgtatgcatcgattaaaacactatgccaattacatgcacacattctctcatgctacattaattgtattctgataaaatccgtgtctatgcggttatatgatgatcaatttaagaaatgttgaattttataatatgatgaccaatttggaaaggagtgggtatataatacagatgggcatgtatgtgtttatgatatatatatagctaaattattgcacaattatgctaaaaatacagatcttattgcaaatagtattatactacatatctttataaatgtatggatcaaaatctttttgtggaaaaactcttgtggggttatttaatgggaattgctaattactactaagtacttcctgataatagttccgtgtgtgcgaggtttcatctacttcctcattatctgcattaactatatttcttgggggtggcagttacttgtcgagttgatcgtgctatcactactataaaaatattagattggtgtcggttgagaaacccttttaaa

SEQ ID NO: 40567 - DNA, 5844 bp, Oryza sativa
aatgctgttaggaggcccgaatccgaatccaaaacgtgtaaaactttatctcttgtctcctatggaccaaaagtgacgtggtgatatgaaaaaagacttggagaaggtcttggtttggtcctcaatcaacttcttcaatcatccatgcattccttacgcttggtctcttttctttcgcccaagaaagtacctctgcaaacgaaaatacacaaaactcattgtgtagcaacatttgttcaaatatatagcaagtaaatcaaatatagaacatatgcacctttggttgattaatatataagataatcatggttatatccgagctagtcgtgtcctcatcaatatggcattagctcagtcatggcaacggttttcaggctaatttcaccaccccactcaataatcctcccaccggtcacaattcacaaccaaattccggtcgaacttttctttggggaaggtaagaaacaaacaaggttgtcaaggcagtcagcactcaacagacatatgaatatagaataagacatgacattgcttaatttgaacaaacatgttagtaacacaaaattagtgattgcaaaacattattttattattagcacacgtactgcgtgcagtgcacaggcttatagaaccgcacttcacacaagtaggttgtaggcacaaacatgacgaaagcatagaacataacacaatacagacagacaggacatctcattccaaatatacgtgatgtataacaggagcaagcagcgtccagcgactgatgaatacgttctacaaaatcttgagtgcgctctgccattcagctattttggaccaggactttgtatttgaacagatgaaaacaattactgagctttccaagatgacaagggaggggtctcagaattttgccaagtagtgttggccatcgcctgaggataccggtcgcctcgaacatcatctgtgcttgcgtaagactcgagttcagccatttcctcaggtgtgagcttcacagatagtgctccaatgttttggtttaaattctcgatttttgttgtcccaggtatggggcatacatcgcttccctgatgatggacccaggccaatgcgagctgtgacggtgtgcatccttttctggctgccattgcgttaacacgctcaaatatttcagcattcttctcaagattctcttgttgaaatctaggaatatgctgcaaaagtatcaatacaagttcttagtaaatgagaactcattgtagttctatttaatttttcaaagaacaaatagacaacacagcacaaagatgagtttaataaaggtttgagtccgataaatgcagagtaaatatttctattgaacataagtatttcgtgttaccaatgtagaaagttcagaaaatgagaatacagaagaggtacttaatgggtattcccatcattcaaactacaaggcatagaattaaactagaaggtttcccaatataaggcatgaatgcctatttgatgatctttttcttgtttttctctacattgatcattcatctctacacgatgtatgagtaaacacaccaacaaaattggtttcaagaaaggaaataaattaattattctattcttcttaatctgaaagacaataacactacagatatcacagtgttttcgctgtcatgctctgctattttcatgacctcattcatcccaattcttaggaaaaactgagtagtaaaccatggaatttaccttgcgaaaatcctgatctgatagagactccactagtttagctccagcagaaaagaaccctctaccaagtgggctataagctactattccaattccaagttctctgaaatggaaataagaacaatagttcaaatggagcatgtgattttcttcaacagacaaactaatttggtgtttttttcaatacctgcaagttggaattatatcttcttccacgtctctagaccataatgaccactcaagctgaacagcagtgatagggtgtacagcatgagcccttctgatagttgatgcagatgcttcagataacccaatatattttatctttccttcttcaactagtttcttgagttcgccaatctaacaatgtaaaatgtaaatcaactagataaacttgacaaaaatacaatggacggtagttcagtttatagcatgccaaaataatcaaaacacattatcaaaatgttatagtaaattttgctagtttgtagttagatgttcagaaagagaacgagtcctcttcagcaaacatatttgcacaaattttcagtcctctcatgtttacttgttttgatatttgtgcattggtttattaaactttgaaatattggtttacttggtgcttcagatcccaagctattacaaaaacagcattctgtgttgtaactgcccagtgacatgtaaatgaaaattattggctcaatctttactttgcctcgtcacccatcaaaatttcacagctaatgtctagagtaaatgaaatactatatatctaaactaagtataatatttaaatagaagaaaacatttttgaattatagaaaccagcgatcaaatagggagttatgccaaacagaaagatcttaatgcaaataatattgtaccacgtatctttacaaatgccctagtatgtttagtcaaaatttaattggtacagccctaagatgaggtagaaaaacaacaataaaaggataggtgccatgaaatggaggttccttttatcctttctctccattacataccctgtcctttcagaactcataccaaattggtctgaataaaagaaaggtcaatgtacaaacagccaaacaaacttaagaatttaagtgtaccttaagctgggttaaaatttcctctgttcaaaattgacctctcttaaaaaaaatttcaacaacttcatgatcctccctctagtaagttttcccaatgaatatgaaattaatcatctagataagtgggtaacaaacaaatgctcctttttttttcttttttgcttttcatcaataaaagatgtccatttttccggcagctgtcctaataattattgtagaatattgacaccaacccattgacaaaccaacccaccaccacctactttccctttcagatacacgtgtatcttttgcatccacacatcacaaaattttctaaaagaaagaaggataggagactggggaagtggcactcaccgtgacctcgatgggcaccttcttgtcgacacggtgctggtagtaaaggtcgatgctgtcgacgccgagccgccggaggctgccctcgcacgccgcgcgcacgtacgccgggtccccgcggacgtcccgcttgccgtcttcgaacgcgatgccgaacttggtggccagctcaaccttatcacgcacgccgccctgcagcgcctgccgttccgatccaagcaggcattccgccgagcaccttgagcgcactctcacaaacaaacccaaagaagcaagagagcgggcaggacaggaggaaagtaggtacgtaccttgccgaggaggagctcgttggtgtgggggccgtagatgtcggaggtgtcgaggagggtgacgccggcggcgacggcgtggtggatgagcgccaccatgtcgggctccggcttgggcgggccgtagaaggcggacatgcccatgcatcccagcccctgcgccgagacctccagaccctgcgagcccagcttcatgcgccgcaccgccgccgtcgccggagcagcagctgccatggccggccggaatcggatcgatcgatttctctccgccgcttcttggttcactccgtcacttatataatggtggagtacatacaaatacagtgcagagcaatcgttagtggttggtgggagaaggaatgtgtcatgtgttcaagagcttacgcgtgtcggttattattatcagggaaaattgcaaaaatcaccccataagtcacttgaagtttgacattccaccccgtaagttattttgttgcaaatgcccacccacctactcaattttgttacaacaaccaccccagtaaacacatgcttcaggggcgtcccggtcaaatcaggtccccgtgcgaaatattaaaataggccatagtagcctagtaaatttttttatagtaaaattaaaaacgggcgtgacgattagctgatcatcagcgatgaagcagaagcggaggctagagggaactggggagaggagatgaagtggctgcggcatcgggactttggcgatacgcgacgacgcgaacgcctggatgggagcacgatggaagatggatcgattcaccttctgcagcgttttgggccttgtgtttgatactatttggactgcaagttaacaaaattaaagcctctaatattattatatatatggcatacttaatattttaagggcccttaaaatttgggggccctgttcggtcgcacagtccgcacgggcccccgggacgcccccgtatgcttaaccgaatcaacatgtttttataaaatgtgatctatcaatgtggtccttaccaaaactaaatatttctagagtattattgatacattttatgtaagattccacaaataaaattgtggacgagagtttaaacattgtcgcactgagtttcgctatatgaaaaaaaaacaatcaaatatggaaaataagtctaatttaagcacttagacaagattgacttggctagcttagcatgtggtaaccctacatccgcaataacaaactgatttggttaagcacgtgcgcattgggtagggttttcaattctgaaattggattttatgccggggattcctgaaatttcagaaatttctggctgaaattatttgaaaatttgactgaatttgaataaaatttgaccaaatttttttaaaaaatgcaaaaatccaaaaattttgggcgagacttgagcatgccggtgggatggcgaaatttcggaaatttcgaaccaaaatttcaaaccctagcattgggtggtttttcaacaaaacttagtagcgggtgggtatttgcaacaaaatgacttatgggatggaatgtcaaacttcaagtgacttgtgggtgacttgtggggtggtttttgtaattttcccttattattattattattattattattattattattattattattattattatttccttttgtatagcctcggttttttatgtctcttgctactagggggccctaacgggcgatcaatcgccagcgatcgatccaagcgatcagatccggcccccctccccctataggcaatacctcctcccactcctcccccttcctccttcccttcttctcttcctactacagtacaccacaaaaaaaattttaaaaaaaataaaagttagaaaaatttatgtatagaaatactatatataaaaaatttaaattcaaatttgaatcgaatatgtaaacttttgacttataaactttgggtctataaactttaggtgtataaactttagatgtatagaaatactatatatagaaaatatttgaattcaaattcaaatttgaatcggatataattcaaattcaaatttgaattgggtatataaactttaggtctataaactttaggtgtataaactttagatgtatagaaatactatatatgaaaaatatttgaattcaaattcaaatttgaatcggatatataaactttaggtctataaattttaggtgtataaactttagatgtatagaaatactatatatgaaaaaatatttgaattcaaattcaaatttgaatcggatatataaacttttgagatataaacttttggtctctaaactttagatgtgtaaacttgagatatataaactttaggtgcataaatt

SEQ ID NO: 40568 - DNA, 728 bp, Oryza sativa
aggcgagcgatcgccctatagcatttccgcttgctactcccttaatacaacttcttccaccgctctcgtgccacgcacatcaaggcccctctatagatccgagtacgagtacgatagcagatggagttatttggcttgaacggtgtggacaacgcagggtgtgccacccaccacatgcgagtatgccctgggcttctaaccatcctctacggatcttcctgcctgtagtttatcaatgtggatatagggcaggtaccttcctcagcaagctcatggagcctaccatcacctttgtatagcatcgaaacataagaactaagcaagtcttaccaccaaaaaccaaaacttttagcggaaaaagttaccctcaagatctgaaggagattggtctgaccagagtaaatcagccggtccaactgtcctttgtggtgccaacgcctatcgccatgcatcgcagttctgaccggaatagatcggccactccaaccatactttgcaccaccgatgcttgtcgccgttgctggtccaacaacccattatgccaccggtgttaccgccgaacccgagcaaatacaaatcaaagaactctattagtgtttacaaagtgcacaacaacactcatctctaaaaaattgactaaactcgaaaccgtaactttttctttcaactcaactctcaaaaaatcgataccgagaggtctcaaccactcttctatatatatatacccg

SEQ ID NO: 40569 - DNA, 3843 bp, Oryza sativa
ttttcatacaagttttcctgcagcaacgtatatataggatatcataatgttacatgtgcatcacgaaccaaagatgcaagtagagcattgtaagcagcagcaacgtacagcacatcgtcaagttacatacacatcatgaaccaaacatgcaagagcaaaccatagcaaacaagaatatatattttcttccgctattcatgtgcaaccaggagcactacttcttgaagagagacccaagcagctactcctctttccatgaggacaacggaggggtctcacaatccttccaggtgttggccatctgagcgtaccagtcaccgtgcacatcagcagcagcagcgtaggattcgagctcagccatttcgtcccgagtgagctccagggacagagccccaacattctggtcgaaattctcgatcttcgtggtaccgggtatggggcaaacatcgtcccccttgtggtgaatccaagccagtgcgaactgcgcagccgtgcatcctttcctcatcgccatcgcattgacgcgatcgaatatcttggcattcttctcaaggttttctggttggaatctaggcagattctgcaacaagtgaaaggtcgtactcagcaaattaagctgccaattgattgctcaaaggagtttaaaaaatgttagagtttttgtcaaaatatttgtacgtagtcggttatagtttagaacttggagttgtaggaggtaaaagaatagagagtaagaattagacgctattatagactctctcttagatagagagacgaacatgttgtaaccatatgatgacttagcatagccgagaaggagcggctgcaggtggcatccaaccgatggtcattataactctagttcactgtaatatgttggatcgggaggggtgcacgtaaagtgcctcgaagatgtaggcttcggctgaactccattatcaaatatcgtgtctcggtgtcgtcatcaggtgtttctttcttgtttagccatcaatgatgatttcggggctggtttgtaacaaaaaagtttcatgatttcagacctgtttttgaaatgtaaagcgttcggaattgttttagaacttttcaataacgaaaacaaatttggaattattttttcttggaacggttttggatttgttttttcctaataatgtctactgtctaaaaagatgataagttagatttgacaatgtgatctctgaactgtggtattatcttatgatagtgctattttttgttgctaaaatttggaaattttatctgttgttttaaaaagatttggaagctcattttgacagttttttatattcccataaatattagttaccgtattcgcttttattcatattcgctccattttttatttgataatattttattctgtatatagggatttttattccaattttaattcctaaaaaatatgaaaatgaaaatgaaaatggtagagttggttttctaactgtttccatccctataggagaccgcttaaggaagtcataaagatcatttctattttcacggccagccacttgattttcacgggtgggtgctagcagccacttgatttttacaggtaccagtgaccacatgtggtaacacgattttaccctgtacgaaaatctgtttatttacacaagcagctccattcagatagctacccatgtccacgacatttttcagacattgctcttaaatgcccgcctatgtcttgtcttttctactattgattatcatgcgaactcctcacaagacgaaccatcggatgccaatcaagcccgccactaccacactacgcctcctcacctcccatgccatgtctattagagagcaatgagaaacctctccataatctcccaactttttccactatctacgacaataatgtactcgtcgcgtcagccgtagtacatcgccattagcgaggaggacaacaatgatatataggagcatggggacatctcatcctccttatcgtcactggccgtattgtcaggcgaaattcctggggataattagcatagcgaggatgaccggtggtacaacaggtcctatcaaaggactccaacgagggcccactatcgctgaaggaatagaacgaggacaaaagtggcaacgaggctgacgactcggatgagggcagcagaggcaggtgcgaagaaagagataacctccttgatcaccatggtcatggcggcgatggcagcctatgaggatgacaccatctaagaagaggcacggctagagccgatgccagaggcatacccaacatggctgaggtgccgaagctgatccccagcttggccaaggtgcaggaggagggcacctatgtggctatggcaccataggatgaggcgaaggatgggccactggctagagtcaagcatagccgtcaacagaagcagagattgaggagaatgcatggcccttccccattgcgctggccctatcgcgagctctgacactgggctaactgtcaacgtttgatccacaacgatggtgaagcgccgccgccacaactaattgtacatattatttttttagtataggcccaaagtacgacaagtagcctcagtagtatgtaattaggggcaaatttttgatttgtattatagtactgtgttttctaggttaaatcttttgtagaaattgaaatatatgttaaatcattttttcatccaaatcaatatatattaaatatttcatctaatgtagtatccagagcatttgacaggtggacaatttgttgtctcacttaaatgtggtcccaactttttcccaagcggctttcataagccactgcatatgaaccaggtctacttgttattcaaaatttcataataattttatatgaaggctgattgaaattaacagaatttcagagtgatccttgctacaattcctttagtttaattcagtcaataactctttcaactacaaacttagtagggattaccactaatatcatgatatctgacaaattaaagtcaaatggtatgcaacatataacgatagtaagtaaccctagtaatgcagatattttaatgaagaaacctaacatagctggaacacattacacatgtgtagtggggatcatagtgataagttgtttatctcaatcagagttcatatgaatttttcaaatctttgaaaattgttatcgcaggcggcgacttgcatccgcttggaaaaattatattccaatgcagatatctgaagacgccgcctgtaaaaatgatttagacataataaatggccaagagtgattcaaagctctaactccatgaattggaaaatataatccgaaatcgtcaacgccgccactgttgcccactagatctgccaacacagccgctgcccaccagatttgcacttgtcacgacatgaggccatgacgggataaccaacgctaggaggatagccagtagcgtcggctactgcagaagggagcgcatccatatctaggtgagtgttgtcctgttggatctcccaccatcaccgctccacatccaagtacgtcatcctgtttatccgacggtttgtccggtgatcatgtggtatgtattgttcagcattttttgcagtcccacatttcatgactaccttgtctgatagtccacgtttcgagaaaactgagcgagtagtaagcatatgataatttaccttgcgaaaatcatggtctggtagagaatccactagtttagctccaccagaaaagaactaaccctctaccaagtgggctgtaagctactattccaattccaagttccctgaaacagaattaacaaacaatagttaagatggagcatatgattttttctcaatagacaaactaatttg

SEQ ID NO: 40570 - DNA, 4358 bp, Oryza sativa
cctactacccactattgtttgggcccacactgataccgagtttagtaagaaacattgagcatgctctaataatgtgaaaggactacaagataattgagctattccactaaattatcacaacaaaaaataattcgtgccaatatattgtactattgcaacgataatttttctgtgacaaataactatattttattgcaacgacttaccatcattgttttatttagtatttttgttgcaatagaaaataagatattgccaaaaaaaacattaccgttgaaaaaacatgttctatcatcacaattttaattttgtggcaatttgcatagtacatggctgtggtatgttactttttactattttctattgccacgatcaacaaattcgttgcaataaaaaattgtcatctcataatttaacttatttttttcatatggacatggattagaacaaattttatatgaaagttatagctctcaacgagatctacaattttataggtgataactttttcatttgaaatcttttatatatttaaatccgtgattcaaatcttagttagatatgctcaaatggaacgatatgcattttctaacagaattgatgcgtaggtgagttggtaaaggagagcacacgtgaaggataggtcttgtgttcgaatcctagcaaagacaaggtatcaaataataaatagttatgatgtagaacaaaattagttaatatttaaacttttaatttagtatgtagaactaatgccacatatggagtggtggcaataattatttattacaacgatgtgaagtgttgcaatataattttttggccacatccattccgtggaaacatcaaaatttattaccgctaaataaaaatcgttaaaataacctattaccacgctatttattaccacggctagtaacgattttaaaattgtggcagcatgtatctatcgccacaattttagtattgatcgatgccatgatttttttcatggcaacaaattatttttctagtagatcaactagataaacttgaaaagaaaggtcattacttaaaaggcatgcatagctctcaagataaaaaaatacaagggaaggtagtgcagtttatacacaataatttaaagcaacaattcaaaaatgtgtgctagctcgtatgcgttattagaaagatatagcacaccagaatgatcaacacgcatatactgtggggcgtgttatagtaattattgctagtttgtagttagatgttccaaaaggaaaaaatgagtccttcaatcaaagttttttctttcccgaaagaatatgaaattaattatatagtgaaatcgataaataatcaaatgctccttttttttgctcttcattaataaaagaagagtaaattgcactcacggtgcatcaacttagcaggtgggtgtaatttggtgaaaaaacttgagaaatgagcgttctagtgcaacaacttggtaggtaggtgcaatttagtataagaactttataagtaattatataaatgtaacaacttgtaaggtaggtacaattttgatacaataaattaagaagttatgagacaacttaattatttggagattttttttatagattcaatttttaagtacttattttgataatatactagcgtgtatttgtataagcatatttatatttttatcctaataactaattactaaaagtcaattaaactggatgtaaaaattattatatttcggttgatatttgagaaggtgaagaaaaaaaaattcttaaatgttaattggatgtaaactgtatgtgcagtataatttttaaagattaaatctaatattataaggtaatatatgtaggattatatgttaatgatatattgacatcgtgaaaaaaaaaatcaactagcatatgcttagccaagttgatgcatcaaaatattaaattgtcaagttcttgtactagaacacacccacttgtcaagttgttacacttatacgttcatttctcaagttctcatactttatcgcacctatctaccaagttgttgtaccatgagtacagtttactcataaaagaattaagagttaattatccgtttttccaacaactgtccgaataattatgaaccttgacaccaaccatttgccaaacccttcaccaggccaccaccaactttccctttcataatcagcttttcatcactcacccgtttatgtttctcataacaaaacaataaacacaaaggcaaaaagaaaaaagaaaagaaaagaaaaaaacagaaagagagacctgagaaagggaaggggcacgcacagtgacctcgatgggcaccttcttgtcgacgcggtgctggtagtaaaggtctatgcagtcgacgccgagccgctggaggctgccctcgcacgccgcccgcacgtacgccgggtccccgcggatccccaccttaccgtcggcgagaaatttaccgaacttggtggccagtgcaacattgtcgcgcacactgccgacctgtagcgcctgccttttttccaacccatatgcaaacaagcattccgtcgagcaccttcagcgcaccactactcgcgcatggcgcaaatcaacccaaagaaagagagggacaccagtggaaggaagaggaaggtactatacgtaccttgccgaggagggcctcgttggcgtgcggcccgtagatgtcggcggtgtcgaggagggtgacgccggcggcgacggcgtggtggatgagcgccaccatgtcggcctccggcttggacggcccgtggaaggcggacatgcccatgcagcccagcccctgcgccgagacctccaggccctgcgagcccagcttcacgcgccgcaccgccgccgtcgccggagcagcaggtgccatggccggccggaatcggatcgatcgatttccctccactgtacatctgtacccatataatgctgtgcgatggcaactgcgtagttgggaggagtacccttttttttgacaaattgactctttttaaaaacttatttcgaaactaacccctgcgaaaaacttcaaccaaagataggccgtcggcgcagcgccaagcgcatgcgcttggggttggccgtgtcagcgccaacgaggctggcgctgacatcgtgccaccgtggcggccgggccgatcccccagctaacgtggtagctacctcagcaccaaccacttcggcgctgagatgccaaagttcagcgccaacgggtttggcactgaggtttggtacttagaggccggccgaggccgccccagccagcctctcctctcttctccccaccgcggctgcgctagggttcgtcgccctctcttctcccctcaccaaatctcccccaaatcaactcaaatcgaaggggatttcgtcgggattgagttgaggatcgattgagaaggtaaactcctctagaaaccctaatttcccccatgttttattggatatttcgcattgtttggttccaaccgtgggttgataatatttggctccgattgcgatgttaattggataatgtgggtggggatgtagtgcggaagacacatattaatcttgctccatttggttcatgtgtggtgatggttagggctttgttggattgttgtgtggtgattgaaatggttgcaaggggttgatttgtggtgatgtctaggcactttgtaggagaagagaaattttttttgtgaataatgtgtagtatatgagttgaaacaattatgttatgttttatggaaaaagttggacatgttgataggtttggaagttttgggattgctatggtatttagagattattttcaattaattaatgtttatgtatgggttaaatattgtagatggatagattggtccggcttcattatggtggttgtgtggtagatgaaagtaccggtggaagccaatttgagggaatgattgttagacagttagtgtttcatgcgaagcctacatttgaggagttaatgtctcgcattaagcatgaattggattggagtgatgagtcagttggtatgcaagggagatacgatgtgggcgccggtgtcatgttgcataagtttatgttagacttgaatggagagatcgaatggcaaacatatatagatatagtattggggtcacatttcaaagctcttgaggtgtttgcatggaagaaagagggtaggaaagggaagaaagaacttatagacctgaatgaaagtccactcatagaataacccattagttcccacgaacagtcggagaggtgtagtaggaaggaagaattaattgaggtggaggtgggcgagggagtaaatgatacagcggatgtagaggtcagggaggaagtacatggggaggagaatgtcccggtaaggga

SEQ ID NO: 40571 - DNA, 10145 bp, Oryza sativa
tgataccaacaaacaggtgaataagttattgtaatgacaaaaaaagtattttatgaatattttatcgtacttttgtacatttaaatctattacaatttgtaaaattagcagaatatttttttcatttttcatttgtatttgtttatactcgctattgtaaatttacttttactcgctatttttgatagtcatatttcatcttggaacacagaccaaggataagtaattctacttatcatccatttaaaatgctactagtcatttctcgtaaacaagcaattcattaatatttacatttctcgatgtccatatagctgatcttgcgtggaagaatgaaaagtcatgcattaaatccgagaaagttattaagatgatatgttgttgaattgaaatatgcctatcaaaaataaatttttcaaatttggaaatattactatcaaaagtagatggagggagtactatttaaataattggttttcgtttaagaaatcgcgtgcgtaattatattttaaaatggtattattgttaaatctgataatagttgcttttataatactatatctttaataactactaaaataataggaatctaaacactatttatttgtcacagagatttttatatgtataccaactaatagatgcatagatgtatgcatgtggccggtttagcccaaagcacacgcatgtacatgcgctggcttgggcgaactgtgcacgtattgccatgggccggttagtgtggatttggatcgtctgacttcaccctgcaaaggcatgggcgtgcagtcatcatttttccactgttcatgcaatcaacgactcacgcgtcacgtgcacttaacttttgttaaaacaatccatggcagccaacaagacaaattgataaggcaatccgatgaggtctcgtcgtcgctgccgccgccaccgccgtcgatgtcatcgatggcggtgactagctagcttagagcttgtttgccggtacgcacgtgtcgtcaccagccatcgcctcggcccaactatttttttttgttgttcttcatttttttggccaaagtatcaaatttgctaagttaatttctttgttcaactgttgatggtactaaagacatattttagctatggagactgtagtttctagtgtgttgcttttgttttgtcaatccttttttatttacgatctctattcactatctgttttgatttatgatgtggcttactcttcattgtactccacttagtaatgaatggtgttgtttgaaacttatgaattgcctgatgggatgcaatgatttatgctttgcttgctgagtagttgaatcgaatgcattctttgctctgctctgctcattgtaatcatgttccataatccaaattccaagtagcaagcatgctgcatcactgccgattgatacatccaatcctagcaggaagatggaatggcaaagcttccatatgatgcctaagacagcggcggtggcagcacgtagcgaaagacgagctccaggctattcgtcggcggcggcagcgatggcgggactacacgtctaccaaactgaccctgaagtctggaaaacgtgcctcttgttgggcggccataggtttgtgtggacaggagccgttgcattgcatggacggtggataagtgatgactacacgttcgtgccttcacagggtgaagtcagacgatccaaatccggttaatgtggctcagccgtggatgattagatgggtatttagcaaaggcgcatacggcgtgcggaggaactcggaaattctatcgttattaggggtgtaagtggataactcgtgaaacccatttatagactaaaataagttgcgaacctacttattttaacctataagtgggtgtgcagctgacccacttacactcctgatcgttgcgcacaacactctttctcacattgctccacgtgtcgctagattatagggacatctggaccaatcgaatctggaccgaatgaccggctttagaaatatagatggtgtaaggagcgatatatattaaaaatagtttgttccactgaataagatgagtgactagtgacaacctgacaaaagtacgaacatgtcaggtgtaaagatgtcgacgcattttttgaaaattaggaaagttattctcaattattatgcttgtcctgacaatattgcatttatgcatttctttgattactctaaagatatgcacgcgagcatggtacactatacttacacacctacgaatgcgtccatagcatactctcaaaaaaatggagacatatggtaaattcctgaactcattaaaatcatgttaaaagcgaatctatgtgcgattttacatgagaagaaactacagaggaaggctgaaaacttgaattctctagcggagttgccaattcatattggcatctattttgtcaacatggacccacctaaagatttacgatgttaatggagtcatgagcccccttaatttagaaaaactcttgacttcgatgggtttacaaaagattaaaaccggttagcgaagccaatttagagatgaaaccaacactagtagaaatgtgcccatctacgaaaacattattgtcatggtagatactgaatttgtcattaagaaatttctatgatgaatttgtgtgctcttaaaaaatggagcgtcacattagtttctttatgacgaatcaacaaatttcgtaatagaacttgtgtacatccatcaatattcaccttatgaggaacccgctttctgccacttgcatcttcctatatagattcaaagcaatttgggcatgcatcaaatttccccacaagtaatgggaggcactctccaatctgaaaaatagactctcgctgctggtgggccaacgcaggttgccggcggggaaattgatggccgagacatggcggagaaaccctagtactagggccaggggtgtgccacagttgtgatacctgtgcagtgaaggcgccctcatagtggaaaggtcagctggaggtgagagaggttttggcaaggtggatctccttgtgtctggaatctttggggcagcggcgagtgaggttgtaggggtgcttgaatgaaatatgaattgctagtcaagattagttatatgaacgtgaggctgtaaaaatgctaacatagtaaagatgcatgcttggaggaacttggacaatactgtgcgatcaccagacaaactaccaggtaaacgttctgaaatcagatttgtacgcacatgatatataacttatttgtaagacaaatgaacagtctctaagtactgatgtggatagttgtcctatcttctgataggtttgatttggtgaggtgaagatgttcacgcattgaggcctgcgatcagccgatcgtcacctcacaaccgctacagccacacgtatagtcgttatcaatcacgctctcatgcaatcaacctttctagaaggattattgctcctgcaaacaatcgaagaagttcaggcttccgcctccctcaaggagaaggttgcggaggaggtcactgctgtttcctccgtccctgctgccgcgggaggcagcgggatcaagaggataccctgggcctgggcgagcggcactgccagatatcggcagaaattcagctgctctgaggacccatcattctcatcttgtcggacttttcttcttcgcgggataatggaatgaggtcgtaatttactatcttactcaggacacgagcggtctccctcctcgtccgaagaggagactactgaagagggccaccgacaagtaagtgaaatctttgaccccctttgttgtcatgtctacaagtttattgagggtgtttttgatgtcagcaggaaggcctcaacgatctccgcccaaagcggtgacgaggtggcgactagcgggactcccgctgtcgtcctagatttttcacaatttggttcttttgaaaaacttattttgcaaatagatccctagaaaaacttattttgcaaatagacccctagaaaaacttatcccataaatggtcctatttgaggcgccagagtgcctggcgccgtcgtccaatgggacagcgctagcctctctggcgccgtcctcttgccgacattgcggggtggtgctgaggtggcagggggagcatgatgacatttttaaatactaaatgatttcaactgaaaaagtcatccacaacaaagttctggctcggacgcggcgacgatgacctcggcgacaacgactgcagcgggcggcggcggcgaggttgggcgcggcggatccggcacggtggtgaaacctatcccgccgccgtcactgtcatcgtctctccctcaccctcactcaccctctcctgccgccgccgctgctgccacgcactgcctccggcgcctcgcgctgtctcctccatcgtgccgtcatcatcatcatcaccgttgccacgtgctgccccctccgcctccacctctaccgccgccgccgtcatgtcgccgtctccgagcgattccgcctctgcctcctcgtcgcgccgttgccgtcgccaagcgcgggcttcaaggcggacgcggagaaagcggggaggtgagtgctcctctcctcttcccctctcgtctcccctatgcctacgaggaccggtgccttgtcgccgttgtcactgtcgtcccgctggttggcgtcgccctttcccctctccccatggtgtcatcctctccgatgccgcgccttcctcctcttcatcggatggggtgaggtgctcagcggcggcaacgagctcgacctcggcaggctgggcaacaacgtagacctcggtatcagcacggattgagctggaagaagggggcttgctcaattcgatttcccgggagggtgatggggaggttgccagatgagtgggggtgtgtgagtggcactgcgacgaagcttgtgcctagctatgatcgagtaaaaatttatattagttgaacccagttttttgggttaatactttctctggtagtacaagcattaagattcgatggaaatatcaggtgctgattcagatttcacctttgcatgcaatctatttctaatttcgtacttctgtgttagtaaaacttatataagtgatattaccatttacttgcaacaatctatcagtgtcagacctgaaattgttcaagcttggctcttcagttccagctgcacaattttttttgtatgggctttactgatgatgtactcaggtgacacaattgtacgatggttaaaaaaaggcctaggttatgatgttagacagttcataataagataagggaatttggtaggagtacaatttactctgcaagaaacagagaatttatgcttgttaatccctgtagatcattgagccatcactttcttttacagcagtagcttcgctcaagaaaatgtttgccttttactgaaaatttttttgtcctcgcagtgcgaccatcatcactgtcgacatgccctgtgggcgcatggctgaggccatctgcatatgctgcatgaactcaagctccgtctgtctctagtacgggatggatgttgctggtcaaggtagggctgatggtaagggaggttggagccgactgaggtaagtgccagttcacacatatcttgaacttggttttgaaatgaaaaattggatctgaatgctgatatttgggtggttggtttagtaatctaccttgcccatcgttgtcttctacagtcccataagattctattataaagtttaattataagagtgttgaaccagaggtctttccctcgtgataaagtagttgtataacctttaagtttagcaggaaagttgtctacagcctacggatttcatctctaggttctataggctgcgtttagttcagcgcaaagtttggattttagttgaaattggagatgatgtgactgaaaagttgtgtgtgtatgacaggttgatgtgataaaaaatgacggaagtttggatccaaactttggatctaaacacagccataatcattgttgccagttgttaagagcaactctggtctcgtggatagctttcaatggaaatatgtgtttcctatattatagagctgttacgctggcactagagttaagtaatggaaatatgatatgtgcaaaataggagacttaattcatacacttaaatgatacaagcacacagtttttttttatctcaagctttgcatgtatgttcttgccgtgtgttactaattatcttttggtgcatagctgcatataattcctatttggataccgtacctgatggtgctccttcgattaattcacacaagttacttgacatcgaccactgctgcattgatccttacgatctaaacatatgccacaaaaataactccattaacctatatttattcacatttagaaaaagaagattaggagggaggactaatattgttgagttgtttagtgacttaatattgttgactcccagtattgacactaaaattgtatttttgcagctatgtataagatgtagcaaaaaaaatccatttgcacatcaacaagaaggccttgctgtaattcaatcctctatttgctatgagtggaggacgagaagcaaggagtgattccattgaatgtttgaaagatttgttttggttttctgttttcagatttcctgtaactaggttgaatctaggatgaactattgtttgaattctgttgtattcttattgtatatgttattagttaaatctgcgatggtatctgtaattaggtttgaatctgaaatggtatgagaaattggattgaatttggtaggctcaaatttaatgggtctgtttagtgggctttgatttgatagttggttgacaaaatgggccagttctgaaatgggcctagctttgaaatgggcctattttaaaatgggccagtttaaaaaaattaatgggccgctgttaaaaaattaatgggccgttaaaaaaataatggggccatataaaaaaatttgctgacgtcagctgccacgtcatcacacacgtgtcaacgaccacgtcacctgccatgttggccgccacgcggcaaccatctatgacgttaaatttcgtcacaaaggttgggcctgggctagactacacgagcccaaaagcgtttaatgacggttaaaaaatgtcatagattgtgctgatccatgacgatttcggagaaaacgtcggcagatttaatctgtgatgctcaatagatgacgataagtagaatcgtcacagacaaattcctgtgacgaattttctgtgatccatgacgaatttttttgtcatagattaaatagattcttgtagtgcaatgatggcgttgtacgcgttgtcgaattctgcgacaccaaaggtgatatgctctgttcggaagttattggcctatccaaaggtgacgggtaacgtgacgttacccaacggtttagacgatcattctggagtgattacatggaagggctgatatgtgggcgtcagctcgcttcgaggtatccccataacgtccaaagtgctggcgaagagcaagttgattggactcccgccatcaatgagaacctgtgccaccttgatattccgaatagtgggttcgactacgatcggatatctacctggtgtggttgcgatcttggggtggtctgccttcgtgaactcgatcttatgctgagaccatttcatcttggcagtagccgcctgcgatgtggaccagacttcgtgttctacctttttgtactccctctttgaggtgtacgatgtagaaccgccgaagatatgagagacatggaggtcgtactctgggaaagcggagtcagagtcaagagtggcggcttccttagccgtttcgacgacacgaactggcttccctctctagatcgctagttgtctcgcgagctccattttgaaaacataacaatcctccgtggcgtgattgttagtcttgtgtatcgggcaccattacttgcgtgagtcgtcgttctgggggtttgggcgcctgggtgggtccgtttgctcagcagcgaggacctctcccgagagtttgcgcttcccacttttgcgacttctctttttgctcgactctggtgcgtctcttttggttgacttcttctcctcacccaccttgctctttccctccttttctcttaaagcatcatctgcatgggcacatctgtcgataatctcgaacaacttccgagcagatatgattcgtcgcgtcgccaactcctaggtggtgttatcgatctcggacgcctgacttgaatgcgcggataacagaagcatcggtgatctcgaggatcgtattcctgcactcattgaatcgccgaatgtagtccctcaatgattctcctaggttctgagttagggcatgtaggacatccttaatcgcgtggcgcttgtaagttccctagaagttagcaacgaactgctgccacaagtcttcccatgaggagattgtgcgggacgggatgtggaatagccatgagcgagcagatccttttaatgcagctggtaaataatttgccagtgcattgtcgtctgcaccagcagcgtagagaattgtggagtagacttgcaaaaatttttctgggtttgtacttccatcatatttctcgatttctcttggtcggaacttctcgggccatcgcacatttcggagtgagggtgtgaatgctctacacctgcctcctgggacggaaggcggcccatggttatgacgtcgtaggggaggtatatctgatgaagaaaatgacgaagacgaggatgaggggtcgcttggtttaggagcccggcttctcgaacaatgattgtgtccccgatctcgactaggcgcgggagattgcgaattgtgatctcgttggtcgttgccgtctcgctcctgatcttgggcatcgtcctgaactcagcgattggcccccctgatcttgctggttgttgtagttggtgtcattgcggcggtcgctgtgggcccgccggccttggtcttcgttaggtccacctcctcggtcgtcgttccttcctcgttcgcgaaggagagcagtgacgatgtcgtcaatgaacaatattctctccgcggcgagaaggggaatggtgtcgatgacgatcattattgttccgatctcttctgtctctccgtcagtcatccaagtgttcgcggagatcgcgattctcgcgatgcggttcaataggttcacgtgtcgcccgaggtgatcgattaccggagggatgttctctgttggcgttttttgcctccgcattctcggcggttggctcgccgttccctcagggctgatctcgtggtgatggctcattggccgacgtctggatttgttacgggatcaaagggactttccctcaatatcgcatctaggtttcacaactgttgacaggcgttctcgctgctgcggacggacttgtctcgatgttgtcgaccacgttcacatcccgtggtgactccgaagagaattcatagtcttccagcaggtgtaacacatatggctcgtttggattagtgccaacatatcctacaaaccgatctggagccggctccacatctcgttccttggcaacacacagagcttgaactcgtggctgttggacacgatgatgcggcactttgaaggtcctgaggaagatcttgcagcttgtgagatcgtgagatctggatttgtgaattggacagtagatggcgcccgttggtgaagtgcgttgaattccacgttcccaacaagcgtagagtttagccttcacatggactatcagtgggtagtcctcgagagtatgtttggatgtcttatgaacaggacaccaagatctcggtttttgtgttgtcatccttgtcggctctgatctcttgtatagagaacataattcggccgcttgaggattcctcccaggtgttggggccctcgatgttccgttctccacttgcatgggaggaatcgtcggcggggtgtcgtttctcggagtcgtagccgtgcctttctcgttcccggtaatgattgggccattcgagattggcgtaatggtatagatcggaaacacaatagatccgacttgagtccacaccaacgatgtcgaggtagaggctccttgattgacactggtgttggtactgctgtcgtgaaggcttgaagtcatactggcagaaccttagcaccaagtccctctacctg

SEQ ID NO: 40572 - DNA, 1893 bp, Oryza sativa
agttaatgcccgtcacagatgagtataatccaaaaataaaaattttattttttggctagccctcactcgtgtgcacccacgcgggaacttcctgatcggtcacccattctgaaattgctccagaccaagcacgcttgacatcaaagttctttgaagattggcttccgaaaaagtagttgtaacatgttggtatgagtattctattaatcctattatgccctaggccaagatatcaaattagggttactaaatgatttcaaatggaaaagtcaccaaaaccaaagttgtagaactcatcgaggtgcaaaatttttattttggtcatttctccatttgactctatttaaacaatttgaaatttgaaattcaaagtttgaaaagttcaaatagaattttagatcagtgaacgacttcaactgaaaaagtcatcaacaacaaagttatataactcataaaaatctataacttttattttggtcatttttctatataacattttttgagtttaaatttgaatttgaaaatatgacaacttcaaacaacattttcgaatactaaatgatatcaactgaaaaagtcatcaaaaacaaagttgaataactcatcaagatctacaacttttattttggtcatttcttcatacgacaaagtgatagtaacattgttcacaaaattgacatatctcttatctggttttataaactataacacatatatgtaaaatttatgaataatattactaacatttcatcggatgaataaataacaaaaataaaagttttagatcttgatgagttattcaactttgttgttgatgacattttcaattgaaatcatttagtatttgaaaatgttgtttgaagttgtcatatttttaaattcaaatttaaactgttcaaaaaaatgttacttgttgcatacacggtcggatttgtcctatgctgtgggtgtagtgagcaggttcatcgagcatcggactgtgatgcatttcaaggcgatgaagaaaattctcaggtacctcaagggtacaatcaactgttggctcacgtttgctggtggtaaaggtgcagtggagatcatcggattcacagatagtgatctggctggtgacagtgatgatcgtcggagtactagcgatatggcattttatctcaacaatagtctgatttcgtgttcacaaaagcagaaaacggtggcactttcgtcctgtgaggctgaggcagccactgcagcagcttgtcacgctttgtggctcaggggattgatgattgagatgattggtgcagacgctaggccggtgaagttgtatgttgataacaaatcagcaattgcactcatgaaaaatcctgtgtttcatgggagaagtaagcacatagacacccgctaccatttcattcgggagtgtgttgaaagtgggaagatttagattgagttcgtccggactgaggagcagtgggcggatgtgttaactgggttgccaacagcgagattggcgacagcacggcacctgctaggtgttcgtgattttgggtcatagcagaattaagggggaatttgttgactgttatttcagctatggccccaaggtgttccagactgtggcagttgcaacggctggatgaataattcaggtttgagtttgttatgcgtgcacgagagatgtggtgcgctgcaggagtcgacgaccgcgtcaggcgtgcgttgtgggcgtgagttttgcacggcattggatccaggagttctggatcgtgggatgggcaattgtaggcttggattccttttttctgttattggagtataagtagcagtagctaagttttccatttgtaagtttttacaattcagttgaatggaagaaaccagaaaattaccccacaaattctctctctccca

SEQ ID NO: 40573 - DNA, 5000 bp, Oryza sativa
aattcctgcagcccacatgttaatttatcatccaacataattcacataatgttttaatgtatatcttcatgcaaagatgccacatcatcattcactaattaacaagatgccacatcatcatccactaacaatcatcacatttaaacatcatgcaaacatgctatatcttcatagtttttataatttaagagcttttcaaacacaaacatgttaaattatcatccaacataactcacataatgtttcaatgtatatctttatactaaattcccgcagcagtgcgcggggtttcacctagtttcagcctctataataaggacatgggcttgacatagagatcctcaagaacctcctgaagctgtttgccgaacgtgaaagcatcacagtcgttgccgtagaacaactggatgcccagcgtgatgttgatcatacgctgcaccacaggaagaacagcccggtggtcgacgcgagcctggttggttgttttccattcgtcctccaacacctcgtttatcctggcgatggcgacgtcggctgtgaccttgtgctcctcgatgtaggcctcgactgcgcatgccatgtcagctttgttctgcgacccaagctgcatatgcgcatccgtataaatgaatagtgattaataattaaacagttatatttcagaaagaaatagagaaacggccagagttctcataaggtggtacggcctgggttcgaagcctctccccttttatttatttaatattaggtccttcccttatactccctccgtcccatattataagtatttttagagtttggcacagttattaagaaagtatatataagtgaatggtggagagttattattggttgagtagtggagttaagtggaaaaattgaatggtggggggttgtgattggttagggattagtggagaagttgttatattttgggacaaatcttgagagctaaaagttgttatattttgggacggagggagtacttgcgtttttttatttcagaaacaaatacaccatgttttgaaagctatatatatttctcaataaggaccggatttgaaaatggcaagaaaaaggataattaattcaaatgctatcgacatagttaaagctctatggatttctagagctagatagcaatcaaaatatctagcttttaaaaaaattggattcgaagctagccgtgtcaaacatgcatgtccttacacactagcctaagatatctccgagcgttatgttaagtggaaaattctgtcaaacctgatgctagctctctcgttgacatggagttctaaattgagattaattaattacttggtaactagtaaaatactactccagcagtaaattaaattaattcaactctctctgttaccttgaatccagaaatgtcattcattaaacgcccaatttttccacaggagatgatggcgtcagtgctagtaacagcccactggaatgcttgttttgttgttgcagcatcacccatgccaagcattaggccggcagcaagcgatcttgtgcctgtggttgcggttcccagagccacctgatcgttgaagctcggcttgtgattccggtggtaccattccgctgcttccaggtaattactggtcagcttttggaactggcatgcacacatgcaagctagtaaattaaggattcaaatgtattcacgaaacaaaactaactgcatagatagatatgtaaatatatagtacgtactactaattgatatcaattgctccaatactattcattactacaaaatatacaataaaaattagtatatatatgcagcaggttttatgctactccctctggtttaaaacactttcaaatacttcttctatcgcggacatatgtactgtattgtatatataccccataatttatctcccgaaatattgaaatagtacgatttactccctaaactacaatacagaacatttgacaccccaaactcttaaaaccggacaaattaccattgtaactctattcgatacgattttcagcctatatggcacacacgtcgcgatacagtcagaaaacaaataaaaaacaatggggcccacttgtcagcgtctcttttttttccctccttctcagcctctctctctcggtgagcagaggagagagcaccggtggccagggccaatccaacagggagggggaggaaggggctccacgagctcggctagctattgctgctgccgccggcgctctaccaatggcaacctatgcggatccgtctccgtggagctcgtcatgggcatgaggccaccccgacgactccatcttccttgacctcagcaaggggattgctttgattcgatgctgccatggagttggatgccgccccggttacatcaagctcgctgctgaccccgtcttctctgagctcaacaaaaggggatgggattcatgcctgagtggaggcaggaagaaggagaggggtggcttggtgccatggtggtggtttgccgtcgctcggagaagggggtgcttgttgccggagccacgtgcacgtggactcgcactaggcggagctcgagcttagcgaggagagttgtggagctcacaaccaagggagggaactcgaggaggaggagctcggtagtgccatggcttgagaggaggagcttgagcccactcgtcattgctgtcaggaccgtcgccttgattcccagggctctgcttcctcctatgccagcactgacctcatcgccgtcaccctcgtcccccaccggcccacggcgggctctggatctaaggcaccagctgagctacacctccgccgctggctgcctagtccgcctccgtcgtcaatagcctgatccgcattcactgtcggtcgtcgggtccgcctccgccaccagctgcccgggcgagctccaccttagttgcccactgcccaggcgaggtccgcatccgtcgccggctgcccggtccgcctcctccacccgctcgggcgtggttctcctccaccaccggccaaccgagcacgtggcaagagagagcaggggggaatgtgaagggactgggttgaggggattgagggagaagtatgacaagtgggcccagttttttttgttttgctgactgggctgccacgttggtgccacgtgtgtaatttcaagtcaaaaccattcaaaacaatagttgagggtatcgaatgtccaattttcgagttcagggtataattcggtctaccacgattgttcacggggtaattcatactttttcctaaagtatacaccaccctacgatacgtcattcatcaaattaaaatatatgattaattttgattaatcatatattgattgtttgaaggttattaattactccatctgtcctcacatccacccaaaatcccttatattatgggatggagggagtaacggtcaaagttaaaatattggtcatcaaaggtgagagtaaataaacaaggacggtctaagtttttttctgggtcagaagtaaagagggagtgagtcatacctctgccttggagaaagcagcaaggtacctctgatttcttggtatttgatcctcaaactccctaaaggtcctcaagattatttcataaaactttctcaggtactctggtacaagcaaggcagcgctgtcatcccatctggaacggtataacattattagtcagggcaggattaaataatctagcagttacgtcaggggaaatttaattaattatccaaaacttaagattaattggatgcataaaaattaatgaagtgtccaacccttgaatggctacgtttagcatccggcactcttcgatggaggtatacgcatggacatcgtatgtgtcatccaatacggaagttagcgcgactagcttagcaaagatcattcgtgcaagtgccaagtctttctcgtggtatacagcataggaccaggtgtagcactcgatcacacggtctcggatatggtctagacccatatatgccaaaacatctttccaccacctgagaaaaaaattaatactagttattactttcaggttcttaaatatatacacacaaacagttaaaggtcgtagcatagcacggtacatgtatcatataataaaagttatattaatgttcaggttattttctttttctatatagaaaacataattcatgttccgcgaaacttatgcttgtgttattagatcatttattctataaaaactgcaacacactctatacggtgcacgtaagtagtaattaaggagtatgtcttttctaaatcaactgacagttatagctatttgcagtaatggtcatcaaatcttttgttctagactatattatagattaccatttttattgattttaattattgcatatttctttcattaatttcgtacaccatgaattgtcttagcctttgattttattttattcaaaataacaaattaaagttagcattcatattagtacctagaaatttccttgagctctttcaagtgaacctgctgcagtaggttgaaatccaactttgctagttcaagaagaaccggattgtgctcattctcttggtcatactcaaacatataatgtagcatctccactctcttgtgagtccttggcagtggcaagcgaagatgccgcttcacttgatcagctaaaggggccttcaaaacactatgcgaactcattgattcgagatggttccttgcaaaagaaatagcttcctcgagttctggctcaccatgtatgaagaggtgggctgcgttgtataaagatagtaggctccttgggtcttcagcaaattcatttaagaaattaccatcatctcctttgaatttgttgaatatatctgcatgtgagatttgatataaaaatgtttgtgaagttccaaggtttagctaggcacgttattcgcaatctcttttgaacatttatatatatatggtcctcaatcgtcgtagtaatgaacagttccaaaataactatgcacaatccattaactaagtagagaaatacctg

SEQ ID NO: 40574 - DNA, 14214 bp, Oryza sativa
atgctatagttaattaagtttatggttaatctcagttgtccgacaagacacacgggaatcaagatgactactgaaatatttgtaagacttgtaagcaattatgtagagtaaaactcaaccagacagtcatgtgcaattacaacacggtgttgtgttctacgatggaatataaataaataataactgagcatttcatgttgatacttagtacaatgcaaatgcaggcaaaagcctacatgtagtcagcacatatgttcatattggtaaaggagttggtgcaaaacaagttcagcacagttgaaacttcaataatgcaagcactgaacacacatggttattagttaatgcatattaagttctaagtccaacaagaagcttcacaaaacatcgatacttccatcaggcaaagcaacaagagactatcttctgacccacacaacaatcccccacaataaaagactgaggaagtcacctttatgcattaactaatggaataacgtgatcatgttctttttctaacaaaacagtaataaaataacatcataagcggaaaatagatccaactttaaagttaatgtttgtggctaaagatcgcatagttagttatccctcacttacttttggccatgcagttatcatccttgccttctccataagattatccagccaagcatactgctcaaggaggagcttcctctctttagatgttccacgagcattagatgtgtctctgacaagctttttcagcttctgctcgtatatcttcatttcctcaagtactttggctgctttggtaacagtttcaatattctgatggatttggtccattagtgcatcctcatcttccaagcactttgttatttgaagagctttattgtaacaaagctttgcatcttcatacttttgaacacgggaatggacctcccccagatttataaatccctttgcctcgccttgagtatggcgtatttttctacatatctctatgtccttctcaatatggcccttggctctgttccagttgcgtagttcaatataaacattacctagattgtgatggagcctactgcgagcatcgtcatactggtgtacctcttcctcatcacatatcttcagaccctgaacaagtaatttctcagcttcttcataattatccagttccagttcaagcatgcccatattattgtacgcatcaataagctcctttaggaagagagacttctgagacgatggattctcctttagaacccttgctagcttcatggatgatttgaaatatttcttggcattccgaatggcactgtgatcattttcagatcttagaaggatctcatagtaagttctgccaagctgggtgctagctctctgctgctcaacaaggtcatcagcctccttggcaagttgtaagtgcttcttctgtgaagcatcaaacatcaatgataactagaaatatggattcatgtaatagaaaaaacatacagctgctttgggttaacaagagcattatgatgagtgttagaaaaataaccaacagacaacatgaaacaggagatcagcacttaataccatgagttgagtgaacaaattactccaaatgatcatatttgaacaggggtgctggtaagtctataacgggcctgagtacacacaaccagggtttacattaccgtcggtaaccgcgcggttaccgtggttaccgcccttactgcgggggtacggtaatagaaataccgcggtaacctccttaaattcaaataaatttaaaaaataatttgaattttacggtttttcactattaccgcgcggtaaccccggccccggcggtttgggaaaccctgcatacaacacatgctaacaattagccattccccctcacttcacataaaagggtaatctgattcacatggttggctcctcaaaggtttacatgcaaattagatgcaactaaaccaaccatatgggacaaaacccataggcgaacctgagccagattgattaagatcaccaactaaccaaacatgcagacaaagagtgcaagattcacaaatatttttttctcattttggtaataccacacaaataaacagcagataaattataaatctcaacactggccatactgaaatccataacataaaatgtttgcatagtccagcaaatgattcaaaccatttgtgtacatttctacaagcaaaagtccaccataagtttgccaaagtaaagcataatatcgaagtatgcagcttaatctgatattcagttaaatattcaaatgcttgactaaatcattcatatacagatgcaacaccaaatggcccaaagcatagtggcattgagatgagcaaaattccctgatacagtggtgcgtcagtgctaaggtacgccgtagaaaccatagcgcaggttgtaactagcaacaattcgtttgccggcagaccccaaaaaaaaatccaaaaactcaatgcggaaattctacaacttaacccacacctgcctataacgactcagacatcagaaaacgtgatctgatcatatgcgtgcgatgcgaaatggaaggatcgtggtaacctggtaggtgagggcctcggagaagttgccgaggcggaggtggacctcgccgagcgactggcaggaggggaggaggtggcgctgggggaggtacttgacggagaccttgtagtcgatccgcagccaccggagcgcctccacgtactccccccgccgcttgtggatgtcgccgatgacgttcgcccaccgcgcctcctcctcccggttcccctccgccaccgcctcccggtacccccgcttcgccgccttcagctcctcctcctcctccttcgtccaccgtcccccgccgccgcgccccatcgccgccgcctccgccgccgctagggctccagctccagcccgattttccccttcctttttttctcgtgcgggttttggggtttccggtgggcgcaaaatggaagcgaattctcccgccaaaatattggggaaggcaaaggcacggcaccgcgccatgttgttgggctgcgtttctgtgtgggccttcagtgaaatgacaacgtgggcttcaagctgatttgggcctttgcattttgggccaaaagagaatccctctgaatttcaggttaaccgagcatttgaaagtgcactcgtaggaacatattgatattgctattttttttatggactagtaataatactcgtgttttgtaagtgtgtaacgggctaggcacataattaagaattgattgggtctgtgggaaggaaacagatggagaataatagtaagataataatgaacacaatgtttagtttatactcccaccgtcccaaaataagttcaattttatactattcatacccaacatttgacttttcgcgttatttgaaaaaaactttaattttgaatgattagttttttattattattagataataataaagcatgaatagtctcttatgtgtgactatctttttttagtttttttcataaattttttaaataagacggacggtcaaatgttggatattgatactcacggctgcacttattttggaaagaatatatactatatcagtacaacctattggagttaactagaattcatacacgcgtgggaaagaacggctctgatcagctgaacctagtctgaaataccgaaacgacgaggggttttctgtaaaattcaatggcgtagatcggctgagctcgcggtgaatctagcacgtttaagatatctaatattccgagacagtgtaatttggctttgcatagcagccagccagccacaggaaggcaagccaaacgggccagcacttgttcaccgcgcagtgctcgtcggccgccagctcgcgcggtcgcgcccatgtctctaaactctctctagatcaaaggacacagttttttctaaaaaaaagttcatagtaactgcagctttttctaaaaaaaaattaactcttccatctatgtgtttgagagaagagaaaataaaaggactgaaaatatacacaaaataagataagctattagctattagcatgagaataattaactattagtttttttacgaaactattaattgttttagacttaaactaaattaatatatttttaagcaactttcttatatataaaactttgaaaaaatacgtaccatttagcagttcgggaacatgcgtgtgaaaaacttttatactctatccaccgatctcaaacgtagccaaatactacagattttcgtttatatactgaaaatttgtagtcacataaaaaatatatatgtcaaaagctgagaaacacatttttcaacttttagaactaactatcaaccaaccactactttgttcaagagtgggagattgtgagttgttttccacgtgcacgcttcccgaactattaaacggtgtattttttgtaaaaagaaatgctatagaaaagttgctttaaaaatcatatgaatccatttttaaaatttaaaatagttaataatgaattaatgatgtgctaatggtccacctcgttttgcgtatcttctcaatctcctcaattcccctcctaaagggtatgtttggtataacttcaactcttaaatttagcttcaggagttgagtgtggagtggagttgtggagctgattaaacctaactacacctctctagttcatcttgtgatagtgtttcacccagctccgcttccattttaggtagagctaaaactgtttgcctgggctaccgctctaaaagaaataaagctatagctagaggtgtgccgaacatacctttaggggctgtttggtttttaagtaacattaccataactcactttagacaatgttaggcaagtgtggctgaccacgcttttcgtggcctacaaattgtaagccacacttgtggcaaagctaggcaaagaattgagtctatgacatataggataagatggtaagaaagtgtagcttgtcataactatggcaataaaccaaacacaaggttaaagaggtgtgacagtctaaagtgtggtctggcaagttaaagtattgaacaaaataacccctaaaatcttatactcatgtaaggcatgggacaaaccgatcgagtgcaaacggtcatagtagtagctagccacgttacgtaaagttacagcgcgcgtgcgcgcggcggcgcggcagctcttttctccgcggcggccacgacgagcgtgctgccagccggtgatgaaacgatgatgtcggcacagcgcgcgtggcgtgcgagtgaaccgtacgttgctcgatcgatcggttgctctcgtctccgagattccaccgagcctagctccgtagctcgtgctcgtggtccatctatcccgcgttagattttgtcaatctatggtcaatcgtcatggtcgtcggccgctagctgccgtacgtacgtttgtagtaataaaatatgcagtgtcgattgacgtcgatgcaaagcatttttcgtagttttgctgcgttgaaggcagccaacaattgatttgttaatatttatagtattaaatatataatattttatatattttttatttattttaagatgaaaggagtagctagtttagatgccaatttacggtgtagccagtaaggctttgaaattttctcacgtcatacatgtatatagccttttttttttctttttacaagacctagcgggcgcattatagtcgacattgtgtctgtatgtacagtgtcgtacagtacattgcagcagcaagatatagaaaatggaaaagaacatatttgccttgtttagttccaaactttttcttcacactttcagcttttctatcacatcaaaactttactaaacacataaacttccaacttttccatcatatcgttcgaatttcaatcaaacttaaacacacccattatatatgtcgagcgtgtacttcctggaatcggctgtaataaaaaaaaagctatgccctctttgaaaggcgcgacaaagaaattgaaagcatcgctgcaactctatgcaagttgtcaaataaacatgagccctggtattgggcatatttgcaaacggaatcccatcgagaaataagttaaaaagtatatttgcataaagaacaatttatgaataaaattattatatacatgttctttagtgatttaaaagtaaagactgaaaaataaactacgataaaaaaacccaactaactttaaattggttgaaaatttattaaattggttgaaaatttaaattttgactgataattataaacgtaaacgaaaaaacgaggcgtatgttaccaactactcgctaggttctttcgccctgatcttctgtcaaaaatggagggccctgagatagtgagatgccgacgccgccggccagccggcttcggctactactacagtacttgtcgccaacctgccaattaactggttgctcgatcgcctaagaattagcttcacaagttcggatgcttaactttccagctggttattgttcagaacagcaaaatgaccactcgttttcttgttagttctgcagcaatagacagtggctgttactacatgatccatatactttattaattaaccagaagaaaaggagctgggggaaaatgttacatgaacatcgtattcaagattaggtgaactgaaacattcaaacatgcacgctaatgctagctccagaaattgtttgatgttttcctgaagaacaaaaagggactcggcacgatgtctgaagaagctgcaggcacaattacacgcgcgtcgttggatagagtcagtcgacgagatgactagaaagtagaaactggactaatccaatatgtaaacaagcgtgtctcgacttatagacttttgctgctgctggcttcaacgatcgatgtcaccttgctggctggcctacttagtaaaagaaaacgactgtgtttttggtggtcataactaattaggcgagacactgatgaaccaaaaacaatgtaacaaagtcgcagttctagctgcacttaacacagattatttaattacctcacctaattgctcggagaaaatctcggcaacaaagccttgtcgcaaaagccagagtaatagcagaaccgatctttctgggagcaactgatactttccaggaaatcttttttaaaaaaggatagtactactagtattaacacgttgttcagatcatgcacacgtctttgcaaggtaaaagtatgagtaaaacacaagggaacaaaagcaagatagggtgattagcaacttccaggtaaccgttttgtctcctctcgttaaccagcgaccgagattagcacacgccacacgcgccactagctttgagcggcgttcggccgagttctaaagagccactcagaaaagtctactttcttatttcttacgaagaaattgttatacatatgatccaactattcgactcacgtacgactaaatttaatcgacgactataaacagctacactgcgtataaacatgttctttttcgattgatatatgtttgcatgtatctagttatatagaagatatgtttcatgttaaattatttaatataaatactttttaaaacatatcaaataaacatttttttttctcgtgtcacgtttcgccgaaaatcagggacgaacttctttgtcccagccgttttctccgccagacagccaaggcggaaacgtgcggagaaaacggccggagaaaaggccggaaagaccaaagcagtaacgcaacgcgatggctatcaacagggtggcaacgcgatgcacgcacgcaccagcagcacacacgctccacgcagcagcagcagcgagagaggagatatttttggtctctcgggtggttggggcatggaggatactagtactaggtacaattcatcaactggtcacataaaaaacgcatcagtttgctattaattttaagtgcatgcatctaccgtgacttgttccatggaggaacactgcaagtacagtgtcgtgtagtggaccacattgtgaggaggtggtggttaatttgggcttaatccctggaattttttgattgaaacctataggtcctcagtttggtgcattattacagatgagatcctcttctgaaccttaattagttaaagaaatatgggaaaaccttaattagttaaggagatatgggaagtagggtaatattaataaaaagatcacgcggaatgattttcataaatgattaaccatgaataatatttcgaggttattattactcgtagtactccctccttctaaaagtttaacacctatttcattctttggtttttccaaaagtctaagtcctatttgtagttattatgtactaaattaaattgttgataggaaaaaaaagtattttaatacttatttgttgcatgtttattggctttgtcatatgataaatgaattaattgtttcttgttcttggtgaaaaagaaataggacaatttttttttgaaggagggagtactacgtactactccctccattccaaattgatctacatattttataggtacactaagaccaagaaaagctaataactctctcatattacatttactctagcaacaaattcaatacatgcaccatcatcactattttctagtcaatagcaaatcgagatattgcatgtgggttataaatacttgtgtgcatggatgcatgcatcaatgtccatttactctaatgcacaaataacgaatagacttaatgaatgaacacaaatatgtagatcatttaagaataacccaaaaaaactatatatagatcaatttggaatggaggaagtatcagtttactcatgattacgctaattattccactcaattctcactttctcagtgccagcaatcaatgctagccagcctactccggcagtcgatgcattcaatattcaaggagtaaaacgcaaaaatgaataaactgaaggtgcaacattgtaaaatgaccttctccgaaggggcgaactgaaaaactccaaaggcagcacaaatctcgtccgtacctgccccgcttctacccaagcgccttccgctgcaagcatccactggctgacaggtgggccccaccacgtgcccctcctccacctcccgccatataaaaaccccaaagccccacccacccacgcttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagaggtatgggcgtcgctgggagcggcttgatttgtgtagtttacttgttcttcagggattgattgctgttgtaaatcgttagttctacggccgattgggaatttttttggggatcgaggacgctcggtggatggattgggaggaaaaaaaggggatagataattttaggggttgatcctgagagatcagatttggggtgatactcctgtttaattggtgatttagggtggaatgatgtgcctccatgtcttatttgtggtgatcagggcttcatgtgctgattctgtctgctaggattttagagatgccatttcagctcttgcactgttcgatcttttttttttctttttctaaattgcgcaatccatatgattacctttttctccaaggagttgaattcgcagtaaaggggaaattattctccgttctctttggaggtctccccatctgggttcttagttgttagatggatgaccctagtatcgcttgatgtggttgtatgattgcgagaggattgttccggacgtaattcaactattagtcgaagtaaaggatttttatgatgttgactgtcaagtcctacatgccttagcatatactcctggctgtttagtcgtcctggtgcctgtttttggttctatctttcggtcaatagcgtcaaatcatttttttgtggtctttgttggcctcttttgcttagacatactagttcattttatttatggggatgttacctcttgtgtaaattgtctaaatcggttgtatctagtcagtcgtgtgagctaaaccacagatctttgttgaagtgttgcaactcagttttggtgttccttgtttacaattaatgttgctgcagcatattgatgttagtccgtaaagcacaactttagactgcaattgcagaaatgatgaggtccattcatgggttttttttcctacaatcttgaatttcatgatttgagatatgctttcctaaaatttgaatgtttatacgcatggttgcatgttccaacttcatgtttgtgaccaaaagaaaataacatcagcaagagaagttcatctgtgtaatttcttgccattgatgttgaccttccattgcagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggtaaggattatcaatttgattttttctctctgaatatgcacgattttttacattgctctaattttgcttgtgtttttcaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgactatatatttatatattatatcttgttagattgcagccttgcagggttgttgctcttgctactgggcgcgtgccatccagaatcaggatttctggaaagatgcttcacttcctcttttcttgatgtgaataggcagtatgaccggccaggtataagctttgtgataacaagaggggtatttggcacatgttgtcactttttcttctcgagatatttttgttaagactatgactaattcagagcgaagacctacgagcttcgtgactgttagatattttttaagaagggcgaaatttcaatgaatgtttaactgcagcactattctagatgtctttggtccaagtcaaaatatccttgcatcacacttggatcatggtcaatgtcagtacagtctttacgagttgtggacttgtggtcccatgtcatggtggttggtcgtgatttgatgccgacatggttgcgcttgcgcatcgcattcttgatttgttacggctgggtcatgcccttttccttctctcgcatcattttttgctatcctcataaatcacatggcttcccctaaagacaaaaggattatcaaacgtggtggccactagtgttccatcaagggagcatcacaagccaaacactaccaccgtttgtctcccgttggccagggtcattgtgcgggacagagcgagacagctctacctaattacctaaagcttgttaagatttcaataggctgccgttgtatatgaacccttcaacaagtttagaaacttttgagtgagagagcttgtgcaatgcatgttccttcagctgcaccaactttgacttgcctctcttgaagctctaatctcacctaccttcgctagaaaactgaaaactgaggttagcatcgaactctgggtgcggcaggttaatcacaggatctaatctgatggttcgctcctaacacattctctgttaggttggctcctaatcgtattgtattaccttgtactgttggttgggattctgataccgattgctgagcatagcgaatcattcattaaaagaaaaaaaggaacatattcgttcaaatctcgaaggactaaacattcacaagtattatatgtagccttcactccagatctcacatgacctcgaaaactttgagaaattaaaaattacaatggaggctgatgaggagatggcatacgcatttgatttgagtggagtaccatttcaaatatcagagtatgttgtgacgacaagcgcggatgataatcaacgaaccaagccacatatagtggacgatgctttacaatccaccttgtgacctcaacaacccaaaacacgccaagcataaaataatatttacatatcaaacggaatgttcccacaatggtacatttttcgaaagaacaaaaattatatatccatatgaatctacctctactttcttttcaaaaattgagaaaaacgcctatctacttgctcctacaagaaagatgggaacaaataaccagaatgttatactttcctaagagggctatgggatgatgtggacatatatcacaaggcgaatgtctgaagtttgctgtgccatctatctcttctcactcctaattccctactcaaatcaccaattcccgtctcatgaccacttggaaaagacaagtttggccttcaaagtagccaacgcgtaccgcgtacatgacacaagcatcgggtaattttaataccaaaaggtgtctccgtggttaacccactgcacgaaatgctcaggtaaattctgagtatagatatcagcatcttgattttcctgaaaagtttgaaatttcgcaattggttatgttattagcacaatgatattgcatatttgcatacatgatctctaccctaccactataaattctcacacaattaatctccagaattggtctgaacaaatttcaacaaaatcaaagaacagaatttagcggaatcgaactgttgggaacatatgctcaccatggtctcagaatttatgccacttataacattctccgctgaaaggttcacatctggagtactaattgcaatggacctgttcaagcacaatccatcagcattcaatgagttacaaaaaaatgtttcagaggatatcttcaaattagcatcagtgaacatactggaagctcagaagacacttgttaattggatttaggaagtgtggcaacataatatttccattttactccctccgtcccataatataagg

SEQ ID NO: 40575 - DNA, 704 bp, Oryza sativa
atattttactgctaagggcggcagttgcttaatcctatctgctgggacggcagttgcgtgcaaacgctttattctgaagatgattgtgacaccaaagtgtttgcccaatcttgtgacggtgagtcggtgaccttagcataagattaatcataaaaatcataaggtgttggtggatggtcgaacatatccatccacggtgtggagagaacactactttcaatttggcaatcatagtctccgatagggaccctacactgtaatttactagtttttttttactaacatgtaattaactagtaatagatcgattgtttgtttatctagagatgagtatacataccgatcatgagtggcattgatcgtttgtgctgggtgtcagcaagctgcacggtccttctgtagctgtagcaaatcatctgttctgtgtgtgtggatcggggctggctggtgccagtgtagctagcattaccgatcagacttattgtatctattataattcaactaaattttatttagttaaattagaatgaatgaattgtcagcgggtcgatttgtgttatccctatatttactgacattttgttgtctctcgctgctgtattggctgatccaagtaaaacttttttctttaagaaaaaaacacttcgccaaccttaaatttatgtgtaataatgtaatatagaaaaaaaatgggctgcaggaat

SEQ ID NO: 40576 - DNA, 1036 bp, Oryza sativa
cactattcttgcgggagatcaaatccattctcattttataagagaaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagagcaactaattgtcatcaactagccatgaaccatcctccactacacaaccatcaaccatccatcaattaggactaattgatataagttaccaattccctaatcaaatggattaattctcaaaactcttcatcccattgatatcccataaaagaatgaatacacatgaattcctagcataatgagccttagaatttatttgatttaattgatttaaatggatcaattacccaattaaatctaacacaaagtatatgcagcttaatctgatattcagctaaacattcaaatacttgactaaaccatttatatacagatgcaacaccaaatggcccaaagcatagtgggcgttgagatgagcaaaattctctgatacagtggcttctacagcataccttagcactaactcacacagaaacaaactataattgcatatacactataaaatgggacaaaccataatgcagattggtactactactagcaaatatttgtttgccggcagaccaaacaactcaatgcggaaattctactacaacttaacctacacctgcctataacgactcaggcatcagaaaacgtgatctgatcatatgcgtgtgatgcgaaatggaaggatcgtcgtaacctggtaggtgagggcctcggaggagttgccgaggcggaggtggacctcgccgagcgactggcaggaggggaggaggtggcgctgggggaggtacttgacggagaccttgtagtcgatccgcagccaccggagcgcctccacgtactccccccgccgcttgtggatgtcgccgatgacgttcgcccaccgcgcctccttcttccggtt

SEQ ID NO: 40577 - DNA, 702 bp, Oryza sativa
aattcctgcagccccttcttttagtagttgtggcttttgacaaattactgatacacatgtctaggtatgatccttgtactaattcatgccatgatgatatggaaggaaatggtgtgatctgcttagccgttgacattctccctacagaattttccaaagaggtgggctcttttatagaataagtaagggtatctttgttttaagcacaaaccttttccattgactgttgtcctactgaacttctatgctgtaggcctcccaacattttggagacatattatccaaattcgttgctagattggcctcagctaaggaactgttggagcttccttcacacttgagaaaagcttgcattgcgcatgctggcagactcacttctctgtatgagtatattcctcggatgagaaagactataatgtaagtttcaaaatccaagtctatgctctcctccttattgtcaccattgtactgctcttggatattctgtatttgtgtcctgatagtttagaaggacagaatgagctaaatagctaatcttgttaagatgcacatatatttcacataaaaaaggagatatattcgattgctcatgtcttatgcttttacccgtaattagtaaataaagcactgcagatttagttattaagcagaaacttagtggcacggttttcttcttctgctttgttcaaacaaatatagatg

SEQ ID NO: 40578 - DNA, 4904 bp, Oryza sativa
tttttatggattatggcagtgatggattaatgagtatctaatgctagagacaaacaatattagcccttattatttttgtgagctcatggtaggctggtagcatatgagttccatcgtttcctgtttttatcattctacctggtgttctgtgatatagcttatcgctaagactatgatgctttaccagcttcaggcatgttttactggtcctaatgttcttctatatgttcatgtgcagagagttgccaccagctccaacaaatctattacctgataagaagtacaacagcctggttagactctagttttctagtattacagtacatttatgatctgtctgactattattggatgtatgcaattagggactaaattgttttttttttctctaaaaacttgttggttcatgaaacaggtgtctctcagtggccacctctttgataagttccttattaatgaagctctggatattattgaaacagccggaggttcttttcacttgattagatgcgatgttgggcaaagcattgatgatatgtcatactcagagcttgaagtaagaacacatgtttctttttgatgcacagttatttagaattaaaatcaatattatatggcgtctatagtttgggaattaattattgctatttttggaacaatctgctactcattgatggcatgtcaaattcagagcttgaagtaagaaatcattttcttttctatgcacacttattcaggataaaaaacaaaattacatggtgtttctagcttgggaaattaattgttcctgttcctaaaattatcaatctcctgctaccactcattaaaaaaaacaaattttgttactgccaagaaagctaaatagtctgagaactgaaacgttatgtcttttcttatggaaccttcttagcagtaatactgtatggtagctcttgatgatcctatatatttggatttacgaatttaaaagttgatataaagaacaaaaggagcaaatgacagaggttggaattacgtgctgggctcctgttccattcccatggtcccacccatctctatctctgctgcaaaaggcagagggagtatgactagtgcaaaagcagtcagatattttttcgaacggtcaggccgttgccgacgttttatattaagaagaagatatcctattgtaaggagaaaacgggaccaaaccttacaatgctcaattaattagggaaaactgggtgaaaaccacaactacaacaccacaccaacagctaacctaacctaagctaccacgacggagcccaacacaaggcatcggtcaagcttgccatagagacgacacgacaacacacatgttatcgttgccgagcttgtcacccaagtgacacagcagcttcgacttcattgtgatactaccccaacgccaaaatgaacaaacaaaagcgacgcccacgaaggacatcagcccaaaataccaagggaccactcctcctcacagctagcatcaacaatcctataaagacattgcaaagtgccatcattgccaagcttcgtcgcaccccaacaacaaagcagctccgactctacctaacaataaccaaataagagtgatgaacacccgccgtggagcaaagagcgaaaccaagtctgtgaaggcctcgtcaaacaccctaggcttgtagagcttcggagacgttgcaggaatccaccaatgactaccattgcacgtaaagggttcttggtgctaggaggggtcaacgccaaaacaacacctccaaggaggggaacggcgcctaaagacgtcgtcgtcgtcatgccggcccatggcctggcaaggctttcgccagcgattcccgaacaaagccccacacaaccatcccgcacaacgaccatcgccggaccaccacgctatctcttcaacgcccaagcacagcccacccgcccccgtagctcaagctgccaagtgagaagacctcggtgaccgcgtgcaccggtctcctcgcgcagcatcgccgcccacagcttcacgccgctggccatggccgcgctccggccaaagcctcgccgaccgccacctcgcagaccaccggccgccgccttgccttggcccgcggcctcgtcctcctccttcccgcccatcccgcacgcgtcgcgaactcacagcctaccggcgacgacggccgacgggagcacgggcagagcaagccggcgccgtcgggctctcagcaaatcagcgcggcgacaacacccgtgctgccgccggttccaggctgcctcgccgtcctctctcgcaccgctagccgcctgctccgcctctaccgccacgtcgcccaccgcgccggccggatccgcgggtgggggggccagatccggccacagaggtgccggatccgctgccccaagccgacccgccgtctccgcctccggccgtgtcatcgtcggccttgccccgtcctcctcgcgcaagggcggttccgccaagctgtttggcctcgccgccgccttcccggctcaccgccggctttgccgccggcgagctctggcggcggcgaggtggaggaagggaagagggtgtggcggcgcgggcagctagggtttcgccccccgagccgcccgcgtgagaggcgacgcgggggatgactacaaacaaatctctgaacctttccatgtcattacactaaaagcagtcagatataaaccctcagatattcttcatgcaattattggagaggttcactagttcatctccgttcccctttctgagtacaccacgctctgcctgctttctactccgactgatcatcaacctggatggacatccatgagtttgtgccttttcctttcatgcttcttctgaactctgttcttttcttcaattttgtgtatgaccttttttcgctctcaaggaagtatgactgttttggaacttgagttttgcagctgtgatgcagtgaacaagttacataaaactcagaatcttgcagccctatatgatgaactttaacaatcctacaatcaatttcaaaaatctttcttcaatgtgtaaatattccagcgggtctctctctctctgttttttttttttggggggggggggcattaatcaatacaggacaaattacaattgttctggattagaccatgccaaaaagttagattcaaaaccacgctagaagccagataatccttaacttctatctctcgtggctaattcatgactaatcccaatttggtcatggcgagttcaaaagccatttaccaacttgttgtagtttgattcttctttatttagaaaaaaaatggaagtcacccacacattacatcattacattatgctatatcaaataatgatgtaaatttaatactaggctaaatctgaaactctataaacccagatcacacaagacaaactgattttgtattatagcattcctgaacttcttttgttgtttgggtacatatccagtaactcatgccactttttttttttgtatttaccatgatattattgttttattattttcttggtaaacatgttactggtcttatcctccttggattgcattaagccaaacattttagtacaactttttttctgagttatatggtgcatgtccttttacaggtaggagcagatgatacagctacattggataagattattgattccttgacttctctagctaatgcacatggagatcctaatgccagaagagaaattgaattatctctaaagataggaaaagtcaatgagtgtggaactgatgacagcatggctaaagaagggtcaaaggttttaattcttggagctggaagagtctgtcgaccagctgctgagtttctggcttcttattcaaacatcttcagcagcagtgcctacgatcatgacattgaccaaattcatgttattgtggcgtccctgtaccaaaaagatgcagaagaggttattctcacagcacagtgcattcctggactaagcctttttatatatatacatattttttagttgcttgcatgagttactatcaacatgttctgtgtacatcaataagcaatggaaatagcagaatgctatcattttggtcaagatttgtaaggtaattttagaaaaatactacattttcttatgtatttttgtctctatatgcagacaattgatggcataagaaatgcaacagctgctcaactcgatgttgcagatattaaaaatctttccaatcttgtttctcaggtaatttcaattctggtattataatgaacatagtggggctgccaaatcacatgggaattaattttgacctgacttcaatcctcttttccattttttttctttctataatgagattttaacttggagttgcttttcaaacaaattacatttgcaactagcaaaatacccgtgcgttgcaatggattttgaaaatatgtttttaaatgtactaacttgccagcgattagagaatttagtgattacctcctcttgcaggttgaagtagtagttagcttgctgcctgccagttttcatgctgccatagcaagagtatgcatagaggtagtcttctatacttccttgtgttcccctggtgtatggatctgtgatgatttatgggaggcctcaaaccaccatcgttgtgatattcagtgattcctgtatgacagatgaagaagcacttggtcactgcaagctatgttgatgagtccatgtcaaagttggaacaatctgcagaaggtgctggtgtaactattctctgtgaaatgggcctggatcctggcataggtactttccttaatatcatggtcaaccatgtacatttgttatggtacatacgttcatcaaattattaggggatgtgatatgactaaacattatcactgcaacgagaaagaatgtaattttatcatagagtaattttgctagt

SEQ ID NO: 40579 - DNA, 19573 bp, Oryza sativa
  unsure (1)..(19573): unsure at all n locations
aagagaagccctctaaataattctatttttcatgaatccatgcgcttcaaccgagcatggaataattctatttttcctccctcatctctagcccttgattgaagcgcatccctcaactgtaaaaacgggtataacatctcccccaacttcaaaaaccagttcaaattaactccttcactggttttggaagcggttttcaccgacgtggcaggttgacttggtctaaatgtattgacgtgacagcctagtcatcaaaagagttaaaaataaaagtggtaccacatgtggggtctacctgtcatcccccttctccttgtattcttccttcaggtttgggggcgacgtagaagatctcttctatgcgtggtgaccggccggcgggggttcttggattcggtctgcacgtacgtgggtggatgactggatgctgccgtggacgtggaggaaggaggtggaagcggcgtgggcggtatgcagggagccgcgtccaatcttctcgacgccggagctcacgcattctaccctgctgtcggtgcaccgttctcattctttgcttctgcaccagctgtactgcccgcagtcgccgtaccaagtcgtgccggtgctgtcgccggtggccttgcctgtgccgccgccgccgcagccggggttactggtatccgcggccgtgatggtggtggacggtccggccagctgcgccgtcgtgctgagcctagttccgcagcacgcgccggaggatgagatcgcccgcgcacgtctacttcttcgatctccgctccgccgagcacgccattacagggtccgtgagcagcagtgccggcttggctagctctacgttgccgccaacatgggactggccccacgacgacaaccgcaggttcgtccttggccaggctgtccgggcccacttcgtcgccgcctccaccatccctgacgacgatggcgcgcgctagccggggatccgccacttgtgcttggggcaggacggggacacgctccaacggcggtaggaggaggagttggggcggccgagaccgatgggggagaagagtgagcgactggccgggcggcgactccccctgcgcgcgccggccgtccactttgcccctcgcgtgctgctgtaaggtgagagaggaggtagaggaaagagagagaggagatgtgaagaagatgataggatggaagaggttattgacaggtggggctgtaagctgattcaatagggatgaaactacctcccaaaccgtggaaggaggcgatttacacgcctcttctcgtgctagcacaactcaacgtctagctaactgcatctaccttatatagacagattgtaacttttttcttcaaacttttaacttttctgtcgcatcgaatttttttacacatgcaaactttcaacttttctgtcacatcgttccaatttcttcatacttctaattttgacgtggaactaaacacagctataggacatgttcggctagcctacctgcagcagttcaaaccggctgcagcgtgcagccaattataattgtcctagcgccttcgaacagccaccataccctgtgttttaaaataaacaatctaatatatgatgtgatatttctagcattatgaatatgcacaaatccttatctagtcctttacatcgtatactaggttggtttattcaatggtggagggagtataagcttagagcatgcccagcagatcatctatctggccatccattatgtgtttggtgtatggaggcgagaaaataatactccagcagagtctcatcagacacaccatttttagatgtcctccaaaccaagcactccacaagtcaattttagcggttttctctcatcacgctatcctccaactactcagctgtgtgggtctacggtaaagaggaggtgtataccggaactcgcggtgaagatcgcgggagtaaaggcgataggcgaaatatttggcagggtcgcagggagattgccaaagtgccgcaccgccctcaacccacaccacttgtggcttctccgttctcactgctggttttctttaggcaaatgatgaggcccgtaacaactagattcatcttgtttttttaaaaaaaataaatgttgtgaatcttaggttctttaaatcacaagattaagaaacaggggaatagaaaaatgataggattttcaaggaatacaagtgcaatacaaataattggaaaacatagaaaaagcacgaaaaattatccttttattagaccacgagaaaaacacataaactggatgagagagatcggtagatttaaaggaaattttccatgagcctggatcacatgttaaaacttctccgaaacttgtgcggatcgagacattccttagaattttttataggattcaataatatctaaacggtgaaaaaaatcctataaaattgtaatcctatttcctatgttttccaaaggaccgtatccaacgccaaaagatcacgtgatacgaaggagataaattacgcacgtctaatatataatgctggggatttggttccttagaaatttaatactgtgatgtcaattactagtggttttatttaaattggatcatttctttatacatgaaattcaagatttgtagggtgtattctaaaaagccacaatatacgcctggatccgctgtagcctgtagtacgatggcaacttaaacagtcacaacatgtctgtttgatatgattttaagtaacagggtcatctgaaacatttttggctaaaaaagttactgtgattttacctagacaagctactactgtagcggaagatctgaacgcttgatgtaaaaatagggccgagtttagttttaaactttttcttcaaactttcaatttttccatcacatcaaaaaatttcatacacacgtagagttctaactttttcatcgtatcgttttaattttatataagaaccagaaccaaataaatgtcctattcttaactgcagcacatctcaatccgtccggacccatccattccccgtcccgttgcctgccgcgcagcgagagacatcccgtcctcgtcggcgccgctcccctcccctcccaccgtctctcctcgcacgtccccctttcctcccgatcgcaccatctctccaccctcccccgctcccgtagtcccgtagctctcttccacggccccctcccgaccgtgccatctcccctaggtggcgctgttggtcgcggttcttgagagttgagacgcacgcgagctgttcgacgttctgcccagatggacgggaaccgtaagcgcaagaccgttgacagcgactagcatggtcctcctgtcaagaaggcctcgacgggcacgcccggtgactcctccttttcccagttcggcggaggtgagtgcccaagaacatccgttgatgacttctcgttgggtgttggtgattcgactttttcttggatttcagttgccgatggacggaacgtcacctggacggcaccgagcacgaccgctgtgccgatggagtctataggacggatggatcgttcggccacccccagtcgcctagacggcaaccgctccgcaggcgcgtccgggcccctgcgcatctgaggtagataacaaaggaaaatccagcgcgccttgttctttcttccaagatcgagtgcacccctgttctttctttcttcttcgtactcctgtgaagcagcttttgttctgagtgtcctactcgccatttacttgtcccggttgcatatgttacaattcaaaaggctatattatctatgtgaaaatggtttgattttgttcctagcaatgttgtattcaaattgtcatgcaaaacatttattactagtttgtagtactactatttgtgagactgccccctctgaatgctgagagtggattaaagtggactttttcctcaatttctatgctctccagtttataaagaatgcctgaggttgcagctaattacctcaggcatctctattgttgttactttatatttggttcattagcacagtgatacaagttgaaccttggatgaattttcatatttgctaactgtgtttttcatttcccatcttaacttgacaagttatccgtgacacacactttgctgcatctttggcttccacttaaaatggcatttagtgtattcttgttgtttgtgcccttttatatgtcctcaatggatgtaactacctatctacatttctactattttccttcaaaaatatttttgctattaatattgttgctctagaaggttttgtttgtgaattgctcctgattagcatgcattgtcagtaagactaattgtgctgtatttgttgtgggattctaaaacattctatatctgtttaatctgcttttgataacatcggcctagcaaatacactatgcattttctattttattttgattaatgaattaatttgtaccctgctttagtcacgcctcatatggacagcatgatagctgaaagccacaactttagaaatctgcttgacttttgccttgtttgcttgaacatgatcatgagcagtctctcaagtaacactcactcttgataatagaagcagatgcctacttaacaatttagaaggcccttttatttttgtatttgtgagactatgccccctctgtatactgcatttgttggtaaatactgtgtaatttgttgcgtccgtgtgcagtggcggagccaaggcccagctaccacgggcaatggcccaggctctgcctggcacatgcagctgtgcatccatagattaacacttaattagcttgctaattacattgcttagttcactgctaggccgtatgaagcaactccacatcaacacatatgcttaacacaaacttataaagcaaatgctcatgttaaaatgatctatgaattatatagacttgtatattcttggtttgtttgttaggtttacccgagctcttaaaattttttgaatctgccactgccatgtggatatttacgtttctgattacctaggtatcttgttctgtctgttctgatagtattttgtatatcttctacattacacctagtggctttgtcagcaatcagcataattgatagtcccatttttctgtgtatataatcgactaacttcagtaatccttctgtttctcactatcacttaagaaccaatgcccctgctgggaaacagcaagcgctctgtgggcgcatccaggcccctgcgcatccaaggtgagtacctaatcgagcgcgcctcttgccctcttcttttttccaagattgaactcccctcttcgtgccattgtgaagttgttcttcttggttctggttggttagcggagagcagcagtgaggaaggccgcgtcgggctggggacacctgcaccatcacaacatccgttgcctggtggcgcactcacccgtcgtgtggatacctccaatctccaggaaccactgcccaccgctgtgtctaagctaccttctcaggacaaaaatggtgagtgttctactcgccatttgcctgaccttggtgcatctgttacaattcagaaggtccttttatttttgtgaaaatgatttgattttgcagttagcaatgttgtattcaaaatgccatgcaaacttgttgctagtagtttgtatttgtgagactacgccccctccgtatgtttcatatgttggtaaatactgtttaatttgtggtgtctgtgtgactatttacgtttctggttacctagggcttttgctacattgaattgatcaatgctcatcactgtcacttgagaacagatggcccaactagttagattataaattattttcactcagttcattcttacctgaaattaacattttgctgcagcttctgttattgtgatagttcccggatggtcttctgatgataataacttctcggaggcagtgaagaaactgttgtttggccgaataggggcagaccactcagttgatcaaaaggtgccaccgccagcagtgagaacagtgattgtacatatctttggtagatatggaccatatctagctcgtcatatggagggattgactgcgcaagcccatcttaggcgtcaagaaatgacatttgaaccaaatatgtgccacagaggtaactgcccgtaacggaactctgtgaaaagactctttattacaaaattgaaggctaatactgtcgctactggtctttctcatttattttcttttggttcaaaatgtttttttttcaggtataatcaaggagagagtggatgaactcttggagccagcgaggccttcctctccgaagtgctgttcttgcgatcggcctgctgactggataacatcatgctgctcgttgatgctatgctcgtattgcatgccggacaagtttcatcagaagcacaagcgaggacatagccgggaactctgccgcgcgcaaggtgccattggcctgctcaatccccggagtccgttggaggaggaaacgaggtacctgatgaaaaatgacatgctctgcaagcgagaaattattctacaggttgaggacgaggagagcgggagaacacgggagtgcgacattttcgtgctcagaagcatgttacctctggctgacctgtggaacaggaagcgcttaaacaggctattcacgtgtggctatcacatgaggtggaatggggtgctcgacgagctcttcagaacggagaacaagctatctttcatgaagtagcgagtagtaatagaggcttacgtttgttctgtatgcgattactagaaccgttgttcagtaactcagatctgttttctggtaccctgccttttggattgctcttcttttattgtctatgcgatgttattcagcttgcgaatcttgttgagacatgtaaccgttgcttaccattgctcatgttttctggtagctgagccttttggattttaaggtccggaagtttgtcttactttgatcgtatcgtttatgtacaaagtttctcatataaaaaaccatatatccaagttttcaaactctaacttcgacaccaaacactgtcaaaccggacgaaattaaaatttgagagaagcatcaaagttccacaacaaaaaatatatgcatgccatgcatatatttttttcccttcttattacttaacactattgcgtttgttacaattaaatcttcacaaaaaaaaatcttacatgattatattacgataaaaatatttatgtttgtaaattacttttaatatatacgtaagttacttttatcatatatataaattacttttagatttgactaaattacttcttatactttcataatgctctaagttgattatttttattattgcttttagtcaattttataatttatggactttaaatttaatttttagatagatcatatttttttccctacaacgaatttacttctaatgttgtaacaacttacttccattttatgctaagttacttttatggtttatgtaaattacttttacaccttattaaactagttaatttgcccctgctaacactaaggtgtcataatcttttctgatggattacatgctagcaaaaataatttacctgttatccatccaattgagctttaattcgatctatgtcgcataataaggcaaagtacaataattatattgcctaaaaatattaattcaagatcgtcaattatctaatcacttcaataccaatatatgagacaatatgcatccacacaaaaaaggtgaggataaataaaatattccaagcaattccaccgcttctcaatcatggtaccgataatacacagtattaacacatattgatatagtatcatgtaactggcaaaatctaaataactaacacactgacaccactacagtacaatgaacacattgagttatggaaacaacagtcatcacttcttccttttttccatatctctcattcagtcaaccatgatcccttttaatttgtagatctttatagacttctattttgttatcctctcctagagtaagatgtgtgcatccttacaagatcagtaaagatcagtgctctcagggtcatttgctttcgtaagacgcaatttatctacacactcttagagtgattgtcaaaataaaacactttagtaaaaaacaattagttctgtaaagaaaaataattgcctagtgccgttcaatgaaaagtcactctagtgctgttttccgttaaaaaaaattagtaccaattctaaatctaatgggtacttaaaaaattttaggtaccacggtagaagatcggttctgctcatggcctgctgcctgcgaaatgtaaggtcttccttttgtggctcacggcgcaggcgctgtacgttgttggatcgtagatgtcctggtcagcgagtgtggagattatgggtacctcatatccacacggcatagctatccgactagtcatagaggatagcttatatctatggaatatgtaaccgatcatgacttgggtattacgtttccttttatattatggagcggcctaaagtcctgatttgataatattataaaatagatttaggaaaccgataccgtattggttaaggtttctatattgtaatcatgccccccatcctatataaggtggggcaggaggccctctagggggcatgacacaaactgatcgtcagatcaatatacacccggcggattcaaatccccaaacaggagtagggtattacctctcatcgagagggcctgaacctgtctaaatcctttgtctccgcatccatccactttcaggtctcgtgcgctacccccttttcatattgccgaaaatttgtttcgacagttggcgcgccaggtaggggttgcgtcgagttacctgtcgacaagtgcgatggaatcaacttcatgagtcaccggcttcatcttcgcttcgggagttttttcgccgaccacttcaacatgctcctgctcttcgactcggatccaatctagccgggaagatcagtctcgacatgttcgatggattcaatttccaccgccgtcaatacctccatggaagacctcagtttaagatcaaataccatatacacatgccctgccgccgtcggaatccgatcattgccaggacgagtcccacgccaattatccgttcggcctaatttcaactcagctgcgattagccagacgcacaactcagctgcgattagccagacgcagaacgacgaaaggcagtcatctatccaatcggaatagtaatcgtgtgcgatttcgccatgtatacaatatacatgcatgtagcggagtccactgacaacagattgatctggaatcataattagcagactttgcagcacgtgtctccaattactgaagcaccagcatatatactatcgttattcccaggcagatttgtttgttttgggagcttggactttgccgccatgcataggcaacgttgtctaatatggagtaattaagattcatgcaactactacttgatttaatcaccggatggtattgatcaatccacctctgtccgagctgtacacgagtgcctgatctaaatgcacagagacacgtcgccaggaggacgagtcggcagagtcaaaccaacgagctgggcagacgtcgcatgctaccacatggatagaccggcgggagtgcgaagctgtttctccgttccctgacctcatcgttgccggcttgcctccgtcatcatcaccgccggcctgcctccgtcgccgccgaccggtgtcctcgcctatacggttggttggtcacaccaccgttcatgggcgtccacgtcttcaccgatcggccgcctcgtccgctgccgactggtgtttccgcctgcacggctggcctattatgccgctgttgttgggcgtctacgtcttcaccgaccggccgcctcgtccgccgccgactggtgtttccgcctgcacggctggcctattatgctgccgctgttgagcatctacgacttcaccgccggcctgcctctgccgccactgactggtgttttcgcctatacggttagcggactccgccgccgttaatgggcttcatcatctacaccactggcttggttccactggcgccgactggtgtttttgtcaccattgatggactgcttcgttcccacatcggctacttttgctgtcaccgagggaatacgacaaagctaagtcgtcatttattttattctttatatgatattttgccttttcctttgcctcactacatcaactggttcgccgttgactagtgagtcgggggctacagatgtgtatcatattttttaaacaattttcataatatttatcttgattgcttgcgacatattctgagtacaaaagtgcctatcgagttatggagttccatcttcctatgcttttcgtttggtttgctaattgatagttgcctttgggctgattcctagcacccgggggcttgttggatggatcgaataacgcaaggtgctaagtattattcggaataaatcaaaagcatagagataagataatttattttctgctcttaataattgcaaaagtacccgagtagtaaactccgacccgtgaaactttgttccattaatgacgaactcatgtcactcatatgcatgtttgggaagtgcttaggctgactcccggtgcatggtggctatgactagtcgggcagagtgtttaaacgtaatgagtcatctgctcggggaaatcaaaattgacaagagaagaaatacatatttataaatattttaaaatacttgaatttttctcgagtattatatttatatcagatactactcatcctatatgtttgttctgcaggatccagatccagatatgcataaaagggattcatggctataagcttatctcttacgctccaggaatggatcagtcagcacatcaccatcggcttgctgtcatcgcctgggtggtcacaccgtttttgttgggcgtctacaccttcaccaaccggccgccttgtccaccgccgactggtgttctcgcttatacggtcaggtggtcacaccgccgttgttgggcatctacgtcttcaccgaccggcttaccttcgccgccgccaactggtgtctccgcttgcacggctggcctactatgccgctgttgttgggcgtctacaccttcaccaaccggccgccttatccgccgccgactggtgtctccgctgcacgactggcctattatgccaccgttgttggacgtctacatcttcaccgaccagccacttcgtatgacgccaattggcgctatcgtcttcacggctggccacgtcgccaccatcgctaataggcgtcatcatcttcaacacaagctgtctacatctgctgccgactggtttcttcacttccatggctgcatgattttgctagtgttgattggccttatcgtcttcaccgtcggtcatctcgtctgcagctgactagtgcactcgcctctacgtctggtttacaccgctaccactattgatggacgtcatcatcttccgtcgccgacttgttaagtcgccgccgactgatatttttatcttcacaactacgcgtcttcgcaaccggtttgcttccgttgccgccgactcgtgttcacttcatcacggctatgcaactttgttaccatggtggagctacttcatcttcattgtcttcggcaccggtttctactcggacatctttaacatgtatcttcactcaagtgatggccacttgacgacaagctacagttctcgactctatgttcagttgtttcccaactaaccaaagagtcgggggctacacaaatacaagactctcaaaattcgacaagctgaagcaatcaattaatcagccaacgagtcaattccaggagtcattatcttcgtctttgctttagagcagagttatcaaccaatcagctcagtttcgacgagttggacaacatcatctactttcctccaagtgaagcatctgcaacagctataacaccaatttgatggattattgtcactgacatcatcaccagcacctctgcttcatcggccctgacatcaactctgttgctaatggatgactatgtcttcgccgacttattatttcactttcacggttgctatcgactggatcaccgacatcgttatcttcatcaacatcctgtcaagcctattcaacatagcccactctactgctattgatgggcaacttcgtcattatatttgattatctatgattgctgcttatcatcattactgtcggttgcgtttgtcatcgctgactattttcttcatcttcatgattggtggatttcgtcatcgcctttgatgcgtgtctacatcttcaccgttggcttgctttcgtcaccaccgaccggtatcctcgccttcatggatggcttattatgtcgccactaatgggcatcttcatcttcttcaccagctgccttgtctgtcatcgactgattatttcactgccatggctacacaactttatcgctgggcgccttcatcttcattgctggctgccctgactgctgccgactggtttctttgccttcacggttgtgcaacttcatcacttttgattggtatcactatcttcactaccaccaatattttttccacctctggtgagcaatattctctctatattggtcatcttgtctctatgccaattgcgtcagctaccatcaatggacaattgtgactacgacagaaggacaagctatatgctcaggggcttactagctcaaacacaagtatcataccttcaatttggacttgtttcggatacattcaacatggatttatagtcatgagtttattttctatgctcaaagactggaccaattactattccccgtaaggactatcaactgaatacttgcgccagtcgggatttaattattatatctattttggagtatcccataagggataatcactcagatcagaagctattcatatgagctacacttggtctacattacctagaagacttattacttgggagcatgttacatgtgtcatcctttaaagggtgtcgaagtcatattttttggcctaggcctaatatgtctgcagcccatattttgaggtgtggccagtcacgttcttttagggacttaggcactttttgcttaggccaaagtgcgtgtgatctagtgcccaataccttaaagtccttttataccgcagttactcaactttttaggagttggtacaatgcatcttaaaaggtgtcaaacagtaaagctttatatagctgccccgctgacttttttatatagtcatggcactgtttgggtttatcaagcaattgattggatacaacataattgctttttgccacgtaagtgtgcatttttattgaccaatattatggcttaggctgattatatattttggtcattttccagatgattgataaatccttatgagtttatttactcggattttataccacatatgccatatatttccaggtgtggtgaaaccatgtgtcttttagggactcaagcacatctgttaaagcagtgtgcgcatggtgtatgcccaatactttggaaatttatttattcacaacatacaagcttctttatagctgttttgctatgtgtattcaatgatgtagtcagctttagattgcacgcatcatattttacaaagcagtcggtatatcactcggatcatgttattcaaggattcacaccgcatatgctatatattaatattaagtcacttggttgactacaattatcaaaaccactcagttggtgcctctattaggtacatctattcgatgcacctgactttatttttcagccctccacaatcttcatatttggtaaaagtactcgggggatcatggcaaagatgattgaagcactcggttttggagtaatctagttcgaaagaagattatctttccgactgtgaaggtctccggggctactgtggagattatgggtaccccatacccacacggcatggctatccgactagtcatagaggatagcttatatctatggaatatgtaaccgatcatgacttgggtattacgtttccttttatattatggagcggcctaaagtcttgatttgataatattgtaaaatagatttaggaaaccgataccgtattggttaaggtttctatcttgtaatcctgctcccatcctatataaggtggggcaggaggccctctagggggcatgacacaaactgatcgtcagatcaatatacacccggcggattcaaatccccaaacaggagtagggtattacctctcatcgagagggtctgaacctgtctaaatcctttgtctccgcatccatccactttcaggtctcgtacgctaccccttttcatattgccgaaaatttgtttcgacagcgaggaatcaagtcatcaactgccttacctcctgtcctttctatgcgcaagaattggagacggtaaaccatatcctcggtaagtttggtttcaattgctgtccatggcggggaggctggaaattgcaccccaaccatggctgcttgatccaagatggtgggcttaattgaggatgcggttgacgaaacgtcatcgtacgtcggaatctcgactcgcagatcttgcgtttcttcgactatgtcttcggtttcctccgtcatcatcctcatccgattggaagggcgccagtggttgctcgatagtgtggttcatttgggggagtagtagctttcggctgttgtttttgcattcattttggggagtagtagctttttaactaggatttgcaatctcttcctttcgacttactccctttgtcatataaaaaattaaattctaggtatgaatacagacatccctaggatttgagtttttttcacagagagagtagccagtaattcctagttcgtttttcttctatcctgttcaccctggttgcgatggctgcccggatgtcgtgtcgtgtaaaactttcatttgctccttgtaatatgatgtgtaattttttttgtgtaattttttgtgtatttctttgtgcattgtggaaaaacttaatccatcaatgaccgccatgcaactcctaagaatgtcatgattggagggagaatggattctagttccttgagaggatgttcgaacccataaccaggcggatggaggggataactattcttagttacagcagaggaaaaaaaccttgtgtagaatttttctcttaaattcaatgcaaatgactttcaaaaatctagaaaaaacgggaattgttttgatccctcactgagacattcccttgtttgtttaaaaatcaatcaaaatagttagaactcggccttagtcaccgacatgcaactatccttttgcagttgatttctctacatacacacagagaggggaattcattccgcggtgcggagctcaaggtcaagtcgcggagaccgttcaagtagctgaactagtaagagcaagttctattgtagaaatttatggtgcaaggccaagttatagatgtgtgataaaaaaaatagtactcactctttttcatattataagttgtgtttgatattttttccctagtcaaacatttttaggtttgactaaatttataaaaatatatattaatatttttaacacaaaacaaacatattatcaaaatatatttaatgttagatttaatgaaactaatttgatattttaaatgttgctaaatttttctataaacttggtcaaacttaacaaagttttattaaaaaaagtcaaacgacttatagtataaaacggagggattagaattttaatacttgtatagatcgaatttgagtctacataagtgttatatattgatctatcgtgatgaattctttcaaaaacattttaagtgacatgaaaaaaatgagggccgtcccataagggatgattattagacttttccctaatccaggggacaatcagcaacctgattatactggcgagagcaaggtgaaacaaaacaacacatcccagacactctcctatccaatcagcagagttcaagtgttcaactcactaaccaaaacaaagtgtcagggtactccacaatcctcaccaccattattattgatgctatggcaacagaacagaaacaaccttcagatgaaaagatgataaccagcagcctgcagactcatgcagacgagttcacaccctgaattcgctggaatcaattatctcaggaacgcagtcaagtcaacaaaaaatcagcgtgatttttgcaaggaagcatgaaaatcgtttaactcaggaacgcagtcatgccaacaaaaaatcaatcatctcaggaacgcagtcaagtcaacaaaaaatcaatgatcgatgcaagaaagcatgaaaatcgtttacccgcacaattgtagtatcacgggagtaaccaagtcggagaggagtgggcagacgatgcgcgctgctccgagaaacagcgatgaacgtgcccgtcgcaccacctcccgttgtcgctgcagggataacggcgatgtccctcatcgcggaagggcatgccctcatcggcgtaaacgtagtcatccaggaagtagacaccctccttgagtcccagcccaagctcaggataggcagatgattcatacgatctggagcagccacgcccgacgaagaatagacgcccatccagcgactccagttcggtccaggtgtcctcaattttctccacgccggtgtagtcctgcaccatctcctgaaccatctcgaacaccttgaataggcttgtgggagaacgtggccgagctgcaaatctcacaatcatcagaagcttggcccgggactccacgagatagcgcgcatggacatgttcgcgcaagcgctcccggtgccggatgcgctgaacagactctgtagtgccttggaggccaccatctgcgtagaacatggggatacaggtgacgaggaatcccctcctcgtcacgaaccggaaggcgccatcctgatagatgacatcctgtatctcatctctgagtctgactgttgagtcgggcgccattgttccttcgacggcaacacgatctcccatacgccagaaggcgagacggcacgagccggcgatgagatcccagcgcatgacgatgcccgcgccaatgcagctcgtgccgcctggggaagaggagagtgctgctgccagtataaccatgttctgtgcgcgctggtagtcgtcctcgtcctgatacgagcggagcaggtcggggaaaggaatcaagctgctcttggaatcctcgcgtgaccggaggttgatcatggcgtgaagtcgattgtgctcgaaggcgacgaacagccaccctccctcatgcgagccgaagcagcgcgccccgtgcgcggggctgaggcggtggtgaagactgcagcggtcgatcccgcagtagaagcagtagacgtggatgaaatcatcgccggcggatgggaggagtaaccaagggagagggcgcggcggcgagggaggcggcgtgggctcggcgagtgcgccgcgccatgtcctgcagacgtcggccgcagcatcgcggtccgcgacacatcgcaaatggcggaagatctcccgcagcaaatcagccggcaaatccgccatagtaggcgcaggcgagggctccatctccatgggagccgggaggggtaggggtggaggagagggtttggaggattcggcggttggtggatggaagggaagggaaggggaggggagctgtggccaagcgacgctgtactagtaggagtacttatgttcgttgcccctgcctggcgttcttctgcttctagaagcaaagtgaggctgggcctgggcctgggcctggaagggcagaggcgttcttctgcttttagaaagcgaaactgctgttcggcgaccggtcgcgcgcgcgcgcgactggacacgtgtcgcatgcggagaggggcgccggacggcgcgccgcgcgggaggagctccgtgttttccgtttttttttcttttcggtttctcttttttttctgtttttctttcgtattttttcggtttcgtttttctttttttctttttttctttccgtatttttttcgtttttaatacgtatgtatgcaaactttgtatacgtaaaaatataaactttgtatacgcatatataaagtttgtatacacgtatgcaaactttgtgtacgcatatataagggttgtatatgtgtatgcaaactttgtatacgtgtactttttgggtttttatatgtacgtatacaattttgtatatatgtatacaaagtttatatacacatatataaagtttgtgtacatatgtttttttaggtttttatacatacgtatacaaattttgtatacacgtatataaagtttgtatgcatatatataaagtttatatacacgtttttttaggttttttaatgtatatatatattttttatagtagtagtactaatagtagtaatagtagactagtagtagtaatatattaaatagtagtagtaaaaggtactagcatcagtcgcgcgtggccccaggcacgcgattagtcgtgcattaggcgccccctttagaaaggggatagtagtatctatagatttgtcctgctaaaagcagagctcagattttttttaaagatattatttgtgtacgacattttcggaaataatgctccgaatcatggtattacactacgagccctattctaaaatataagtatttttaagatggtcacatatattaaaaagtagatagagataatttgagaaatgttataattggttgagatgaaaaggtaggtaaaaaaaaggaaaaatggttgagaggaggagataggtagagaaatagttttattttaaaataagatgtattagaaataactaaattctgaaactcagcatttggttcccaacatttggtaccgaactcagcctaagcactgaatcagctccactaaaaaagaaaagcgaggaacaaaatgggctttcctgctctcaagaaactaacaaaatttctagtgagtccaagaatattgtaagtcatgcaggatttgctaggactaggatgcatgcatatgctactccatcaatcggaaccaggcaagggtgttcgtggagtcaccttcaattcttcatctccaccgttccacccgaccacaaccgtcgtggaaatctttgcacattgttgtcgttgacacattaaccgtcaaaaggaaccctacttataaaatttaatagaacttgtacaagatgacatggtcgccacaaagatgcacaattccgagaagaaacaacaacaatctttgcagacagccagagacaatctcatgggccatagtaaatgggagcaacaacggtttagttatacaccatgtattttggagtcgcgctgaacttctgataccctttgatgaccttgtttacagcatcaaggaagtccttctcagtcactgttttccgtcgggcgcgaatcgcatacatgccagcttctgtgcagacactccttatatcagctcctgtaacagcaaacaggagtttgtgagaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40580 - DNA, 4425 bp, Oryza sativa
tgcaacaagtatctgatttatctactcctgcaataattctttgcaaagtcttaggtacacatactgcaaacaccgcctcattagattagaaatttttacaaggcctacttcagtttttatcttactgttgaagtgttatatgctatacagaagatcagagccagaaactagctaagcaacactataattgttccttcaagatacaacaaatatatgtttgagaatgtcttagacattacataaaaaatcatattcatttcagtctggcttcacacattacatatacataaacacaatggaatattgtcaaacatcctctaaagaaagaatattgtcaaacaaaagcaatcgccatagaccataccaatggcagatgcatatggagcaatcctttcatgaaaaacaggcttgtagtgttctggatgagcataatagtcagcctgaaaaatgataccaattgggaattacagtgatgcagttgtaaagtaagggaatactaatgagatatttaacaagaatgaaaaaaagtttacgagtaatatttgaaattaattttacgataaaaggaaagttttaatcaatgtaatgaaaaatggatagcacagaattaaaaaattatccaaattgcttgatggaattaagaaacaatgaccaatattatgagacaaagggattacattaggacacaataagataagttatattatgtacactaatacaaatacacactgtaattatctcagtattttgtagcacactttaattcatcttatgtttctaaaataaaagaattgtgcattactttgttgaagcatctggtgggatccttgggagtgaccatgtctctagaagagacaacacaaccatacagctggaatactctcttgcttgattgtggatgttgagacagacttctagcctgaaaaatgaaacaataaagcataatgaggtgtcttaagaaactaatgcttatgtttacaaataaaatcaaatagctaaagtatcctatcatttagtttttttttaaaaaaaacagagtgaaactagatgtatactatcattcccacaaacaaaaaggtgctggcagaaactacattcagttcaaacaggtcaaaagagaaacttacgaaaactacgatgcttagatagttaacactaaaacttctgacagagaaggagtaataccgcagaaagctctggaagcttcccagcatcaacaaagctatggggcagtaacttgaatatctcttgcgcaccctgagaaactgtcgtgcatgaagttatatatatgtgagggatacaatgttacaatgagaccaattacaggtctaaagagatgctatttttcccagaaagtaagattacgaaatgggcaacagctaagaacttttgtctcttcaaagcaccacaatatatccaaacaacggatattcccaacttgagcttatatgatgggcaaaaaaaaaaggtacagtaaattaccatttccagttccagtgaatacaaatactattgggcaaattccagatggaagtccaaatgttgctatctcttcaccaatggcaatgactgcagccttggctgcagcgagtgaaggatacatatgtgattgccctagagagagaaatggggtcgagtatccaaggctcaagtaccctgaaatttaaggtgaaaaatgacctgcttgaataatccacaacaccaaacaattacttgtgaagactaaatggtgcttatgacgaaaaactgctacctaagatagtatgtgcagatagcagatttgggtggcactagaatatcatatcatgtcagtacatgaactgagaaattaaggcaagcattcttcatatcatgtcagtacatgaactgagaaattaaggcgagcattcttacgttgtccgagaccgtgtaagaagtctatcagtccagctctcccagcaaatttcccaaatgcaagcaatcttttcccatcatctccagcaattagctcataatcaaacagggatactcttttttcaaggatctgagaatgtgacctagaagtttagtacctccacaaaaaatgattgtatctgttaacggaaaacatggatataagaatatggtagctacctcatctaatagtggcatattttctttctgggccttatgggtgtgagaaaagaatccatatgctctatgtggaagaatcatctccagctgcataaaggaacatagataagaaaaattcataatcgcgatactggtacaggctacggtgcacagtcgattagagcatcgaagatggtaatgtaacctttggttgtttgattcctataataagaccacactctgacaggtcttttgaaatctcacacccaacatcctcgtattgagcatcatgatggatcctctttgtacttggttgcacgataatccgatttaccccagttcccctcttgcctcctccaagcagaaggcgagcacaatgggatggggttaatggtgctctcctttcccacatattagcagtctcggcaagaatcccaacaactccattgcctagtaatgtgtcactgttctgtggatgaaaataaatacagttagaatgtgaatgaacaaaaaactgcatggtttgatgtctgatagggccaagcaacatacttcatttcccgcagaacccatagagaagccctgttaaggtgccacagtgaagaacctgctatttacaattcctgagaatgaaatgcatgccaatcagggtatggagatttacaacaaatgattatagttgcaattatattttacacaaacacaatttagagcttctggaagttgcagctttttctagaatctccaactcccgaaacagtctagcttttcacccagattctaagaatcataagctatagagtctaaaaaatgattataagccataagctgcaaaacccagcttttccacattctcactagctggctactcaccaactacttctcaaattctccagcttgtcaagactacactctattgctgaaattatcttattttccaaacatttaatttgaagtttgatcaacatgacctaaatatgaagggaaatagtttctttttgtttcttaaaaaaagataaagaaatatcaagtagatgagctctcgaactgttccattgttaaacggaacccctcgtttaaacactcatgttgtcatgtgccaagtatcaatcaaataataaaaaagcaatagtgtaacgagaaagaggaactaaacatctccctttgtctataggtggagactcacagtctctcactgtgcaccatggtccactactccactctgagcctctgatgatgacaaccaaggaatctgaggtcctaatcaatgactccaagaggaaaacaatactcataccagtactatctttccaacatgattgacaaaacagaaccgttgattcttcatggaatctccggacggaccggacctcggagacaaatggcccaacggcccccaactccgcacctcactcgcacccatgccctgtacgttggggcagggatgatgatcaataattgatcatgatatgctgcattgctacctcctcacaggctccttgctgctatactattactggcctcacactttgtttctggccttctgttcacagcgtctctcgctaagcgaaaccgacgcgtaactcgtaagcgttggcaggtgtcacacgccgcgggcaaatgcgcatggacgccaccgccgcggagcacgagaggctcctgatcgtgaatccgcgccaccgcctcccccagcggccgcaatccggccgagctacccggaatcctcgcgaatgtcgtcccgatcgtctcctaccctcgggaaatcccctctctcccccgcgccgcgaatccccaaaacacacagagaaaaaaaaagaaagaaaaaaaaaagctcggctaggttggtgatggcgtcgtcgcgtacctcggattgccgcggaacggagacgacgacggaatcgtagcaggcggcggagtggaggcgcagccggagggattcgaggaacggatgcgctccagcttccagtttccaaggaggtactagtaaaataggaaggcggaagaagaagaactgcgcgatttggacacgtcggctgcggcggcgccactggccgtgggatggcgacgccgggccgacgacgccacgggagaggaaggcggcgtcgctggacctggacctggacaggagttggttctgggcggagtggaggcgacggcgacgaggacggggacggcaatatgaagctgcagcgtggccgtgtacgggggcgtggcaacagttggcaaatttgtcctctcccccctttccaagcatgagggggtgaaggatttatccagtgagtcagcgcctcagcggaatttccactttccagttgaaaagtgggctgcaggaat

SEQ ID NO: 40581 - DNA, 17815 bp, Oryza sativa
ggtgttactaacctggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtacaggcggtcggcgtggaggcggcgacgcgggggacggcgcggaggcggcctgcgcggcggtcggcgcggcagcgcggggggccgcgcggcggcggcggtgggcggctggcgcggcggcgcgggaggccgcgcggcggtgccgggggccgcgcggaggcggcggctgcggtgggcggccgctcggcggcgaccgacgcggcgctggccggccggcgcggatgggaggaggggaggcggcagtggccgccggccggattttttttcttttttttttttgaaatgtgaatctgtgatgtatttttgtgtgagatgtgaatctgtgatgaattttttagaaccctgtgatgtaatttttttaagagtttgtgatgtatttggagatgatttgtttgaggatttggagatgttctgtaatatgtgatgatttggatatgggaggggatggtgtgaaatcaatattcaatattaaaagcagaaaaaaaaagaaaaaatatctttagtcccggttggtgttatcaaccgggactaaagattctcccatctttagtcccggttggtaacatcaaccgggactaaagattgatttttagtcccggttatttgaaccgggactaaagatagcgatctttagtcccagattcgtagtcccggttggaaaaccgggactatagggggttatgaaccgggactaaaaagcatttctccaccagtggtaacgctacactaatacattaacaaaagcgtctcctaacacatgtttaaagaaacgaacaccagtagtatatctttgatgctcgcttatatgcgtatatatatgaacaccagaatttaaactctgatgaagttaggagactccaccgtttataccgctagtgctttttgtcttggttgactgatttttaccacgacgtttgaagcgatttgctcgtatggatggcggaatttcataatgaatcagttcatacttctgtgaagtttattttttttaaatcatgtgtttggtacagtgctatgcaaggtcaattggctgtgactctcagtctctctagatgcggaccatgcatgtttggtgtacgcgaatttgaaatatgtaaaaaaaatttgaggttttgattgagccatggatgagacgaacatgcacagacagtaccgtcacgtttcgagctgcgcgtgcccatctgtcgtggtcggtgtactgtggtacgtttcacggcaatcatggggcgaacgagttcaaaacatacagcgacataccaacgtctaatctacgagtgtttgctcgttacttctctgtctctccctttcagacttttgtatcgtttctcccaaagcacaaaagcaaaagatgaacagaaacactggaggtagaagatcgatgatgatgacggggatcaatggactgttgcacaggtcgatcgatcacctacgaaatgacgtgtccattttctaaaagaaaaaaaaaagagaaaatgacgtgtagatttttgtcattttggagtctctcgtatgctcgtttttgtacttcccttgctcagacgacgcatcaactttgcaaatgtgcaggacttcagccagaaccgatcgaaagcgttaattagtacttcctccgtttcataatgtaagttattctagcattttccacatttatattgatgttaataaatctagacaatatagaaaatgatagaatgacttacattgtgaaacggagggtttagtcaactagtcagttatcaccaacgtggagaggacgtagcggataaacatagccgctttagccagctaacatgaccacatcacgcattattttcttttggactaatcaattactcgctctgtctttagagattctgaaggaatgtgacatatagtagtactataaacaagatacttttctagattcgtattattagaatagatcacatcctccaagatcccttatattatgaaacgggaagagtgttagtgatcagtcaaatagtatagtacgtacaagatttaatattataagtcgtttgattttttcttaatcataattttttaatttaactaattttatataaaaaaataacatctatgagcaaaattagtttcgttaaatttaacattgaatatattttgatgcaatgtttgttttgaattgaaaatgttactatatttaactataaacttgaccgacttaaaaaaaaatatgtaccgattataatatgaaacggagtaaaccaattaagtcacgttttgaagtagcatgcacagatgtaggagttacgacataatatacgattaatctacgcaacatgcgaggcgtgttggatttgcaaggagtacaaagacgggcgagagccgtgatctgctggacgtccactacaaataggcactccagctagatttgggtcggagagtcggactcggaccagtccagatcacacgcaatctgagcactcagttatggcaaaacactttgcttatctcttccttagctagtatacgtacgtagtgcacatgaacaattgaaagagaaacgtactaaagaaaaagtcgacgctgtaataactacttactccgtctcaaatatatttacactatttatatccaacacttaaccattcattgtatttgagaaagttttatgattagtatttttattgttattagataataaaacatgaaaagtgttttatgtgtgactatttttaaaaataatttataaatttttaaataagacagatgatcaaacgttgaagatcaaatgttagacactaatatccacagttaagtttattttagacagaggtattaagaaaaagtcgacgcattgatatccacagttacctttattttggacggaggtggtaagaaaagtcggcgcagagagcgtgtacattttggagttaggtaccgatcgatcgggatcgtgacaacaacctatctgcagcgtacaaaatgagcgaaaacgacggccgaaagccactctcgtacgtgtgtttcttgcccacacgactacggcagcgagcgggactgcgttacagcgcgcgtggggcacgagtaggaggagccgaggagggagaagcacgtatatatttcgtttcaaaaaaagaagaagaagaagaagaagaagagaagcacgtatgtatagccagttggccacgtacagctagcgctatataaatttgcctgtgttgcgtagtatggtcttttgccaacaaaattcagttggcagagctcggtcatcgtgtagctagcttacctttgtcttaaaataaatttaatttccatccatatttatctacttttaatacaactagcatggtggcccgcgaagattgcgcggctagcaccgttatatttttctcatataatagcttaaatatattcacattttattaaatacattaaaatggcaacataatttaaattcttgatcaaactaacaactgtgtgatattcatattgtattgtatatacgtaatagttattaattattttaattttaaattttagttatttatagattgtatttctatatggactctagactcatctttcaatatttttaattttttaattccgaattttattattgataaattttattcctatatgaactctggacacttcttcacatattcaattttcttaattccgaattttagttatttgtaaattgtgtttctatatgtactctaaactcttctctcaacattccttattttataattctgaatttccgttattgttaaattggattcctatacggactctatatttgtttccaatatttcttattttttaaatttcagttatttataaattttattctatatggactctagactattttttcaatattccttatttgttaattccgaatttcagatatttataaattgcatttctatatggacgctagactcttcttctaatcttgcttattttttaaattttgtattttgttgttctatattgtatttctatatggaatcttaactctacttttaatttttcttattttttaattctgactttcagttagttctatattcctatatgtactatgtactatagactcttatttcaatatttctatttttctaattcccaatacattatttctaattgtatttatgtatggactctaacttcatttttcaatactttgtattttttaattttgaattttagttatttataaattgtattcctatatagactctagattttttttgtctaatatttcttattttttaattctgaattttagttatttataaattttattcctatatggactctatactcttctcccaatcttgcttttcttaatttgaattttagttattgtaaattatattttgatgtggactctgacttctatttttaattttcctaatttttaattccgaattttaattagttctaaactatatacttgtatggactctaatatcctctttcaatattccttactttaattctgaatttttgctatttttaaattgtatttctatatgaactctatttttattttttttcaattaatatgagaatttctaggccatgagagtagacttggtggcccgtacagattgcatggttagcattgctataatcttttcacgtaataacatatattctttcatattttgttgtagaaaaatattgaaattgtaaccatgctgaaccaaatcgaccaatctacgatattctaattaatatagtaattcctatgtctatagagcaaacgtgatataatggatcatctggtatatttgtttgtttcctccctccatctttatactcttttagactattagtgacatcttgtaattatctgtaatgtatttattagcatgcactattgtacaattagaaagggacaaataaattgcctcccacggccatgcatgatagcatgagtacggttactattagtatctcttacagtttccaaaattggtgtttcatcctgtttctaaataaaaccttgtccgtttgcatgtactcctaattttctttggttttttctttgtttttcttgtccgcttccacatattgtagtcctaatatgattctcttttctcttttttcttattttatttcgattaatgtgggattttctagaccatgagagcgaaaatactcctatcttaattttctagactaaattagtttcattaaatcaataattaaatatattttcataataaatttatcttgggttgaaaatattttttttctacaaacttggttaaatttaaaataatttgactttgaccaaaatcaaaacatcttctaacctgaaatggagggagtagcatatactcctatatttagggctcatattaatttgacaacttgcatagagttgcagtgatgcgttcaatttgtttgtcgcgcctttaaaagagggcatagccttttttactacggttgattccaggaagtacacactcaacacatataatattttctttttcattttctatctcgtgctacttcaatgtattgtagatactatactacacagacaaaatgtcgactacgtacgattgtaaaagatagctaatgagatgaaaggtttctccactaatatattatatttcttgcttttctacaaccaatataagactatttgtgtgcgctagtttttttttaaaaaaagaaaaaaaagctatatacacgtacgacgtaagaaaatttcaaagtcttactggctagcaccataaattggcacacaataacatagccagttatattagctacttctttcgtatcaaaaataaataaatctaacataaaatattatatattttaatatgatatctgatatctggttggctgccttgaacgcagcaaaattacgaaaattgcatgcatcgtcgtcaatggacactacatattttcttactacaaacgtacgtacggcagcgagcggccgacgaccacgacgattgaccatagatagacgatagacaaaatctaacgcgggatagatgggccatggttagctgggtggaatctcggagactagagcaacggttcaccgttcgcacgccacggcgccacgctgtgccgacatcaccggctgcacgcacgtcgcgggcttgtcgtggccgccgcggagaaaagaagctgccgcggcgccgcgcacgcgcgctgtaactttacgtaacgtggctagctactacactactactatgaccgtttgcattgcattcgatcggttgatcccatgcttttgtatggacctgtggctctattatactacctctgttttcttaatataaggaattttagcatattacttgcactgttcggtcactcatcttattcaaaaaatttacgcaaatataaaaatataaaagttgtgcttaaaatactttgaataataaagtaagtcataaataaaataaataataattctaaaatttttttaaaaaaaacaaatagttaaacagtgtaagtaaaatatcaaaatctcttatattagagcacggaggggtatgatgagtacaagactttaagtagcagttggttggttgatggttagtttctacaaataaaaggaaatgtgcttctgagattttgatttctaatttacatttttatgtagagaggaagatttttttttcaagaaaaatctgcagttgctttaaacttttctacactgtctcctttgattaaagagacatgggcgcgaccgcgcgagctggcggccgacgagcgctgcgtggtgagcaagtgctggcccgtttggctttgccacaaattttgacaatttgactctttgcaaaaactatttttataaatgaactgatcaaaacttattttaaaaataacccttttgttcagcgttacatcgtgtggcactgaatttaaacacctcagcgccaaatagtgtgacgctgaatgtgcgttggcacgctgacttagcctcccatctgcggtggcacgacattcagcgctagatgacgtggcgctgaggtgtctaaggtcagcgcatgatttggcgctggaaaaaaaagatcatttttgaaataagttttagcgacggttcatttgtaaaattagttttttcaaagtgtcaaattatcaaaatttgtgtggctttgccttcctgtggctgctatgcaaagccaaattacactgccacgaaattaactccaataggttgtacggattatatctactaaaggccttgtttagttctaaactttttctttaaacttttaactttttcatcacatcaaaacttttctacacacataaattttcaatttttctatcacatcgttttaatttcaaccaaactttcaaccaaacgttcattatatctgttgacaggtgatacccggatatagagggtattggggtacgttgatgtaagggtctatgtagtacgacatcaagcaaacagaagacgaagattatactggttcagaccccttgacaggtaatagccctaatccagttggtatggaattatatgatgggaatcacaggttacaaagggaacgatggaactcgatgaaaccggcgagatcataatcgagttgattcgactagacctcccagcgatttggctcatgtagggtccgacttcgtaggctgtggtggtggcgttggctgtgagattcgatcccgcaggtcctcccagcgggtcccttttatatcgcaggccaggcggtctccaagcaggactcggagacgtcgaaccgcacacgatacgttgacaacccaatcttgtctgagtaggtctctttccatttgccaattccgtgaaggatttccttaacacgtatagagaatgtccctacatgcgcgggcatgccatattgatatgtgacgtatatcgaagggtaaagggtatacctaacccgtaaccctgacagtagcccccgacttctgcttaaatgaactcgtgtgaccaatcgcgacttctcatgtcgaagctgatgtcgttctcggtgtagaaaccatagagacaggacatagtcgagaacaccatgtgaaacccaacggtcatgagtgaatttaaactgaagtctaaaagaccgccgcgcgtaacagacccagaaatttccggcgggcatctctctcctttccttgaaattcgcgccgtgcgaagtgcgtctacttaagggaattttggggattcattctgaagtctgcctgtttgtgagaaaactttccagcctccaagcgtccctcgtcttccccgctcccataaaaaccctcgcttgttaatctccgtccttcctccgacgatctctagttggcgatggatctcggcaagtctacttccaccaacgcgtcgctgaagaaactctaggaagaggacgcccttcccagtcgtggagtcatggagagagaagtaggagttactgaaccccagcctgtcctaggtcgcatggttgcgatcgaggactacattctttgtggttttctccctccaccttctgaatttcttctattggttctgcacttctacagcctttctttgctccacttgaactccaattccattgccttcctcagtatatttgcgcacctttgtgaggcttacattggggtagagccttttctcgatctcttccgcttttactatgagttgcgttggatggaatccaccagggtgtccggatgcgtcggattccgacttcgggatggcttgaaatcgtgctacatcccgttccagtgcccttcttctcgtagcaaatggcgggcgaggtggttctatcttcagatagagaattcggatcctgtctttgtcatccccgaggaacaaccagacaagatttcgtcttggaccgcaaagcccgccttgaccccttccctccagtccttcatcgatggcatcgacgacctccgagtacgaggtttgtcggggtatgaagtcgctaccaacttcgtcggtaggcggatacagccgctccaggcccgagcctacccagcctttgactattctgggccggaggacgcgacccgggtttctcctcggggtattttcctttttagttaaattgactccctcatgcgcatgttctccctaacttatcgaattctgttctcgatcagcaggcttggatagcgccaccgtggagcgccgcgttggccaattgatgatcagcggcccgacaacggcaaacgacgtccccgttcctctttttgagaaggaggcgaccgagcgcgaagccgcaatcaacgtgagtgtagtcggcaaccccttcatttttgctcctggatcggataatgactttatgcgatgcaggctctccctctgactgacgccattggactgctcgtggaccaccaggcggcggcctcgttgaaggagggcgtcgctcaggaggcgtccgatgtggccgttgctgctacgactagtggcagccgtgtcccaaggatagggagaaagttcacctccgtgctcggcagttgccggatagcgtcctccccatcagtgagtttcttgattcgttaactgcatagtcgaaagatgtcaccctcaattcgtacttggtttacttaggccgtggctgcgtctccgccaccttcgcgatggcggaagctggtgacgctgggcgagaagtaagtagacgaaaatcgagatttttaccttgtttgatttctggcgacttgtttcgagggccagacatgatgatcttctgcaggtcgacacaggcgaaggcggcgcaagacaggtccggagggaactccagcgcatctcctgcggtggcctcgaccgatgtcgtggtcgtgccgaggagccgtgaggcgacgccgagcaggccagccagtgacctcgggcctactcgcggcccgtctgccgacgtcctcacctggggggagtttcaagccgagatggggcgcatcctcgaggctggtgttcgcggcataagtcgcgagattgcggaggcgagggtagcaggagcgtcgtcagcgaacgagcgtgccgacaagctggagcacgacctggcggaggttcgcgaggacctccagaaaatgagggagctggtggccagcaacgagcgacaacggcggggactcgagggccagatgtcagaactcaagaacaacttgtcggagatccgtggctcgttgcgggtcacctacaccggcctacactagctcgccgaggaatgtggtgttacgacaaccatcccggcgaactccgacgagttctcgctgacgtcttcactcgcggaactggcaacggcgatggaggcgataccctccaagcatgcggccaggatcgcggaggaggtgtccaatgggatctataccggggcctgtcacgtccttgcgtgtgtaaggttggcacaccccgaactcgatcttcggcagatcttggattggggggccgccaacgacgcgcgtaagggcgtgatggaggaaatcggcgagctgggagagtctgttctcccgctttttgaagagtaggacctcagttcctttgtaatcggttatgccttgtaaaacctttgttggcctcaactgcctttgcttgtgcagccgtcaccttggtctccgttagcactttggtcctgaatatttttggttgtcgtttgtagggatgtcgatgttgaggatgtccagcagcgtgggcagcccgagttaccggtggtcgtcccggcgattgcgctccaaccatatgtgtcccaggacgatgtaggtcatagtttgcccgtgaatacgggtatggcgacgacttccctaagttggtgatctttgttttcatctcctttatacttctatccggagtgacttgattttctgtgttctcggaagagaagagcagcttgacttagttgtttccatgctgagcagatctcgagagtaggcttgctgaccaaaatcgttgcatccagtattggaagacgaagtgtgaggtcgcggaactcgagagagccatgttggaggtgagaaaggaccaggccgtagaggcactccgaggccgcgaggtgtggttcgactcgtatctgaagagttgttgcacgtccatgtcgagggtctgcagagagctctgagtacctcgtggggatcccgaagagtccgcagccggatatttctcgtggctgaacggagcctgcgctcagcttgagggtattggtcaacgcatcgacgaggccttgaagcaggagtgtcgtcgctcaagccggtatgccgaaggacacgtgttggcctgtatacgagatcaccgtccgcagctgcacctcgagttcctccgcgaaggtttttcacgttctcggaggactcctacggagatagatggcctggcgaagtcgatggcgccgctggcggagaaagttttccagtcaatggactggtgttggccttcctggtagcctttgtaccctgtgatagacgtcttagggaaaagtgtaatatggttttggacttgtgtgaaattgtaagaagtatcttatgaaatagaaaagaaatctatcttaatgagtccttattctggatgtagtgtgtaagagtgcctcctcagttcccgactttggccagtcgtttgagttgtacactctccctagaccctagccttgtcgtcggaggattcttctcggaggacatggctcttggacctttgacctgcctcggttgaacaagcactgatcctaacccccagccgcgaagttggaaagttcatttccgattatgcgacttggttaatacgcacggggagaactcttacacgaccaggtctgacatggtctttcgtctccacagaatccgacaaggccttatcggctctgggcgtccccagccgaagatcccttaggttccttggaggccttgtcagcatggcataaagggacatgaggataggtttcaacgctaagtgtcatctgggtgagggatcatcaggcaggaacactgtgattgtaatatgcgcctgaaaataggctttattgatactgtaaggtgtcttacaggtatgggtggtattgactcatacgtagaatttacgtagttggtaaaagttccatgagtttgccaactcgcggccatcaccgtctgcaattttgaatgcgcctggccgcaagacttgtgtgatcgtgtatggtccttcccatttaggtgagaacttgtttcgccttgcttggttttgaacccttcggaggacgtagtcgccgatcgaaagtatgcgtgctcggatgcgcttctcgtggtaacggcggagggcttgttggtagccggctgctcggacggcaactcgttcgcgatgttcctcgagtagattcacattgtcgtttcgctgctcctcctgatactcgtcggaatacttctgtgctcgtgtactctgatgtcatagctcgctgaggagcatggcctcggagccgtacacgagaaagaagggtgtttccttgttagacgttgtcggtgtggtgcgtatggcccatagtactaatgggagttcttcaacccatttcttgtcgtgtgacatgagcctgtcgtagacgcgggtcttaatcccttgtagtactatgccgtttgccctctcgacttgtccgttgctttgaggatgagaaaccgaagcaaagcatattttgactcccagcccgatgtagtaatcctggaaatcggtgctgatgaactgggagccattgtcggtgatgatgcgatgcagtagtccgtatctgcaaaatatccccttgatgaacatgatggcgttgtcggccttgatttctcccgtgggtaccgcttcgatccatttagtgaatttgtcgatcgccacgaataggaacctgtagccgccttgtcctcgtgggaatggctcgagtatatctagcccccagcacgagaacggccaagtaagagggatggtctggagcgcttgtgcaggtagctttgtgtgcttgctgtggaattgacaggcttcacaccgctggaccatgtcgcatgcgtctttgagggcggttggccagaaaaacccttgtcgaaaagctttcccgaccaatgtgtgaccggcggcatgtgacccacagattccttcatgtatatcgaggaggaggtgtctgccgtcatcggatgagacgcatttgagaagtactccgtttggcgctttcttgtatagatcgttgccgatcatgcagtagatttttgctttacgggttattttctcggcctctgcgtcgtcctcaggcaactcttcgctgttgatgaacttgatcagtggggtgcgccagtcatctgtggtctcgatatcgacgatggcgtgttccgcctctgtgacctccgagctgatgtcgggggcggctgtgttaatctcgccgatggcctctttcactgatggctttgtcaggatgtccaaaaaggtgccgggctcgagtggttcttgcctggatgcacgtcatgctaggtcgtcggctcgatgttgtccttgcggtatacgtgtcggacctcgatcccatcgaaccttttctccagcttcctgacctctgcgaggtacttggataactcggggttagagcatttataatctttgtatacctggttggcgactagctcggagtcccatttcacgatcagtcgtttgaccccaagttcagctgctgctcttatcccggcgagtagtccttcgtactcggctgtgttgttggttgccctgaatttgaggtggattgcgtgcttgaattgatctccggaaggagatgtcaagacgaatcctgcccctactccttggctgttgagtgcaccatcgaacgccattgtccacgtttcgttgtcgatctggttgtctgattggttatcaggcatagtccaatcggctacaaaatcggcgagtacctgggatttgatggctgttcgtggtacaaagtggacatcaaactgacttagctcgactaccctttttgcaatgcggccgacaacgtctttgtttctcacgacttcaccgagagggaaggaggagacaactgtgactctgtgggcttgaaagtagtggcgtagctttcttgatgtcatgattaccgcgtagagcagcttttggatctgtggatatctggtctttgcgtcatggagagcttcgctgacatagtagactggtcgttggactttctctctcgacaacaatgccagtgctgacggagtatggcgtggcggcaatataaaggaataattcttcattaggttggggagcgacgagtacagggggatttgataggtagcgtttgagtgcaataaatgcctcttcggcttcctgtgtccatacaaatttatcttgcttctttagcagagcgaagaagggttgtcctcgttctcccatcctagctacgaacctgcttagtgctgccatgcatccggttagcttttgtacttccttaagtcttgtgggtgacttcatgttctcgattgccttgatcttctcgggattcgcttctattcctctgctagagacgaggaagctaagcagcttgcctgacggtactccgaaggtgcacttctctgggttgagcatgaggcgatatcgtcgcaggttgtcgaacgtttcccgtagatcgtcaatcaatgagtcgcttttcttggtcaacgtctgcgccggcgttgttcaaggctgcatcagtacattcgacctcttggattgctctagtttggatgatatatttgcctacctatttatcatatgtctctgttaatctagtcttagcatatcaatttagctctatcggctgcttctcgttttagggtttatgccggtatcggctaaatcgccttgctagattagattagcttagacatctaccaccctgaaaactcagtcaacagcttgattgtctagatattatgtttcttttcatacttagtgttgcatcagttaagtttgatctactaagtcgtgcttagaaccataatatctagcctgcttcttgactgccaataagggtttcatcggggtttcagccgatgagttatctggacgttgcatcggcttataaggattgtatacatgttggatttagccgatgacaacaaaggtttcactgtttaatctaatctgtggattttatgacatcggacctccagccgatgtatgctttgaccttcggatcaatgcttattctatcatatcattgctagccgattggtttatattggattatgttattgttatattatattattatcagccgattgcatttatatcatcatctatattggacatatagccgatcgcttaaaccctattgctatcggctggtatcggcgtcggctattatcgatatcggctgagattgcagcatcggcttgtcagccgatcggctgttttgtttattatttgcatatcttgtcagttgcaagatcaaactgactggcacgcccgcatctcatcatatttggacctgcactggagttaagcagatctcccagaccggtgtgtttgatttttttcgtcaacacaaattggcacgcctagtgggaccacgaattttatatccacatgtctgaagaagaagtcaatgtcaagatcatggtcacaatgtagaatttaacagaggaacaaaggcaacagatgaagcagtttgtagctgattttcaaatgcgttgtcttcaatgtttcatcatgacaccagaagggccaactcagaagactcaatttcccaagccgatagttgaaatacttcaagatacagttgatgacgcagttcatcgcgcattgtttaatcaatctggagttttggcggatacattacaaaatttgatcaaagtaacagttgatgagttattcagaaaagccagctcagggagcagattgaagaacaacaacagcatcggctcggggggcagacacatcaatgtcagcatgatgagctatatcaacagtatcggccagaagaatctcaaagatatcagaatatagaagattgggccgatagaattgcaaaattagtagaggagcagtttggaattagacctaaggaacggatccatatgtatcggcagccatatcctgaatggttcgatagagttccacttccacactgatacaagattccagatttctccatgttttcagggcaagatgatacatctatacttgaacacatcagccgattcttactgcaatgtggtgaagcatcgactgaagaggctctgaaagttaggttttttccattgtctttgactggatcggctttcacttggttttcatcattaccatcaaattctatcagaggatgggccgatcttgagaagcaatttcatgactacttctttgctggattcagcgagttgaagctttcagacttaatatcagttgagcagcaaaaaggagaatcggctatggaatatattcagagatttcgtaatgtccgcagccgatgttatagtttgagcctaagcaatgaacagctagtagatcttgcattccaaggattgtcagcacctatcggagatagattcttttgccacgagtttgacagtctagctcatctaatgcaaacaatatcggctcatgaaagccgattgcacgaagcaaaggaagatcggttttggagttatcaagacaagaaattttgaagcatgagttctcatactccaaaactggggggcatgtgttaacagtgaaatttggtaagcccaaagttaccatcggcttagagtcagtatcagcttcaaagttctagaatcagccgatgggagtcaagtcgccacgatgtcgtgttcatggtggagtcggatcaatcaaaggaagcttatctagaagagtccgagttcaagaccgatgcgacatgacagtttatctattaattaggcatagtttgttagtttcattttatctttaggaaagtgtgtttagtgtccgataaggactttatattttcctttttagtttctttcttgtccgacaaagactggttcctttttagtttctttcttgtccgacaaggacttgtatctccctatgggtataaatatgtacacccggggtctatgtaatctatctctacgatcaatacaattcggtgcatcgccacccttttaccttttctactttattttatcgtccggcgggacttggcacctgacgcggggctgcatcggtgttcgatctccggcgaaggggtaagtccaatgttccgtcggcccaggcaattgtatcgtctgcgccggcgttgttcaaggctgcatcagtacattcgacctcttagattgctctggtttggatgatatatttgcctacctatttatcatgtctctgttaatctagtcttagcatatcaatttagctctatcggctgcttctcgttttagggtttatgccggtatcggctaaatcgccttgctagattagattagcttagacatctaccaccctgaaaactcagtcaacagcttgattgtctagatattatgtttcttttcatacttagtgctgcatcagttaagtttgatctactaagtcgtgcttagaaccataatatctagcctgcttcttgactgccaataagggtttcatcggggtttcagccgatgagttatctggacgttgcatcggcttataaggattgtatacatgttggatttagccgatgacaacaaaggtttcactgtttaatctaatctgtggattttatgacatcgacctccagccgatgtatgttttgaccttcggatcaatgcttattctatc

SEQ ID NO: 40582 - DNA, 7630 bp, Oryza sativa
  unsure (1)..(7630): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggctaaatctaaagccgatgtattgcacgagcatttgaaaggagttgtcgagggtttgctgagctggcaaactgatacaaagaattccttcaaagcgaaggtactggctatttgcttttgatactataaagcaatggcatttctggtggtatttatataaacgctcacaaacaatgatatggttgtttttgtcctgtggaacttttactattctaataactagatatattcatatcaactcatatagacaatatatgacatgggagaaactaaaagagtgaaatatgcatgatatatcacattacatgtaaactgctgctgttttcttggagcttgctattcatctcttatcttattgccagataaagtcactgatggaaattctagtgaaaaaatgtggtttggatgctgtgaaggctgtgatgcctgaagaacatataaaattgctgaccaacattaggaaggtaacttacagtattttttctttgctcttctcttgaagaatagacagttaatgttgtatgattgtatctggtcaatatgctcaacaattccatgcaatgttaaacagattaatgagcgaaaaatgcggaaatctaaatcttctgaggatggggataacatgtcgatgacctcacgagctacaaggtattgtggtgcatttattgttttttttttgttctgagaatttgttgatagttctgatggcgtgaatgtcacatctatttatacaaatttaacttctgttcaactgtcctggtcatgctccctgcagacaaagtagatggaatcacacacagatgttttctgattttggaagtgatgaggatgactccaatggtcccttttctgcccaacatacagttgcttctcgtactggaacaaaagcttcaacacggtatgtgccacaatagggccacacttggtttgtgaggattttaagtgtttctcacaaactgttatttttccaggtcgaccaggaagcgccaagcagataagagcttgctagagaagttcattgatcagtcaactggcgagcccctagatttacttgaccagaaaacagtgcggttggctctcaaatcgacgaaaaagagggctatgcctgatgaagatgatgatgaggtggagatggaccctgaagggcgtatcattgtgcgggaagagcgggagaggcgcaaaaagaagcagcctatctcccgagacgacgaggccgacgacaggagcatggtccgaagccagtccgtcaagaggaggaagacgaccagctccggctgggcctacactggccatgactacaccagcaagaaggccagtggcgatctcaagaagaaagacaagatggatccgtatgcctactggccattagacaggaagcttctgaaccgcaggtcggaccgcaaagcggcggcacgcaagggcatgagcagtgtcatgaaggtgaccaagaagctcgaagggaagagcgccgccagcgcgctcgctgctaagagaacgcaaacaaaaaaccggaagcagaagaagagcaagtaaggagacgaagggacagagagagatagggcaaggaagctttgtatagctgaaccgatggcccttggcagttgggagggaaagttttggacgtgtacagtgcttggtgaggattcggccgtagtagttgtttttgctcgtttcatctcctatctgtcgaagagaaacactaggttccattcttgccaaaaagggagattttttgaggggaaaaagggggaaattttgacacccgtcggtatgacggtaccagattcagattagatttaattttcttgtaagtttttgattgatgactattgaatttgaaatttgttgcttcctgcccgctgacacttcgctgtaatggaagatgagctgtagcgaaatttccgaattccttattcgggcatacgcgctaaaacaatcgcgcgatcgtggagctgtacggggatgaaacgcaaggctacggcgtacttgattttttttcatagaaagtgattttttttcttagaaagtgattttaaaaaaaagacactgtcaattcaactttttttttttaacaagggcaaacttcaactgtaatatttaaaactttaaacttaaaaatggaaacaaaattaacttgaaaacttttaactcaaattttgaaactttcaactcaaattttaaaaactttcaattaaaattctgaaaacttttaactcagagtttaaaaattttcaactacaaattagaacttcaaactgtttttaactaaattatttgtgtttttttaataaaaagctaatgctaagcttcatcattagcactattagtgatgttttgcgcgagggactaggtagggtgcatgcggccacacactaatcatatggagcagtttgaaacaagggttaatttgatccgtgacattacaaatgtgcctattcagataattagtctatttatagccatgtcattcaaatttttacaaaattggaaccatgccattgttgtctcgttttctatcttccctatccgtgcgtagggcccgccccttagattcattttcttcctctttcctcctctcttctatttttttttctttttttcccatctctctccaacactttcccgcctcctccccaccaatccatcccgacccactcctcgccgcccgcagcaacaagccaccgacatcgtactcgaactccgcactgatcaagcgagagagaaggctgccaactttgtcagtggtggcgacaccagcatccaacaccaacattgtcgttagctctagcgcttggagtctgccaacgccactgcctccatgccgactatgtgcctctactggccccgccacgttggaccggccttcctagagctcgccggccagcctccgcatggtcagcggggagaaccagcatcaggaaggcaggaacgggcaaagcaccatggggaggggtagcggcgaaggctacttgttgcatcgttggctagaggacgacggctgagctagagcgctggttactcgagctccatcgcagctgcttgaatcaagtagttatttcacgagaagaaggctctagtggcaacaactcgggtttggggatgaccggtctcatcatggagccggcagcaacaagatccagctccggacggctgtaggcgacgacaatgtgtgaaggggtcgagatggattggtggggaggaggctgagaagtagtggagagagacgggaaaaaagaggaggggaggatggagggataagatgaatttgacgggtggggtccatgtgcatatggggaagaagatagaaaacgtaacggcgatgacgtggttctaattttgtaaaatttgagtagcatgattatgaatagacgaattgtaatgacatttatctgaatatgttaacagtgaaatttggtaagcccaaagttaccattggtttagagtcagtatcggcttcaaagttctagaatcagccgatgggagtcaagtcgccacgatgtcgtgttcttggtggagtcggatcaatcaaaggaagcttatctagaagagttcgagttcaagaaggatgcgacatgacagttatctattaattaggcatagtttgttagtttccttttatctttagaaaagtgtgtttagtgtccgataaggactttatcttttccttttatctttaggttagtttctttcttgtccgacaaggacttgtatcaacccatgggtataaatatgtgcacccggggtctatgtaatctatcttcacgatcaatacaattcggcgcatcgccaccttttaccttttctactttattttatcgcccagtgggacttggcacccgacgtgcggctgcatcgtcttcgatctccggcgaaggggtaagtccaatgttccgtcggcccaggcaattgtatcgtctacatcggcgtcgttcaaggctgcatcagtacattcgacctcttggattgctctggtttggatgatatatttgcctagctatttatcatatgtctctattaatctagtcttagcatatcaatttagctctatcggctgcttctcgctttagggtttctgccggtatcggctaaattgcgttgctagattagattggcctaggcatctaccaccctgaaaatcagtcaacggcttgattgtctagatattgtgtttcttttcatacttagtgctgcatcagttaagtttgatctactaaatcgtgcttagaactataatctctaacctgctttctgactgccaataagggtttcatcggggtttcagccggtgaattatctggacgttgcatcggctcataaggattgcatatacatataagttggatttcgccgatgacaacaaaggtttcactgtttaatctaatcttgtggatttcatgacatcggacctccagccgatttgttatattttattatcagtagccgattgcctttatatcattatatacattggacatatagccgattgcttaaaccctatcgctatcggctggtatcgacatcggctattatcgactatcggctggaactactacatcggcttgtcagccgatcggctgttttgatctactatttacatatcttgtcagttgcatgatcaaactgactggcacgcccgcatctcatcgtatttggacctgcactggagctaagcagatctcccaggccggtgtgttcgatttttttcgtcaacagaataggcatagttgcaatggtacagatcaaattaacccttgaaacaagggattgaagcctactaattcctttgaatcctatggaatgagtacctattggtctctcaacagacgatatgacctatcagtgtgttataaggaacaataccttaggactgattttttttttacaattttcgataaaaaatattgttacttatttaaaaattcacaaatctaggtgatatgtcacatttagaattttgagttttaatctttcttggtaagttccaagttggctagatgcaaaagtttatatatgaaagaacattgataatggtggggtggttttgaataggcatttttgaaaattactacttagcagcggtgtaaatctatccagaggatcatgccagaaacatcgaaacttccggttggtcttctcgatctggacaagagagctgaatggagtttccagtccttaggttcaaaactttcgatcccctagtttcttccaataaagagggtgatagggacaatcttcatggaacaagcaatccaaacacgtagagaatgcaagaacaacaagcaataacagtttggactccggaacttccggcctgaggaaaatcacaaacatagcaatagatgaataaggagacaccaatttttcaccaaatttggcattgcaaatatcctacatctatgttgagggactccaagtagccagttctcgattaatcttaagcctcaccaaatgaccacaaagatcgagcttggtatccactcaaaggtgttccttttccttgttgagatagagtaacgtgttcacaaacctcttgggttgtccacacaccctggatactcgtgggtgatgcctaactagctaggagaacttccaagagtaccaagcttgaagatgatggtcggatgtcaatcctaagtgctcaaactgaacccccaaagaatccactccaatctcactctaatcactcagatgcacttgatccaaggagagcttatgggaataggtctaaaagttctaacaacaacttgctcaaagcaggggtaggtggagttaaatattcacctacccgaagctaaccattactcacaattttgaacttcggaacatccggcttgagggctgagggttccggacaatacttcggttttggaagacatggaggaccgaaacttttcgactcaaactccggaacttctgattagccctctctgctagctagagaactgtggttggaacttccggaacttacgtctggaacttctggtctagcccttggccaaacagagagctctagttgaaggttccgaacccgaactttgaagctttcggcctggccaaacacaaagctcttttctcccaattgtgagtgacatgctttgtgtttctctctaataggttttcatctgagcacaaggacacaaaccccacttgaataggtggtttttcctatgactcaatttcaaaagaaaaacaatgaaatgccttaagccatcccattgttttagttttaatttgtgagggtcatccatttagagcatcatccttagggactaatcaataattgtgcttaacactcaagtagctcattagtcccctaattgtcttgcctttaatattcctagatgcaatttaaatgtaagaaaatctctaatatagatgtgactctcttaaagaaaaagtgactttagagaaagtcacgctttatttaccataatcaataaaacgtgactttctcttaaagaaaaacgtcgtgacatgaaaatgaagtgattattaaggtgaaaagcacgagtgtgacgatgactagctgaccacgcatattgcacaccgccatcttggcaatcttaagttcctagttggttagacgcaaaagcttacatgaaaaggatctctaatagagtagtgaccctcaaactgtaaaacaagtgaatccaacactcttcacttaggggaaaaatagtgtaaccaacactcttcatttgtaaaataagtgaatccaacactcttcacttaggggggaaaaagtgtaaccagcactcttcatttgcggtcggtaacgacgtatgcctgcagtagccactccgttagctgttactgccagcccaccacctcggtatcgtgtatacatgcaacaaacagctactccaaaaatacttatattttaggacggagggagtagctagttagctgtggccatcataagtacaaaccgacgacaagccaggaaagcactgaatactgcatacatggaaaaaaaagagaggaaatattgccactgacatttcaccacaccaaaatttgtgtactgaaacaatactatatatgaatctatatgaatctagatatacatttgttcaggtacataaccaagattgatttcttttggacggagaatcccaaaatgcaaggacttttccttacaaattatttcaaaatttgaaatcctgagataaaactttattcccaacctatcaattacttttaaccttgtttattctctccaccatccattttcttactagtttatttctccacctgccaacttttgtagtactttattgtttcaccttcacctatcacctttt

SEQ ID NO: 40583 - DNA, 2761 bp, Oryza sativa
aatcaatcaatcatgataagacacgcagccatgcactactaagtgtatcacacataaattgaaaaaagtgtatcacgcataaattgcaaaaagtgtaccacgcataaattgcagaaagtgtaccacgctaaattgcagaaagtaagtgtaccacgcataaattgcagaaagtgtgtcacgcataaattgaaaaaaaaaggaatttctcactaaatgaatcaatccaaacaaagtaggtgcgattatcagttactagcatttagcattagtttcttttaacagtcaaaacaagacataatgtaactggcataaatagcggacttctgcagaaaggcaccaacctcagagttaggtcatgacactgctcttagcgtaagcacaaatttcttcctccccttgagaaaaaaggataaaacttgagccaggaggtatctgaacaaaaaatgtgttgcacataataatataagataattgccttgtacacagacactagagagtaaatccgagcttctagaggtacttacaagaaatgtttcacctaacgttttgggatgaagggatagctggcttcttctctatttgatcataatggagaacaaagttgtcctgcagaaaaacatacacaattataattcacaaattttcacaaaagtattatgtgatacaactttacattgaccaaacatccaaaccttgcggattgtctcccagttgtttggatcaaagcaaccataagatcctcgttcataatgaggtgttttgaccagaggctcaacatttggaattctggtgagccacacacgcacttctttatggtagaaccatcctcgagtatacctgcggaaaagatggacatataccatggttcaattcaacagttaaaacaaaagtaaaaaaaaaaggtttaatctccatttggtatttggttgtgctgtgctgcacctcaaagtgggtaacacatatttgccgtatgtattaagatattaataaattctaaggaagtaaatgcatatccaatatcaagcctcatgaaacacaaggaaatataataatcaattacatgaataacatgaaagatagctaattgatagattgaaagattcaaagccttaaacatccagaataattcaggatcatggaacatgttctggtgttgtgcaactagtagtcacccatctggattacgaacaagtcctaagcgtaccctttcaaataaataaaatacacaatattacttgtaaaaaattgctgttgatcctaaaccaattggcagtccactagtcccatactaatccaagctggtctaaaccagcctactccatccggtttcaaatttcttgacgttttagatatgatctcacataccaaggagtgtttaattagggtgcctattccctgttatacccatattaaatactgccatatgcttgaattaatcaatatttggatgtatcctagtggttcgaaacaacaaccagatgcaaagcatgcaggttcgaatcctagcgtcgcttcgtttttctcctttttctttccacgcgtggattttctctacaattttgcacgtgcagcacacgctggctggtgtgtttttctcgcttgtgcgggggacacgggagactactcaactttaaatggaatgcatgcataagaggcaaacaattccaaaataacctaataaatcccaaacgtcaacaattaccatactttggatacaaggctagaacgtcaacatttttataccggagggagtatgtcctacacaagcccaacaaaatgcaaaacccacgaatacagatcaatttaagtccatggtctatccaagatgttatattagataatgttggtggacggagggcgaagatgtggccaatctagttgtcaccattaacttggtttgcacccatcattaacagaaggattaatgatgcgtaaccagtggaaactatgctacaaataaacatggataagcacgactatgcaaatcaaaaccaacccctagcaacaagatgtaaatgagaagaccggtgaaaccatgtactcacagctcactagcagcacatagctgagcttcatcccttggcatgctgcaaaccaaagaaaaatgataaatctttcataaaaaaacaaactatactcacattatttgttgcaacaaatggactagcctaatagaattgaagtgggacacacttaatggtagatgtacctatagaagatgtaaaacagtgttggcgtctggaatttctgaaaatgtataggctgcaagaggcagaacacaattacaaatatataagtcataacatgaagcaaatacattgagacaataaattctgcctatgtttaagaacaactagtttaggaaattatgatggtcaacatccaataaaagatggcaaatgcacagccagccattacatattaaaaaatagcacacagtgacaggcagcttacttgtagtggtggaggttgctcagcggagtagcaagctggagtatgaaactcaggttctccttttgctggctcgtttgaccatggagagccaaatgtcttgtacagattgtctggtgagttcaagtttaaacccaatgttgtcaaatctattcctaaagcaagagatgataagtcaacatcattcatcctgataactcctagcaatcccatcaagccatatggatcagatggtgtttggcccccctggatggactttagactctgatccctatatgactgggtagctgaagacacctgctgcaatctg

SEQ ID NO: 40584 - DNA, 4861 bp, Oryza sativa
cccagcaacggcggtgggttgctgatacgtgcgtttgattttgtgaagcgttggagatcttggagtcatcgggtatcaagctggcggagagagtggagacctgagaatcggacccaatatgtataatgtagcatggtggtagcttctctatatatatgcttcagtgaataattgatttgccgttgtgtggtaattaagcaatgcccgctaataaattgtaccgtagaagtccttctatgtacatccgtatcaaaaaataaaaaaagcatcgattagcttgaataaaaaggtgagctagctcgttggagattaatcaggccgtcgctgttggcagcagaaagtttttagaacttaattacataaagatgatacaattaaaccgagtcactctcggcctctgcataaaatacacacagccagaaaaagaagaaagaaacaactagaacatctcccaagtacaacatctcccaagcacaaaagtttgacagaaacatatatcttagtggctatcaattcatagactagaccgtcacccagtcagaaaaagaagaaagaaacaactagaacatctcctaagcacaacatctcccaggcacaaaagtttgacagaaacatatatcttagtggctatcaatccatagactagaccgccacccatgctcctgggtaaaaaaaacttctgtgccacctggtccaaacatcgagataccaccgtaatagtatcccgcagtcccgattggtggaggatagcccaggtatgtagccaccgggtaactaaggtaataacctgcaaaggagaagacaccatcttgttatcaaaaattactccattcctgctcaaccaaatggaccaacacagagttgttgtacccatcaaaagcagattcatcatttctttggagacacatgatagccaactcccaaacatatgaccaacattgcgaggaggtttcagattagaagccaaatgaattacagaccacaccaagcgagataagcggcactgaaagaataaatgttggatagtttcatccttgtgacagaaacaacatatcttgctgcctttccaatttctcttagcaaggttgtccttggtgagaattacgccccgacgtaaataccaaaggaagattttaacttttaggggtactttcaccttccaaatccgttcttaatattcggaccccggtatgtgttagagctagataatgagatttgactgagaagaccccattcggggtgaggttccattgaaactcatcttgctcctataccagaaccaaatcagctatgcgaggcaataagttatgccaagcagctagttttgcaccaattaaatcccgtcgccatgaaaagcacggaggattggtttggaaaatctgtgcgatagtcgactgtttatgcctaactatgttatagagacaaggatactgttctcttaacgaggcattacccaaccatttgtcttcccagaacctaacttgggagccgtccctaatcttgaaggatccaaaacggataaagtcctatttgacctttataagactagcccaaaaatgtgaatcccccgctttccaataggcttgagataaaggttgtgatcccaaatatttattgcgtggtagttgttgccatattccatcggtggtaagtagtttgtataaccacttactaattaacgctttattctttatctcgaggtcatgaattcctagccccccttgttctttgggacgacaaataatgtcccacttagcaagccggtatttcttcttatgtccatccccttgctaataaaacctagatcgaaggtagtcaagttttttaagtaccccactaggaattgcaaggaatgacatcatatacattaggaaactgctaagtactgagttaatcaaagtaagtcgtcttcccaacgaaagaagttttcctttccagctactcaatttctgctcagaacatgaagtcagtgcttctagctttcgaacagttgtcgggtcttaagatcaattttcataaaagtgaactgtattgttttggtgaagcacttgattatggtgatcaatacaaccagctctttggctgccaggtcggcaacttcccattccgttatctgggcattccgatccattattggcagcagaaagtacgcaattgtgttttgagtgtatgcatgtgacttagatagttgcataaatattttataaaattagataaaaatagattatgatgatataaaaaatacaaatctaaattcgatctacgaataaaactgataacatactggagactgactatcaatggcaggtgaggcaattgatttcattttttttaaccaaataagcaagggatgttggaacaacaagcccggccagatcaacttgcacctatggttgcgagaagacgatgttttcacttgtgttgcccaccaacgcgaggctctcctcaaacaaacccaaagtagagacttcgttattgctgtaatcgtgatattcgccgacggcttcgtcctccggcgagaagataatctccagggtcccgacgctagggtcgaagaccaacacatggcctgtacctgtggcaaacatgatctttttcttcttcttttcttcgttgttgccatcactaaacatatgaatcggggcgatccaataccaccttagacacgaatggtcaggcggcaacacgctcacccattcgatggaacacagcttctcccagcttccagctgcagcttctctcgtcacccatatttcgcacgtaggactctccggctcctcgtccacgagctgcaactttacgtctgtgaaagtatacacacacagacagccatccaactctgtcagctcaaagtcgtcgcgagattgcagctcaggaggaggcttcaacgacgacacgccgaaagattcgtcggtcacgttgaatgtgacgatgtcgccgtctcctcggaggaagtgcaggtcgccgccgttgcagagcgcggctcctcgtcgccaattctctcgcgggtaatgccaatgccgcggcggcggcgtcgtggacgcggcggcgggcggcctccagctgctcgacggcgacggctcgtcgccgtcgagagccaagacctcccagacgacggtcgccggcgagcagcagcggcaacccaccacgcgcaccaccttgtgccgccgcgtggccgagcagtagcccaagccgtaggtcgccggcggcggcgtgttgtccgtgcccgggagacgcaggatgtggcgggtggaagggttccagaggtagtgcgtgtggtggccggtgatcttgaggaggacgaggccatggcaggacttgctggcgagcggaaagatcgtgccatgtggcagatgtctagcggtcatgatctcctctaccgggggcctggggatcagatgctgccactgccattgccaggcgaagaaaggttgtcgaggaccgaacggcggcctgatgaacagccgtggtgggtgtttgttccgctgctttcgctggaggaaatgggcttcctggaacaggtgtgacgaggtgatggtggcgtggaaccgccgcgagacgcatcggaatcggaggagcgatttgacgggcaggtgggagaggatctcgtcgacgatgtcgtcgggcagtggacaagggcaagcccccgagaaacgcttcatcctcttggcgctcctcgtgccatccatgtcttcctccctccttgcctccttggttggttaatgattactcaactcactcctgtttgttttgtttgatcgattctggtgaagtgtacagcagatccaggagatcggtgccctccagttaaatgagtacccaaggagcaaggatgagtccgaatttgaatgggacacgcaacaaaactctagtccgagccggagtcagttcgcacgggcacggtattccttcgattaattggcaatcgccgatcagcgatcactatcagccagctttgccgtttttagggaatatcctccccgtcggttgctcgggagaggtatagatggtcatctgggccgcccggcacggcatggcccaagcctagccgtgcctaggctgaggtttgtcgggctggcacggcccgggccgtgccgtgccagctcacaggcagcatacacagcccaggcacggcccaatactactcgggccatgccaggctggcccgaagacacgaaggcctattgtgcttgctcgtagaaaaagtatatttttggttcctcaactctgcggctgtgtttgaatggctggaaaataagtctattttgtatgcctcttgtcttgggccttgccttatacgattatataagtctattttgcgtccctatatttttttatttgatcgggccgtgctaggccagcccaccatgccgagggtgtagcccagacatggcgtggctgtcaggccaggccggcacgagcacgaccccagtcgggccttgccatgcttgcatcgggccaaaattgcgagcttcgggccaggccgtgggccttgggccatatggccatctatagggggagggagaaaaaatcgagcgctccctccccccacgacgcacgcccccttggccccacccacgtgtccctgcctccacctgccaagtgtctccaccacatactccattgaaacaaatcacccacatattttggaacgggattgctatatgtcattcgaatgaaatttggggaagaaatcttacagattttgaaccattggatccatgccaaggttcgtgcatcggcttctctccttcaactccggcgggctccccttcttctccggcgccggcgacaccccaactctgacgggttagggtttggggttgggatgagggtaggaggggggttgggtgagggggaa

SEQ ID NO: 40585 - DNA, 15862 bp, Oryza sativa
attttacctagtgtactcacaatgtttcactatgtatatatctaatgttgcagtgaattgaaatattcttttgcaataaatcacccacatattttgaaaaccctctattaagggaatttgtttcattttttgttccaccaaaaatgtttcaccagtgttcttttaatgtttcactatgtatggaacaaatgttgtagtgaactgaaacattctttcgctatttgctaaaacattatttttatataaggtgaaacaacacctaatttaaatgattgaaacatttttgatctactgtaaaataattccgatatatttggtggaacatcgtgcaacattttaaaataattcaataataagctaaacaaatttccgtcggaatatatccatgtatggtcttattttgaagatttaattgcaacaaatttaatggtgcaatcggatcatgatttggataaataatttaagagaaaaaatagtttaaaatggttttgcacgtatgcgtcatgctgacgtcatcatccgattttgccccctccccgtcggccgaccaacacgtagtcgtctcccgttttcagcccaacaatcctttcctgtttttgtcttttttttaacaagttcatttgaggtcccttaactttacaccgagttcaattttcatccttgatgcaaaattagacacaacgggtccctcaacagtcaaaactggtataaaggaggtccctcagcggtttagatggcgttttagctgacgtggcatgacgcctacgtggctagtctgacttggtcctcgtcctacgtggtggtgacatggctctagaagcaaaatgaaaaatatgtgagacccacatgtcaatcataaaaaaaatatagtgggacccacatgttcctcctctctatctccgcccgcagtctacgaaacgctcaccagtggctacgctcgccgaccgcttgggtgaccacggcggcagggatgggtgggggaggaatggcgactgggggcagggggagggggctgtgtacaaaacaggatcttgcagcactgggacgaatcgatggcgtcaacgttggagaacccgctgaagcggcggcagcggcttcgagctcgagtctcgggccccgtcggcgccacgctgtccgtgtcccgcgactgcgaactcgccgttgccagcgccaactcatgaagatcaatgcggcgacgcaacaggaggaatcggcggcgcgggggggtgaggtcatgcagctccggccgccactcctcctctctcgtctctcgcctgctgccgcacgccgcttctctgccattgtccatcgtgcgccactccgcctgaggcccagagccgccccgctctgagcaacgaagagaggggagatggggagtaggacaagaagagggggcgtgaatgacatgtggggcccacgtgggccccagtatttttaaattattttttgtgtaactgatatgtgggaccatagtttttattattttgcaaattaaattgtcacataagcgtcatgtcaatgccacattagatgaagaccgagtcaaattagccacgtagacgtcacgtcagctaaaaccgccttaggacttattttgcaccggttttaagagttgagggatctattgtatctggttttccagttgaagaatgaaaatcgaattcgttgataagttaagagaactcaaatgaacttatattccaccgagcattcaccgtcaagagaggcgctctaaatttctttgtttgcgaggtgacatttgatagtgcattcctaggaagtacgaacatattgctttttttatggaccagtaatatactcgtgttgtgtaaggctcttagccatacaagctgcagctactgtggctgctatatcacaaattgactacaagtagttgcagcaattcttaactacggtagccgcagttgcaaaaatatcagccgagcacatcttaagtgtgtaacaggctagacgcatataattaagaattgattgggtatatgggaaggaaataagatggagaacagtagtagatataatgaacacaatgagtgtgtttagttcacgttaaaattgaaagtttgtttgaaattaaaatgatgtgatggaaaaattgaaaatttatgtgtgtaggaaagttttgatgcgataaaaaagttaaaagtttaaagaaaaaatttagaactaaacaaggcctttagtagatataatccgtacaacctattggagttaatttcgagacagtgtaatttggctttgcatagcagccacaggaaggcaaagccacacaaattttgacaatttgatattttgaaaaaaataattttacaaataaaccgtcactaaaacttattttaaaaataatcttttttttccagtaccaaatcatctggcgctgaccttagacacctcagcgccacgtcatctagcgctgaatgtcgtgccaccgcagatgggaggctaagtcagcgtgccaacgcatattcagcgtcacactatttggcgctgagatgtttaagttcagcgccacacgatgtaacgctgaacaaaagggttatttttaaaataagttttgatcggttcatttgtaaaaatattttttgcaaagagtcaaattgtcaaagtttgtggcaaagccaaacgggccagcacttgttcaccgcgcagcgcttgtcggccgccagctcgcgcggtcgcgcccatgtggtgatacccgtagaccggatatagagggtattggggtacgttgatgcaagggtctacgtagtatgacatcaagcaaacagaagacgaagattatactagttcaggcctcttgacaggtaatagccctaatccagttggtatggaattatatgatgggaatcacaggttacaaagggaacgatggaactcgatgaaaccggcgagatcataatcgaattgattcgactagatctcccagcgattcggctcctgcaggctccgacttcgtaggctgtggtggtggcgttggctgtgagattcgatcccgcaggtcctcccagggggtcccttttatatcgcaggtcaggcaatctccaagcaggactcagagacatcgaaccgcacacgatacgttgacaacacagtcttgcccgagtaggtctctttccatctgccaattccgtgaaggatttccttaacacgtatagagaatgtccctatatgcgcaggcatgccatattgatatgtgacatatatcgaagggtaaagggtatacctaacccgtaaccctgacagtagcccccgacttctgcttaaatgaactcgtgtgaccaacgcgacttctgatgtcgaagctgatgtcgttctcggtgtgggaaccgtagagacaggacatagtcgagaacaccatgtgaagtccaacggtcatgagtgaatttaaactgaagtctgaaagaccgccgcacgcaatagacccagaaatttccggcgggcatctatctcctttccttgaaattcgcgccgtgcgaagcgcgtctacttaagggaattttggggattcattctgaagtccgcctgttcgtgggaaaactttctagcctccaagcatccctcgtcttccccgctcccgcaaaaaccctcgcttgttaatctccgtccttcctccgacgatctctagttggcgatggatctcggcaaatctacttccaccaacgcgtcgctgaagaaactccaggaagagggcgcccttcccggtcgcggagtcatggagagagaagtaggaggtactgaaccccagcctgtcctaggtcgcatggttgcgatcgaggacaacattctttgtggttttctccctccaccttctgaatttcttctattggttctgcacttctacggcctttctttgctccacttgaaccccaattccattgccttcctcagtatttttgcgcacctttgtgaggcttacattggggtagagccttttctcgatctcttccgcttctactatgagttgcgttggatggaatccaacagggtgtccggatgcgtcggattccgacttcgggatggcttgaaatcgcgctacatcccgttccagtgcacttcttctcgaagcaaatggcgggcgaggtggttctatcttcagatagagaattcggatcctgtctttgtcgtccctgaggaacaaccagacaagatttcgtcttggaccgcaaagcccgccttgaccccttccctccaatccttcatcgatgccatcgacgacctccgagtacgaggtttgtcggggtatgaagtcgctaccgacttcgtcggtagacggatccaaccgctccaggcctgagcccacccagcctttgactattctgggccggaggacgcgacccgggtttctcctcggggtattttcctttttagttaaattgactccctcatgcgcgtgttctccctaacttatcaaattctgttctcgatcagcaggcttggatagcgccaccgtggagcgccgcgttggccaactgatgatcagcggcccgacaacggcagacgacgtccccgttcctctttgtgagaaggaggcgaccgagcgcgaagccgcaatcaacgtgagtgtagtcggcagccccttcatttttgctcctggattggataatgactttatgcaatgtaggctctccctctgactgacgccattggaccgctcgtggaccaccaggcggcggccttgttgaaggagggcatcgctcaggaggcgtccgatgtggccgttgccgctacgactagtggcagccgtgtcccaaggatagggagaaagttcacctccgtgctcggcagccgccggagagcgtcctccccatcggtgagtttcttgattcgttaactgcatagtcggaagatgccaccctcaattcgtacttggtttacttaggccgtggatgcgtctccgccaccttcgcgacggcggaagctggtgacgctgggcgagaagtaagtagacgaaaatcgagatttttcccttgtttgatttctggcgacttgttttgagggccagacatgatgatcttctgcaggtcggcataggcgaaggcggcgcaagacaggtctggagggaactccagcgcatctcctgcggtggcctcgaccgatgtcgtggtcgtgccgaggagccgtgaggcgacgccgagtgggccagccagtgacctcgggcctactcgcggcccgtctgccgacgtcctcacctggggggagtttcaagccgagatggggcgcatcctcgaggctggtgctcacggcataagtcgcgagattgcggaggcgagggcagcagcagcgtcgtcggcgaacgagcgtgccgacaagctggagcacgacctagcggaggttcgcgaggacctccagaaaatgagggagctggtggccggcaacgagtgacaacggcgggcactcgagggtcggatgtcagaactcgagaacaacttgtcggagatccgtggctcgttgcgggtcacctacaccggcctacaccagctcgccggggaatgtggtgttacgacaaccatcccggcgaaccccgacgagttctcgctgacgtcttcactcgcggaactagcaacgacgatggaggcgataccctccaagcatgcggccaggatcgtggaggaggcgtccaacgggatctataccggggcctgtcacgtccttgcatgtgtaaggttggcgcaccccgagctcgatcttcggcagatcttggatcggggggccgccaacgacgcgcgtaagggcgtgatggaggaaatcggcgagctgggagagtctgttctcccgctttttgaagagtaggacctttgttcctttgtaatcggttatgccttgtaaaaactttgttggcctcaactgcctttgcttgtgcagtcgtcaccttggtctccattagcactttggtcctgaatatttttggttgtcgtttgtaggtatgtcgatgtcgaggatgtccagcagcgtgggcagcccgagttaccggtggtcgtcccggcgattgcgctccaaccatatgtgtcccaggacgatgtaggtcaaagtttgcccgtgaatacgggtatggcgatgacttccctaagttggtgatctttgttttcatctcctttattcttctatccggagtgacttgattttctgtgttctcggaagagaagagcagcttgacttagttgtttccatgctgagcagatctcgagagtaggcttgctgaccaagatcgtcgcatccagtattggaagacgaagtgtgaggtcgcggaactcgagagagccatgttggaggtgagaaaggaccaggccgtagaggcactccgaggccgcgaggtgtggttcgactcgtatctgaagagttgctgcacgtccatgtcgagggtctgcagagagctccgagtacctcgtggggatcccgaagagtcggcggccggatacatctcgtggctgaacggagcctgcgctcagcttgagggcattggtcaacgcatcgacgaggccttgaagcaggagtgtcgtcgctcaagccggtatgccgggggacacgtgttggcctgtatacgagatcaccgtccgcagctgcacctcgaggtcctccgcgaaggtttttcacgttctcggaggactcctacggagatagatggcctggcgaagtcgatggtgccgctggcggagaaagttttccagtcgatggactggcgttggccttcctagtagcctttgtaccttgtgatagacatcttagggaaaagtgtaatatggttttggacctgtgtgaaattgtaagaagtatcttatgaaatagaaaagaaatctatcttaatgagtccttcttactctggatgtagtgtgtaagagtgcctcttcagttcccgactttggccagtcgtttgatttgtacactctccctagcccccagccttgtcgtcggaggattcttctcgaaggacaaggctcttggacctttgacctgcctcggttgaaccggttgaacaagcactgatcctagcccccagccgcgaagttggaaagttcatttccgattacgcggcttggttaatacgcaaggggagaactcttacacgaccaggtctgacatggtctttcgtctctacagaatccgacaaggccttatcggtctggagcgcttgtgcaggtagctttgtgtgcttgctatggaattgacaggcttcacaccgctggaccatgtcgcatgtgtctttgagggcggttggccagaaaaacccttgtcgaaaagctttcccgaccaatgtgcgaccggcggcatgtgacccatagattccttcatgtatatcgaggaggaggtgtctgccgtcgtcagacgagacgcatttgagaagtactctgtttggcgctttcttgtatagatcgttgccgatcatacagtaaatttttgctttacaggttattttctcggcctctgcgtcgtcctcaggcaactcttcgctgttgatgaatttgatcagtggggtgcgccagtcatctgtggtctcgatatcggcggtggcgcgttccgcctctgtgacctccgagctgatgtcgggggcggctatgttaatctcgctgatggcctctttcactgatggctttgtcaggatgtccagaaaggtgccaggctcaagaggttctcgcctggacgcatgtcgtgctaggtcgtctggctcgatgttgttcttgcggtatacgaggtacttggataactcggggttagagcatttataatctttgtgtacctggttggcgactagctcggagtcccatttcacgatcagtcgtttgaccccaagttcagctgctgctcttatcccagcgagtagtccttcgtactcggctgtgttgttggtcgccctgaagttgaggtggattgcgtgcttgaactgatctccagaaggagatgtcaagatgaatcctgtccctgctccttggctgttgagtgcaccatcgaacgccattatccacgtttcgttgtcgatctggttgcctgattggttatcaggcatagtccagtcggctacaaaatcggcgagtacctgggatttgatggttgttcgtggtacaaagtggacatcaaactgacttagctcgactacccattttgcaatgcggccgacaacgtctttatttctcacgacttcaccgagagggaaggaggagacaactgtgactctgtaggcttgaaagtagtggcatagcgttcttgatgtcatgattaccgcgtagagcagcttttggaactgtggatatctggtctttgcgtcatggagagcttcgctgacatagtagactagtcgttggactttctctctctcgacaacaatgacagtgctgacggagtatggcgtgacggcaatataaagaaataattcttcattaggttggggagcgacgagtacatggggatttgataggtagcgcttgagtgcaataaattcctcttcggcttcctatgtccatacaaatttatcttgcttctttagctgagcaaagaagggttgtcctcgttctcccatcctagctacgaacctgcttagtgctgccattcatccggttagctttgtacttccttgagtcttgcgggcgacttcatgttctcgattgccttaatcttctcgggattcgcttctattcctctgccagagacgaggaagccgagcaacttgcccgacggtactccgaaggtgcacttctgtgggttgagcatgaggcgatattgtcggaggttgtcgaacgtttcccgtagatcgtcaatcaatgagtcgcttttcttggtcttgacaacaatgtcgtcgacgtatgcctcgacgttgttgccaagctggttgctaagtgcgccctggaccgtgcgctggaaagtattcccagcggttatgagtccgaatggcatcttaacatagcaaaataccccgaacggcgtgatgaatgctgtcttctcttcgtcttctctcgccatgctgatttggtggtagccggagtaagcgtcgaggaaactcaacagctcacagccggctgttgagtccaccagttggtctattcgaggaagagggaagtgatccttgggacacgccttgttgaggtcagtgaagtcgacacacattctccatttcccgttggccttctgcaccattaccggattggctagccactctggatgaagtacttctctgataaagccagccttgagaagtttgtcgagttcttctcgtatggcttgtcttcggtctggtgcaaatctctgcagtctttgctttactggcttggcatcgggtcgcaccatgagtttgtgctcgatcacctccctggggacccccggcatgtcggacggctgccaagcgaacacgtcagcattgtcgcggaggaaggtgatgagcgcgagttcctatttctcgtttagtgatgccccgatcttgacggtcttgtcggggttggcactagagagtggaacggtcttgatcgcgccgttcggtttcggcgtcttgtttgtcttgctcattttcttgggtggctcagttgtggcgggtggacttggtgtttgctcgaccatgtcgaggctccgcttgtcgcattgtaccgccagctttgcgttcccttgaatagtgattgttccctttggtcccggcatcttgagcacttgatccgcgtagtgagatgcggccatgaacttcgcaagtgcagttctcccgatgatggcgttatatgctgtatcgaattcagcgacatcaaatgtgatctactctgttcggaagttgtttgcttggctgaaagtcacaggcaacgtaattttgcccattggtttggacgaagactggggagtaattccatggaagggttgatcggtgggcgtcaactcgcttcgtgggatgcccatggcgtccaaggtgctggcgaagagaaggttgattgagctgccaccgtcgatgagaacccgcgcgaccttgatgttccgaatagtgggttcgaccacgatcggatagcgtcctgggatgacagcagtcttgggatggtcttcttccgaaaattctatcttctgtttagaccacttcatcttgggtgcagccccctgccatgtcgagcagacttctcgctccacttttttatactctcgctttgaggagtacgctgtggaacctccaaaaatatgtgagacgtggaggtcagagtctagatatgctgagtccgattcctgagcagtcatctccgcatccttctcgaccacgcgtactcgcttgccttgttccaatgtcatgtgcttctcgagcgatttttttgaaaacaaggcagtcttccaaagaatgtctgttcgacttgtgtatgggacaccatgctttcctcgcgtcgctaccttgtgggtctgggcgtttgggagggttagcatattctgctgcgagaacttctgcttgagctttccttttcgcattcttgcgatttttctttttgcttgactcaggtgtctccgtggctggtttcttctcgcccccggtctttggcttgtcgttcttgcgtctaagcgcatcgtcaacgtgggcgcatcgctcaacaatctcgaatagtctccgagtagttgtgatgtgcctcgttgctaactcctgggtagtgtagcgatctctaacactagacttgaaggcgcgaattacagaagcgtcggtgatttcggggattgtatttctgcactcattaaagtgcccaacatattccctcaaggattcacccgagttctgtgtcaatgcgtgtaagtcgtcttcgatcgcgtggcgcttgtaagttccctggaagttggcgacgaactgctgccataggtctgcccacgaagaaatcgagtagggcggaaggtgcatcaaccatgaacgcgcagagccttttaacgcagttggcaaataattcgccaacgcgttgtcgtccgctccggcagcatagagtactgtggagtagacttaaagaaattcttctgggtcagtgctcccatcgtacttctctattgctcccggtcggaacctctcaggccatcggacatcgcgcaacgaatgactgaaagccctacacccagcactgggggcaatgggttgtcggcgatcgtatgtccttcgtggatgtctgtctgacgatgaggaggaggaagaagatgaggacgacgatgggtcgcttggtcccggtgaaggattacgagaacgccgaccgggttctcgagagccctgtcatcgtcctccattgttgtcccggcaccgatctctgtcatcttcgtcattatggcggtgtcctcgactggtatcgcccggcgtccttcgttcacgatcgtcgtgaatatggcggttgtggcggtgatcacggtctcggtcttcgttcgaacggcctcctcgttcttcattgtcgtgacgtcgtgaagagacgtgatgataggaacaattctcgttttcccgtgtgcgacgagcctctcggcggccgtttaggtgatcacggagatcgctggtgccgcgaggtggagggctagcttgatggggtgattcccgctgttcggggttttcaccgttgataccaccagttggttgttgttccgggtgggatgcagcaacggcctcttcgaacgcgttgctgaggttggtcactgattcccataatcgttctgtccattgtgcgagatcatcgtttagaacggggtcataaggggtttccctcagtattgcattgagggtcctgatgtgctgagccggtgtagtcgtttgattttccgcctcggtgttagcgcgtgctgatgtgtttgtcccgtcgatagccaatacctcgcgtggcgtacttgttgactaggagtcgtagtccttgagtagatgtaggactgacggttcgggagaaccgatgtcgataacaccgacgaaacgatttggggtcagcgtcgttcctcattctttgtcttcgcctctaagggtcttgcctggctactggaccttaggagatgacatatttgtgacgctgagaaaaactttacagcttgagaggtcatgattctttgtcttgtgaataggacaatagacaccacgagttggagaaacacgctgaattccacgctctttgcatgcgcgaatctcggcgcgggcgttgaggaaaacccagcaggcttgcaaagtatgtttcctggttttgtggatagggcaccaggaccctgtcgcttcggaagttattcttgtcggcttgtgtttcttgtcggaacgacaaggtttggccgcattagaatccttctcgagctcggatatcgtcgatgttctgttctccgcttcggcaggaggacctttcgacgtggagtcgtcttgggttatagccactgcgttctcgtttctggtcatcgatggctcagctgagatcggcattgtggtgtaaaccggaaagacaatttcgccgacttaagtccacgctagcatcgttgaggcaggaagcccgtagttgaggttggtgttgacgctgttgtcgacgaggctggatgacatagtagtagaaccttgagcaccaagtccccctacctggcgcgccactgtcgacgggtgatacccgtagaccggatatagagagtattggggtacgttgatgcaagggtctacgtagtacgacatcaagcaaacagaagacgaagattatactggtttaggccccttgacaggtaatagcgctaatccagttggtatggaattatatgatgggaatcacaggttacaaaggaaacaatggaactcgatgaaaccggcgagatcgtaatcgagttgattcgactagacctcccagcgattcggctcctgcaggctccgacttcgtaggctgtggtggtggcgttggctgtaagattcgatcccgcaggtcctcccagggggtcccttttatatcgtaggtcaggcggtctccaagcaggactcggagacatcgaaccgcacacgataccggaaatctctcgcactctcaaaagagaggtggggcgcttacgcttaagtcgatggaacttaaggttgaaataacactgggagtctgcagctcattctactgcaaaccaacacacccacgcctactctcccgggcctagaaggtttgcaacattctcatcaacccagtcttgcccgagtaggtctctttccatctgccaattccgtgaaggatttccttaacatgtatagagaatgtccctatatgcgcgggcatgccatatcgatatgtgacgtatatcgaagggtaaagggtatacctaacccgtaaccctgacaccatgtctctttaatcaaaggaaacagtgtagaaaagtttaaagcaactgcagatttttcttttaaaaaaaatcttcctctctacatttgtcgctacataataaaaatgtaaattagaaatcaaaatctcagaagcacatttccttttatttgtagaaactaaccatcaaccaaccaactgctacttaaagttgtactcatcataccccctccgtcctctaatataaaagattttaatattttacttacactgtttaaccatttgttttatttaaaaaattttagaattattatttattttatttatgacttactttattatccaaagtattttaagcacaactttcatatttttatatttgtgtaaattttttgaataagatgagtgaccgaacagtgcaagtaatatgttaaaattccttatattaagaaacggaggtagtataatagagccacaggtccatacaaaagcatgggatcaaccaaccgaatgcaatgcaaacggtcatagtagtagtgtagtagctagccacgttacgtaaagttacagcgcgcgtgcgcggcgccgcggcagcttcttttctccgcggcggccacgacaagcccgcgacgtgcgtgcagccggtgatgtcggcacagcgtggcgccgtggcgtgcgaacggtgaaccgttgctctagtctccgagattccacccagctaaccatggcccatctatcccgcgttagattttgtctatcgtctatctatggtcaatcgtcgtggtcgtcggccgctcgctgccgtacgtacgtttgtagtaagaaaatatgtagtgtccattgacgacgatgcatgcaattttcgtaattttgctgcgttcaaggcagccaaccacgatatcagatttataatattaaaatatataatattttatattagatttatttattttcgatacgaaagaagtagctaatataactggctatgttattgtgtgccaatttatggtgctagctagtaagactttgaaattttcttacgtcgtatgtgtatatagctttttttttcattttttacaaaaaactagcgcgcgcaaatagtcttatattagttgtagaaaagcaaaaaatataatatataagtggagaaagctttcatctcattagctatctttatctacaatacattgcagtagcacgagatagaaaatgaaaaagaaaatattatatgtgttgagtgtgtacttcctgaaatcaaccgtagtaaaaaaggctatgccctcttttaaaggcgcaacaaacaaatcgaacgcatccctgcaactctatgcaagttgtcaaattaatatgagccctaaatataggagtatatgctactccctccatttcaggttacaagatgttttgattttggtcaaagtcaaattattttaaatttaaccaagtttatagaaaaaataataataatattttcaacccaagataaatttattatgaaaatatatttaattattgatttaatgaaactaatttagtattataaatattactatatttatctataaatttagtcgaatttaaaatagtttgactttatccaaagtcaaaatatcttataacctgaaacgaaggaagtaccaatgatgttgctaaggttctttcgccctgatcttctgtcaaaaatggagggccctgagatagtgagatgtcgacgccgccggccagacggctactacattacttgttgccaacctgccaattaactgattgcacgatcgcctaagaacagttgaaaccccgcgtgttacagtggaatatattttatttgagattgatggttgcttttgataaattaaagtggtataaaaatccatcactattgaattgggccacgatcaaattagatagccctcccgtggtgaaaaatatatatgggcctcacgtggtgactgtatgcgagatggattgggctatattttttcatccaacggttcagagatgattaaatatattgatccaatggctgagcattaacgatgatgtggcacattgaggtttgagttttagatcttaattgtagttagtgggttataataactttatagtaagaagggattagagcccgtcggttagcctaacaagttaaagtaaaagctaaaatttaaatttttaacttggttttgaagttgatattttcaacataatttctttgaattattagtttttaagtcgctacgaacaaatatataaaagttttacctataaattattttttattctctaataagccgaaaggacttgttagggaatacagacaatcgatgagcctcttgttagaaaacgatagtcaaaacgataaaaaataatagatcaatcacataagacatgagatttaacgtgaaaaaccctccaaagcaggagagaaaaaactacgggcaccagctagcaaaataccttcactgaggttacaacgtcgtacggtgggttacaagaggtatatatatgatatatatgaggtgaaaccctaaaaggtattacgatccgtaccgcgggggctctgcccccacacccccgctccgctccggcccagcctcccgcagggcccccaattcgctccgacagatctttattaa

SEQ ID NO: 40586 - DNA, 2343 bp, Oryza sativa
agagcttgaatagatgcaagactgcaactctgcttgctcagcacatatgttgaagcgactttgctgaattgcttgctggttgctgttgaagtgagttgaaataaggagtatcaaccaattgcattaggcaactaaatcggagccgtctaaatatttatggacaaaatttcttcaaaaaatttaacatatacaaatatagtataataatagtgtatttacattttcactcttaataaactttggccggcccggaaaaaaaagtgtacttacattataatttgaatataacaacaaaatatatgtaactttcaaaaatgccatggtatcacgcctattttcgtgaagtggacgtctccggacgaaatcctctcacaactacgcacaccgtgaatttttccttccccgtttacatgaatcttcaagcaaatttgacggttcaaactttccacgatgtagttacactgcaattatatcgtatttacatttataactgggccatggcctgcttgcagctccccaacgcgccacggcgatcaacgaaattggcccagcacacgccaagctcaagcaggccataaaagctggaaatattgtcattctcccagcccaccgcccgtaagtcgcgaatgagcccatgatgaggaggacgaccaacgatgccggcccaatttcgccctggatttatgcgaatcggcacctggttcagatggtagcgatcctgatttttcatgcggcagtgtttgttcattttatagccatttttaacctttttaaaatttaatattgctaaaattttagcaagttaacaatattattaaatttaggtaggataagcttgttgttgtcaaattctctagggatgaccaatactctatttgataacaaaatcatcatatatttgttaattttatcaaacaatgatatgctttaatctgaatagacctttaggaccctatttaggatcggtacctttcatgcccatatttccttaataagttaaaacatcttattaagaaatataaattaatttatagttaaaacttttatatgacttaaaaaccaatgtaaaaagatacactgaaaatatatcaaaatcaacttaaaagtttgaaaatttaaatttaggctttagtgtattagtgcaatcaataggctcttattcacttaagccccttagggatcctaatatatgcagttattatgaccattttttgactttatgcaatttagcccctaatctaggtcgaatttgtacaaatcaccacacaccgaagccgcaaaccccaccaatcccacaaaccactctccagccctctctgcctcctcgccgccgccgccgccaccgccgccgctcgccggcgcggcgccagccatgctccccttcgtccgctcactccgtaggctcggccctgccgcggccgatgggcgcctccttctccccctcgctccgctctcctcgaaggcggccgcgccgccgccggagtacgagatgccgtcggtgacgtggggcgtgatccaggggaggaaggagcggctcgtctcccgcgtgctcgcgctcgacttcctccgctccgccggcgtctccgaccccgccggcgagctcgaggccgtcgagctcccctcctccctcgaggtgctccaggagcggctcgacttcctcctccgcctcggcctctccaccgacgacctctccgcctacccgctcctcctcgcctgctccctccgcaagaacgccatccccgtcctctcctacctcgagaagctcggcgtcacgcgcgcgcgcctcgccgccttcgtccgcgcctacccggcctgcctccacgcctccgtcgccgtcgacctcacccccgtcgtcaagtccctccgcggcctcgacgtcgaccgccaggacctcccccgcgtcctcgagaggtaccctgacatcctcggcctcaagcccgatggcaccatcagcacctccgtcgcgtacctcgtcggcatcgtcggcgtggcgccgcgcgacatcggccccatggtgacgcacttccctttcttcctcggcatgcgcgtgggcaccaccatcaagcctctgtgcgagtacatcacttctctcgggctgccaatgcggatcctcgcgaggattctcgagaagcggccatacattcttggctatgatcttgaggagacggtcaagccaaatgtggaggcattgctcagctttggcattcgaaaggagatgttgccgctggtgattgcgcagtatccgcctattcttggattaccgctgaaaacgaagttagcagcccagcagtacttcttcaacttgaagctccaaattgaccctgatgcgtttgcctgtgctat

SEQ ID NO: 40587 - DNA, 9440 bp, Oryza sativa
tgtcagatgaggataatgcggaaagtgacgatgaggtgctatatagacgaacagtcatgctctagtgagtgtagtttcttcttcttgtctttctttgaaaaaagctgcagcatattagtactttgtgaacattcacaagattaaaaaaaaactggccatttttgttccagatttggtggaggataatcccaaagatctttcgtgatgtgctcctgacagcatcatgcacgcaagtgagttctaattttctatgttttctatgtcaaataccatctagtatagccctgataactaaaaccgactgcaagggattgaagtatacttactgaaactgttattattcatgcctgattagtgacgaggaacggccatctgatcttgtatattttgctcagcattagtagctgcaagatattgcatcaatggctactccaataagctagaagtagaggggctataacagggaagtaaaaatgaaaagataatgagttgtaatcaggaatgtgcaagtaatcatacccttttctgcaaaactaataaaatggcagactaggagataaatttaaatctctagcatcaagtcgtcaacacactttagaggctatctttgagacacagtgagactttcactttccaagtaagcttctcaaatgaatttgtgatagaatacgtcctctgttatttatacccacttagaaactaatcataaatatgagtaatctataaaaattgttgatgtcgattctaattatttgcttcattttgttcatgacttcaaggctataccatcattatcggtaaatagctgcctggttatttgcatttgcaaactgaaattcgctaaccacgcaggcatcctcaactgcaagatgaaaaaggctttggcgttaatggaacattctcacaccaacagaggtcattggagtgctggcctaagcaacagctcgaagggattaacaaaggtagcagatgtactccgtgacagcctctggctttggttatgtgcgacttgaggcgaaagctggagattcgtagaccagttttggtaggagatcaaagagtagctgtggtagagtggagataatgtgccagtgatgaaaaatcctgttcactgaaattttactctaggacaccatatgatcccaacataggattcagatttttgtagcctgtagactatttactgtctgtaattcaactgctgagaaaagtattgcctaatgaacttattactagcacggtgtgtacagcttacattgtgttccacataaccacatttcagtgtctatggttttgttgccaatctgaatgtcattacagatagatagagagttcacttcagtactggaaatcactctgaacctgataccacctctacctgccttccctagctaaatgtgagggagttgagctgtccttttgcacagaatgagctctgtgccagtgactgttcaaagcatttgtaggaaaagcaacgatgcagacagcttcgttggcagaagttcgcacaaagcatcatagggctcttaggtaaagcatcggtgctcatagcactgatgcgtcttgtatctgaatgcacttcagcagcttgtggtgatctttatttctaatcagaagcaaagttagacagccatgatgagctgcccctatgactatctgggcatctcttctgattattgataaatgttcatgtaaaatgcaggtattgtacagaacattgttgaagaaaaactccaacaactcacccagttaatccagtcatcagataggagcaagatcaagcatcatgtcaagatcagtcaatcaagtcatctaattagaacccaaatcacattagaaaaaagatcagaatcgtgtggtaaaccagatcttcagactaacaaatcctcacacactaacagaacaaaaagtttctgcaaacagaaacagaatgtcagtaaggacaagaggacagaaacaaatctttatctgcttttttctcccttattaacctttcacttttttctgtcttgttagagtgcaccgtttttgtgcgaacatttactcctttatccattaatcaggagtccaggaccatttcctttgctccatgcttgtttccagctctccatgtgctctgcattgccagatgcctctttgcaaagctgaccttgcattgcattgcccacagctcaaccatgcaatgttctatcttcatatcttgctaggaggattagcactcactaattatctctgaagaaacatgacttattatcactgattatcagtgaagcttttaccaagattgtgaaaattttctgacaagtgttgtttgatcaaattttaatcgagttatgcaccagaaacttaatcactgaacttgttagtactttatttaaaaagttgtataaggttgattcataatgcattatgagaaacgcctagggttcttccggctagcttcacaaggtggtgggttagacgatttgggttcgaagcctcacccattctaattatttaatattaggtcattctccaatattcgcgtctaatgcattattgacgccactagcaaggccacatttgtgtacttatactctataaagccattggtgatgtgcttgtacattgcacccatgcatctacacacgcatcaagctaaggacatggaaacgcttgggaggaggaggagagtggccgtccttgcatggtgcaatgccattgcaatggcgctagctctagcgacaccggtggcggctgtcgctgccaaccacggcgacacggcggcggcgaaggacaatgtggccgtcgtcccgaggattgccgcctcggcggcggcggcggcgtcgagcgtgaacgtcacggccatctgcatggcgacgccgtacccgagcgcgtgcgagacggcgctctcgtcggcggcggcgcggggcgcggccaacgacccgttcgcggcgtcggtgcagttcgcgatgacccgcgccgagtcggcgcgcgcgctggcgcgcaacctgtcggcgtcgtcgtcgaggccacgcgtggcgccgagcggcatggacgactgcgccgagctgctcgacatcagcctcgaccagctccacgacgcgctcgccgcgcgcgccgcggacgcggccggcgtgacgacgtggctcagcgccgcgctgacgaaccagggcacgtgcggcgacagcctcgccgccgttcccgaccccgcggcgcgctccgccgtacgcgcccgggtcgccgcgctcgagcagttcatcggcacggcgctggctctccacgccaagctcaacaatggcggcagcgggagctcctcgccggcgccgccgagccgcgccgcgttcccatcctgggtcaccaagcacgacaggcacctcctctcatccccggcgagcaccatcgcgccggacgccgtggtggccctcgacggcagcgggacgcacacgagcatcagcgacgcgatcgccgccgtgaccgcgccgccgccgccggcgcaccaccccacggcgagcggcggcggcggcggcggacggagccgaaaggtgatctacgtgaaggctgggaggtacgaggagagcgtgagcatcacgagcaagcagaaggacgtgatgctgctcggcgacggcaaggggaagacggtcatctccggccaccggagcgtcgccggcggctacaccacctacgcctccgccaccgtcggtgcgtacccttcccactactcacgtcgacacgacgcgccaccatggacgatatggatcgtcgtacgtacgtacgtgcgtggtgtccagatatcttccattccatgcatgcagagatgcccatgcatgcatgacagttaatagttcgatcgatctagtcgttagatgcgcacactttttatagcctttaatgatcgccaatctcgtcgaaattaatcctcaaccgtccaaatgctaacgacagcgatgttgcacttgccaattgccatcaccttttctctttttttttctttttttttttttgccggtgtgtgctgtacactacactcccatgatcaaatttcacaagcagaaatatctcattttgtactagtagagtagtagaaatggatataatcaattaactgaattataacaatagtgaattggtgattatttgtgcagctgcaatggggtcggggtttatagccaagggcctgacgatcgtgaacagtgccgggccggggaagggccaggcggtggcgctgcgcgtcggcgccgacctctctgtcgtgtacaattgcggcattgaggcgtaccaggacacgctctacgtgcactccaaccggcagttctacgccgccgacgacatctccggcacggtggacttcatcttcggcaacgccgcggcggtcatccagggctgcgagatccgggcccggcggcccagcccgggccaggaggacaccgtcacggcccagggccggtccgacccgaaccagaacaccggcatctctatccatcggtgccggatcaccggcgcgccggacctcggcggcacgccggtgtatctgggccgtccgtggcggaggtactcacggacggtcgtgatggggacgttcctggaccgttcgatcgcaccggccgggtggctcgagtggtcgggccagttcgggctcagcacgctctactatggcgagtacggcaacaccgggcctggcgcggggacacgtcggcgggtgacgtggagcggcgtgcacacgtcgatgtccacgtcggacgccacgaggttcaccgtggcaaactttatcgttggggatgcgtggctacctgccactggagttacctacacttcaggtctgtagtggcgtactagtagcgaaaaagaaaaaaatgaagatggtgttgtgttctgttctctgtatcacctgattaattaacttggagctaaattgcatgttgttaactagtaatttttatttgctccggtatttttatgtgttctacttgatgttatgcatgtttcagattacaatgtttctggatgtgttgaggttaattggaatggttctttatgtataaaggattctacaccaaattgaaacaatcacagaaactcgatgttctagcattgtgctgaaggaatacagaaggatccagttgataattgagacgaacaatactaaaactcatttatcagcaagaaatgataatgagtatatatgaaaatggatagagtttcagcttattcatgtagcaattcttaggccttgtatgtctgaatttcagaaaccttatttcagagcttccccttctgatctttcctgggctgcagagaatcgacgtcttcgaaaactcgaagcgtcgacagctcgatgaaatcggtgacttgaacccccataggcctgcatcacagaattgacagcacaatagtaagtttgatcagaaactctagtacgatatcaatctttttttctgaaataaatggtaaatcaagcaaagtgtttgccagcaccatgggaagcaggccttctccggcagccgcatgccaagcctaggcccttcatcgtacccttcgcagatcatattccccttatcatctctgtaacataccactcctctcacctggtcttcaaatacctgaacaatcacagcacagcataatcttgtgtaaaaaccatgaaccatttagcaacagttgcatcagctaattaagttggctgtacttaccatcttggcaggtgctgcagtttgggagaggtgagcattgctgcagctgcagctgtgcactggagctctgacgaacttggccatggttgccttccttgtgccaaatcttggggtggaaatggaggaagaaaggtgatggcaagagctcattgccgccatttggttcatggccttgctagtttgggaaggagaagggtggtgaactagttgcatagagggcaagcttttcaatgatggatccattggattttgacttcttggtgcctagcgtgtattattggggatttctattggtctgtttgctgatgctgagcaagatggcaatttttatatgcaatgttgctatatccacaagtgatgctaacaaattgaagatttgtggtcactttattgcattgtgaatcctgtctagtggacattgtgtaacatgattataaggttcctttttctggtgaaaactaagaatagcaaaaaaggggttcaaagattggcatggcatattatggtgttaacaactcggcacaaacattgtagtgttcatttagcattgttcttttgttagagtagaaagtaatgtttcggcttatcttgtatccttttgggccgtgggaccagctgtcccatcgtggacattatcttcatagtctttaataatatactatcctatttggagaaccgacaaatccttatctggtgatgtggtacacaaaacaaatactagtagtcgatttattttgatcaccaaatagtgtacgactgaggcattttacgcagtaatgaagttggcttcatcatgtggttattgaaaacactaataacattgttatattttatatttataaaattgcatgtggctttaaacagagatgaaagataatagtaataagcaaataggagtaccataattttatttacacccgaaaatcggccgctatttacacctctgatgaaacacaagttcccattaattcatctctgtttggacagagccccggaattacactgacgaaccctagttaatttactgtggtaataataatatttccagagagcaactctaacctggtgcttggggaggtcgaccaggtttactacatctgcaagtctcttctgcagcagggcttcaggccgcagcaattcatcccatccactgcaaaatgcaccacctccttggctacatgtttccgagccattccatcacctctagggccagaagcccaagcagaatacagtgactggatatcctcttccgacaacccgttccgactgagatcgagcaccttcagttgctttgcagaaatgatggcatcagcgagttcttggatggcatgacagccagaagaggagtttctctggcatgaacttgcacagctcccgtctgggccggtcgctgcacgggtgtcctcgtggactgcctcttcgtcttcgctatccggcacctccatcttatcagggtctatgtgatcgttcgcttcagcattggtacgttggttttggtcagtacctggtgatacatcctgcgcgtcttcatcgtactgcaatgttctctgtagtgccaggtttgtgttctcagcaacgcgtagttcctccaattggtcatttcctgaaagtagcaggagactattgaggttgatgcataagcttccatacttgttggtttttatgtagtagttgttcctcacctgctagtgcttgaataatgcccacggtgccagcaagcccaagattgcatctatcaagggtgagagatctgagactgcattggggattcgaaagcaatgccctaatagcatcacattcctgcgccgtatacagcataatttagtcgaccaagtttaccagaatatgtataagtgtatcaaggcattcgagaataggaaggaaacctctagggtaaaagaattgcctccaaggttcaagtcaacgatattaatttgagaaagatttgtacagagttgcgagaaatcaggagttgtaagcccacagtttgataaatccaatctcagcaattcttgtgatgcacaagagagtgcctcagtaagcttagttgcccctccctacaaaaaaaaaaatcttcacagataagaagaatgttatttgtataatctgaaaatactaaccatgcgtgggaagcagggctgtgtacatccattgtggatgtagaggccggattttaatccattttctaaaaaaaatgcgtgggaagcagactcactgatccaatgtaagttccacctagcagaaatcctgataagcatgaggattgtgcaagtacacacagcttatcaaccattaacttactcagttttataccagtcaggcttagttctgaaaacctgcagtgatgagatatatggctcatccattatttcactgcacatctattcctaataggtatcaacaatgattgaacaaatgtttgcgaaccttttcagagaggcaagtttggagagaaggctaagcattgtatttccagaaattggattgttgtttcctgtcaaaaatatgaaagtttgaaacataagaatgctgtacatgaaacatatctgatagtttttaactatgcagagcaggagtaataaaagtacctaaggagagatgtgaaagggcagacccttcatgcagtgcatctgccatcttctgaactgttcttgatgtgatagaacattgctcgacattcaagctgtacagtgctgttacgatatgtaaacagagcacacattctataagaggaaattaaaggttggtgccattaaagaaaaatatggctggcaaaaacacagaaaatgccataaacagtacctacctttgcacttctgtaggattgtgaaaaggtaagaaccgcatgcatctgtgaggcgattcccagacagattaagtacttccaatcgattagtcataacagcgcactcacatatctgtatcagtaaataaggagtaaatgatttcagaattctgttcctaaaatgaacgtgtgcctgaaagcaagacagcttattttggtccgataggcaacgatagaataatttgttctggtaaagggtcaaccctcgagtttcatcagagtatggaattagaaccatccaaatggtttcagttagttttaacaggatcattgagatttgcgactaagagggacatccaatctcaatgcagaaaatcaaccagcacttgttatagcacattcccgttgagtctaaactctaaagtaagtaatagagtatagcttctagtgatctaaatttctcacacagtaagactaaagagagatatcacaagttaaattggttttcggctgaaattcttccaggaacactagtagacgtaaggactgcgtgtcgttcgggcctttctcggccttgttaaaagcattatgggacatctctccccaagagtcaagttttcctttttattgtagaagaggatccagtccattttaatgttcaatttttttgagctttcaaaagcagaaataacttgtagtttcactttgataaacaagtttagggatagtaaaaagacctgaaataaagcagttggaccaaatcgattacaatgtaaatccagtgtcaagccaccatatgtttggcttgatgaagaaaatatttgttgaagcctctcaattgtttggtttcctgcagttcgtgaacataaactttagtcattgtaaaagcatagaggaattaatatggtacacacacatttagcttgaactggctttctgcgatgccaccaaatcattggtgcgtagattacataagataagacaaa

SEQ ID NO: 40588 - DNA, 1578 bp, Oryza sativa
ttagtggaatgaatgaataaaaaaaaaggacaattgaattgatttccttcgcattagcaaggagttatttagaaggctcctaccgaatattggtaggctggaagctttttaaaaatccagtcttattttttaaaaataaatcctattgtgaataattcagtcattcctattaaaaatattcatagatggatataataacaacttccacaaaactaattccagtgacacatacctgcttaaaaaatccatagaccaacgcaacggtccacaaagtacttccaagaaaattacgtatcccttgtgtgagaaattcattccacacaaaagttgactcatatatgttccagccttcctgtggatcactcaagttcttttgaaggcttctcatgatatggtatgagtaactgaaaaagaagtcctttctaagatcaagtgtattcagtatcttcttgtacctgcagcatttcataaacaatcagcttctaatttaagaaatgcaatagttaaccggaaatgaaaaactaggaacagttttcccataatatattatttggtccataaaaacaatatctaatatcataatcagagtgcttttcatggggttgggtgtcgaaccgaagaaattcccatcgaaatgtgaactttggaactagttgatgaaatggatcttcatgtactgattataaagttttttatgcataaggacagaaaagagaaaaaaactcaaggcttgcagctggaacaaacctgttctcatccttggaatttagaaatctggatcgcgtcttagaattcgctaactcgaccatcgaagtcttaatcacctggtatactggatgatcaaatatctccccaatttttcgctgctcggtaataattaacatgtaaaatggtccaacaaactttatgaaacctgcgaagatatttcatcatcaagtgcattgtaatacaattaaattttgctagggtataaacaaaggaggaggggttggactacttaccgattatgccataaaattttgtaacaaactttacaccaccagtcaacctgtggtcttcatcaagattttttaacagttcatgatattcactttgagtatacacagtacaacactcatgtaagtcaaggtccgatggctccgatctattaatcttcagtaatctccaatgtgttttgccagtgttagttccaaaaatataaaacctctgcaaagcaaaatacttggttaagaattgtgaccagaagcacaagttactgaacaaggaaattaatgaaatctctggatccaagaacgttgagcacctaagctgcaagcatactgaccaacagagtgattgtgtacacaggtgaaatacttaaaaagagatattgacaatattttcaccgaacacccagaacatatgaggccaagtctctacacaggaacgtgattgccaattgtgctaatacgttttgtcaccaatttcatatgccaacaatctaccatagcagagtttctagcgatcagatcatagcaaaattccaaacacaagaaaagcatgcagactgcagagacagtcagcccttctgagataaaa

SEQ ID NO: 40589 - DNA, 2678 bp, Oryza sativa
gcaggcggcctcctgctccaccgccaccgcagcagccatggacgggggtgatccgggcggatcacccgctcaaatcaaccgccccaatcccccccctccgccaccaccgcggagaccgtatcaccgcccctccgtcacagccgccgccgccgccgccggccggaaccctaaatcccgtgccggaagcttgaggtagagcattccccgccaatcaccgcagcatcagccgacgccggtggcggcggagaacggcacggggctcgaatcgcgagccgtggaagcttctaggaggagatccgcgggagaagcgtgggtgggaaggaggaggaggaggaggcggtggcgacgaggaggagaattcgcctcgcggaggaggaggagagaagaagaaatccgtgagttggcggaggaggagggcaacaagatacaggttgttacgggaaatattttgctctccgtttaaatttagctttttgagtccgtttccctgtggagacggtaaactggataagcacgcacagggctgatttgtctccgtatcatctccgtgttgtactgtcgtaccgtgcagagaactgatgcaaaatagtgaaatactcatccctccgtttcacaatataaatcattctaacatttcccatattcatattaatagtaataaatctagactgtctagatttattacattgtgaaacggagtgagtagtatgctattgcgagcaatttttttcttggccggagtagtttttatataaagcttgcgagtagtttctatacaaagtttgcgggatactagtagaaatgtatagaatgtaaataaaaaaaagatttggaatgctagacatccctctaaacatttttaataagaaagtgtgaaagtgtggagattgaacacgacatttccaaattgaaatcacacggccatcactgcactatcaaataacctaacattatttgtgcttctcatttattgccaattcaccgtgtgagatgagtagtccttctctaactattctcagtggtttgtttacataggcttggtcgcgaaaaaggagagagaggggttgggaaaaaaagtgtcgaacaaaggtgataagaaattttaaatgtatgaatatcactgccgtttcggacatatgaaaatcccgttttggacatatgtaaatcatactgatcccatgaaggaataaaatttatctgatcatacatggtaagtttaataatggatacagtctgtgattttttttactttttgaaatttttaattttaaaaataaacactttcaaaaattatttctaaaatctgaaagttttgaggcaaaataatgttaccacgccagtctattattacagcgttgtcttgttgtcacgccacctaggttagcgacgtagtcaaaagatttagattttgaaaacaagtgttggaaaggttcgtttctaaaattataaatggttaaaaaaatatttaaaatatgctgtttgtatacatgacaacactctaataacaatagattagattcaaaccgctcttccaactgtcaaggtataaaaacacaacaaactaagcacaccatcaagatcccagcgacgtcatccaagaacaaagaaaacgcacagcttattgcgatcgagacgctaacctacttccttccataggaaggagcatctggttcgcggaatcgaagctgtggtcgcaggttttgcagctggttcgcgcacgacgtcaacgcatacgcggggtggatttggcgcgagccaccagagaggagagagagaggccgggcgattgaccgggtggacgtggagggatccagttggacgagtgcctcgggctcggggtttgcgtgcgtggtgcgggcgcctcaatgattggaggcaggcgctacgttgcgttggtgcgatgcaccgaaaactttggagctttttttcttgggtccacatcctacacgagagccacacacggtgggcgccaattgtatttgtccctagatcaaagaatctatagctatatatgagtatattttttctaggactttatctgcatatatacagtgatgagtttataaagactcgtaccataatttggggtttaattatagcaaagggcttagggtgtgtctagttcacgctaaaattgaaagtttggttgaaattggaacgatgtgacagaaaagttagaagtttgtgtgtgtatgaaagttttgatgtgatggaaaagttggaagtttgaagaaaaaatttgaaactaaacaagggcttattccaaatgtaggataggaagacacaagaacattatatagttacatgagcaaaatataatagcgtccatcctatgccagccaacggggtcggagtagctgttttgagtcccgcgaaattcctattttcacataattgctacagtattccttcgaaattcctacactcgattcatgcgaaccaaaatacataaacagttaaaaaaacaaaggaattgccagctctacgaaaatcctatgaaccaaatgagttctaaatagaaagagcgattattatatgagctagttgttgcattggctatactccaatatatgacaaatttatagtaatagaatgtatcacatctaatactatatttgtttatttaaaaacagatggagtatatatgttaggtgacatatactgctatggggcgcagg

SEQ ID NO: 40590 - DNA, 12516 bp, Oryza sativa
  unsure (1)..(12516): unsure at all n locations
cgttgcttaatgagctcgatcaataggccgtgatctctctttttgtgaccatgtgctacctacacggcatttgcttagcttaatgtgctcatcttcgactgcattaattaataattaagcaatcggttttgatggtgatctacctatagcgacaacgacgacaacagagagagttgacgacgacaaaagagcacccataatagttatctataggctatctataagagatccatatcagcatattatctaacttggaagagattaaatgaagagagaacaaagctatctactaacctagagatagtctatagagaaaaacgagacaatgaattagagagctataaatacacatgtagacacattattgaggtggtttactattaatctagtctattactgagatatacatattttatagagagcatcttactttaccattgtagatgctctctaagggaggttcactgtaatttgatcgagtctagcttgcacgagtacgcgaaaacaaagtgatttaatacaccactgatgattcacatgcgatataaaacacacgaacgaagaacaggtagacgacaaagacgatgtgcatgcagaaacgccgtacacgtacaacaacagtgccgatgatgtcgtacatatgtgatcgatgtgatgtgccatgtgtgtccagggcaatcgagagatattccacacaaatataattccattgtccagacggctcacctaattaattaagcacactattaagtacaggaaaaattacaaaaaccacctcataagtcgcttgaagtttaaaattccaccaataagttaattattttgttacaaatgtttatccatatatttagttttgttgcaaaaatcatcccaacatacacatgcttaaccgaatcaatatcttttaataaatgctccctccgtactcgtaaaggaagtcgttttggacagcgatacggtctccaaaacataattttgacttcttgtttctataaaaatatttattgaaaagtgatatatgtatacttttatgaaagtattttttaagagaaatctatttatataatttttacatttttcaaactcaacaacttgagaattatttatgatttatattcttaaggtttgacttaaatattgtcctaaacgacttcctttacgaatagggaggaagtacttccagagtcttgatactttttttttgagatttcacaaataaaattgctgacaataacttaaatgttttttttttgcaattttagggttgtttttgcaattctcaaacttcaagtgaattatagggttgtttttgcaattttcccttaagtataactacgtatgcatacagagtacagatacacaggctattattagcacgtgagagttgatgtccacgtcatggatgtcgtaaatcgatctgtttcgtcgtcacacaccttgcagtagaatcgatcgatgtcgacattatgatgtgatataattaatcgacacctgttcattttagtaaaatttgtttttattgcatgaatcccattcaaacgggaagggagctagctagctggcaatccaatatttgcatgcttccaaattcatatgtggaagtaaattttcatttcaatcaaacgtgaccgagagtataattaagtgtttctttgctgaactacgttggaacaagtccatagaaaaaaatgatatgatatgaaaaacatgcatataatcaatttttctcttctgttgtttattgttctggtaaattttgctctagatcatttgtggtttgttggttctaaactatcgagggaatatccattcgttgtttgcatgttatctaaatggttatgaaaaaaattcaacgagatcgattaatatgcgatattaaacatgtgtgagtgatgcacatttgaggctaacctcctccattgtaggtatcatgtatcacacaagttagttattcacattattgatatgacagcagataattgatttgcataagattcaattgcacaatgagtacatttaaatagtactatgggtttttctgttcttcaacatattgctatagatatgcattgacatcgagagcctatggaaaatatttctatagatattcatttgtactgctgactataacaggcagtactatttccatgtggatgtttcataaccacaaaattaaatatcatttcctgattgattcgtacaactgtgcattcaccgcgaatagtgcacacagcttatcgttctcatacgaaagactattcatatatataagaataaacaacaaaataattgaagaatgcttatatggttaacaatatgcaacggccggtttcacataaaaatatcgagagagagatcagagagctatcacatacatagacgttgtttgacatcctgatgcattttaaataattactccttctgtttttaatcaataactatcaattttaattaagtcattttttaaagtgcttgtcactacactttcattagtaagattctaactttgcctctaccgaacccccacatagttctattttggatcattccttttctcgagaccccctttaatttactagttttcttaattctatttcctaacaatttttagttaaattttaaataattagattggtcaaaaaattttaactaaaattttgccgtgttatacatgccaaatatttttaatagcgtgtttgttttgtgttacaaatgctattatatatgcacggtgtttgcacgctctagacgtgctgatccaaaatatcaacagaaaactagcgagctcttgtcaaatccatctttcctcattcgcaacgacaacacaaagcataatcgttaatctggtatatatacaggacatacgtgcagtggctatcacatgaattatattcgagatagagccatacacctgccgtctaaggctgtgtttagttgggaaaatattttagatttggttgtcacatcgaaggtttgaccggacgtcgggaggggtttttggacacgaataaaaaaactaattttatggcgagcatggaaaccgcgagacgaatctattaaacctaattaagtcgtcattagcacatgtgggttactgtagcacttatggctaatcatggactaattagactcaaaagattcgtctcgtgatttccatcctaactgtgcaattactttttattttaatcaatatttaatactccatgcatgtgttgaaatatttggtgtgatatttttgcgaaaaatttttgggaactaaacaaggcctaatttgcagggcgcatgacagcgaacaacagagataataaatgagaaaagggggggcgaattgaagagactcgatgcatggcttgtagagaaaccgctgtgagagggaagatatatgcttactctggctcccattggatggtctaatcagtcaaagaaaaagccaaattttaaattttcatgcttaattttgagatattttaaacgtaatttcttttttaacattgacttttaaatcaccaagaacacatttataaaagttttacctacaaatttatttttatttcctaatacggtttattaggaaatatgccaaacgatggggaccttgctctctgacatcttcgagagggagggtgcctacagcggaggcaaccaataatcaatcgatgcatgtttgtatcgccctcagacagtgaagattacgaccagattcaagctgagttgattactgttaattgattaccgtttatgcatgccattagcttcagccgtcgataggatgatcaatgatgataggataattaacatcaatagtgatatcaataatccacccagcaaaactaattaactggtcactgcatgtacgcataacctaatcgttggactggatcaaggtcggcgcaggggattaattggagaccatctcacttggaaatcagaataaaactgtttgaatcgccggagcttgtgtacctaataaataggtcgggctctcgtgtcatcgatcaaaagggaccacatcattgacgacggagaaaattgaagaatgtctagctttatagctaggagtattggtgttcagagcagattggatcgattaatctccattatggtaaaacagctgctttaattaatttgctaggctgatcatagcactccaaattaaatcaagcaagtacggtagtagtacagctcatgctcaaagctccaaagaacaacttttgcgaataagttagccgcgccttttcttatttttcttcgccctcgcccgcacgcagctcgccgcgtcgctgtcgtcgtcggcgctagctgggcttacctcgcccacgcgacccttcgcgcgagacctcatcgatcgccggtgggccggccggtcgcctgccgcggccggcatgcaacaggctcgtcactgacgctgacctcactgagtcactgacactctgatggcggccggctccggtcagtggtgtgatgcagtactgcgaacagatcagaaatcagctgtagctgctgtagcctgtagcaagcagcgtgcagtggcactgtggcagaagcgactgaccgatcgggcatgcgttcatttcgcagctgactcggccgtcccggattacactttttcctgtgtgggaaactaggagtgacgatttttatgacgaatccaacaggaaaagtatgttacaagtggagagactggcagagaaattcagagttcagatttagatcagctggccaagaaaattaacgctcttatcatctacttatcaactgcagccaaatttagaattatagttaaatttaatttttagagttcattttagtgtttcttatcttacgctagtttccaacgttatttttaaaaccacaatcgacatagattttctaaaagttatatttacaaattgtttcccttcattcatttttaagctgtagctcaaacgagagaaaatttcttctataatgattaaggccccgttattttccacccattagctaatatattacgaacatgttttccaagccactaaacaacatgattcttttagaagaactttccatgtaaaaattacttaaaaatttaaacaaatctatttttaaaatttatgatatcaatacttgattgattatgtgttaattgaatttcttctctggcaagtaggccaaacctttcaaacgaacagagctgcatgtttctctgcatctgcatgtcctgttttcctgattccagaccacacgggcttgctctgtgtttggtaggtcgttgggagctgagttttgctgacaaaatgctacttacatcgttctcatccgatcaagtgcgtgccttgcaagttgcaacaaagcttattactagatccaaccatttcgctgccagcacnnnnnnnnnnnnnnnnnnnnnnnnnnnnnnnngactcgccgacgtgacgcgtcccggagcggattccaaaggcttaattttttttgctaggcaaaaaggcagcagcgaaagcaacagacaaattcagctaagaaaggccagcgctagctgcttattcctagcatttcgcacattcatattaatgttaatggatctagatatatatatactatgtaagtcattttagcatatatatgtctagaatgacatcaatataaatatggaaaatgttagaataacttgtattgtgaaacggatgaagttattagcttcccctggacgagggctctttggcatgttacgattaagctgatcggcatcatcatcaagacggcgacgcccgtaaaccggggaattattggctccccaatggcgatgcctgggacgatgtgggccaagaaaacggccagtggcacggcgcgatttgcaagtaaagatcgatcgcgatggacgtcgttttgttaatttgttcccttctggcccagctgatcaatcgatcgatcgatcgattgcaggaagagtagtggcattcaagttttgatggtttttttctgcactgcatggagggtttgattggaagaggttagctactagtaggacggtagcgatgggtctattctgaatttttgattgatcgatcggcgtcgtcgctgttgggtagtcacggttcagaaactggtacagattcctatttcctggtcctgtgtatttaaagagtagacgcttcttgtctgcactcatatatgcagacatactcctacaccgcacaatgcatggattcatcgttcatctgccaagtaagggccccttagaatcgcatgaataaaaaaatggaggaatagaaaaaacacagaattctgacaaaaatgtaggtgtaaaacataggattggaaaatacaggaaaaacatatgaatgaccatttgattagaccacaggaaaaacgcaggaatcaggtgagatagatagactcaaaggaatttttccaagaggttagacctcttgctaactttcctctaaaatatctataggattacacatttccaaggtgggtgagagagcggaggagaagcgcgagaacgcacgttgaggccgatgcccttgatgtgggtctgggtcgcgatccactgcttcttcctcctcgatcctcatcgccgctgccgccgccgccgccgctgcgaggacgttcagcagctaggacggtcgtgcacgcggcggtgacatgaaaagtagagaaagtgatacaaagtagaacaatttacaattacaatagtatattttagaaggcgcgcggattaggtggtaaagatataaaggcatgtgtagtggagggtgacgctatcgaggcggttccgtgattgagtttccgaacccctcgaacacaatatttaccgttggatacacatacgacggcgcagatggggaagagcgaaagtagcaaattatgactgcgatcctagtgaacacaatcacgtaggatcatgttcggcgcagcgatcatgtcgtgttttatcgtactgtagcgctgcgactgcagcagctatttgaggattaataactgatggaatagacctgatggaattcacagatcacacaatgaagggcccgtttagttttgataccaacttattgccttattgtcttaccaatttttttaatagtagcaaatgcatgtttggttagtagtaaatacatgtttggtttgctacttttgtcacaataattcaaattcaatactacctaatttggtagtgctaaaactcgctaagattttaacacaaaaattggattcaaaccaacaagccggaaaattcatcaccttcgccgtcatctccgcctcccagtcgactgttgcgccctgttgaaaggacgactttggtttttgttctccccaaacagggagtcggacaataattcaccgaaccccacgaacgcaatgacttcccgcgagccctccttcccctctgggagcgcaccgagtcgtgcataatatcgtatgtacatgatccaccctttgcttgctttcgctcggcgcgttcaccggacaaccttttcatggcgccgccgccgagctccgttgatggtggccgccccacatactagtggagacgatgtggcaatgcagtactagcaggattgaggaaacgaagaattgtagctgtaggattcatataagacagagatcataacataatgcatcgatttggaatcgttcacgaacgagatttgacataatttgcttgatcctacacaaaagaacagctacttccgtagtcttcatcttcacggtcacaccagcgtttatacatagcagatcagcgacaacttgtactaccgaaacacgaacagagcacaaacacattctactgctccaaccattctcggcaaccatttccagcttctactaccgccacgctgccattacccgagcactacgctatgattcaggcgatggtgacctggacggacttggtcttcttctccggcggcggccgcttcttgacggtgaccgtgagcaccccgttctcgcatcgcgccgagatgccgccggtgtccgcgtcctccgggaggcggaacttgcgcgcgaacgccctcggcgacgcgcggcgctcgaggcggatgtacttgcactccccttcctcctcctcccgcttccgcttcccgttcccggcgccattgctgctcttcatcaccagcaccctgtcctcctccagcgtcacctgcgcagacaagaaagaatcgcgcccaaactaactcgctgattcgaacgcgaatcgaggaaattcagggctcggattttgtacgcacctggatgtcggacttggagaggccagggacgtcgagcacgaacgcgtactcgccgggggtctccatgatgtccactggcgcgccaccaccgattccactgatgcggtgctggccgtgtccatgcgcggcgtggtgcgcgtggtcgcccgccgagcggcggtccccggcggcggcgccgaggcggtcgagcacctccggcaggtggaggaggctggtcacggcggtgtcgaacagctccgtcatggctaccaacttgggctttgctctctcgctctccttcttgctactgcagcaatggcgagacggcggtggaggagaggaatgggtataaagcgagcggaagcgaaggttcgagatggcgcggagttcgctgcgctgtcgcgcgtcgagaaagatcaggagacacttggaagaacctcgtacccacttgtacattgggccgaacaaagcccaaatctcccatcacagcagctgttttggaccgcagtctaggccttggcctggttggagagttaatccgcagacaccgagcccatcaaatctgttgctgacactggtggcctcgtgcatggaatataaagtccacttatggcctctcaactttacttcaagtttaactaacatcccttattcccagtacaggaaacttagcccatcaactatacgaaaccgtacaatttgataactcgtggaggtggaggagttagttgcagggagagcgctacgcgtcggacgtacggcacgagacgaaaaatcggtgcattcatgagccgtccgatccacgcgcatgccatcagacatccaacatcacgaagcatgcatgcatgaaaaatattttaaactactttttctcttaaattatttatccaagtcatgatccgattacaccattaaattcgccattaaattcgttgcagttaaatttttaaaaaggaaccacacatggatatattccagtgaaaaaaagcttattattgaattatttttaaatgttgcacattgttccaccaagtatatcggaattgtttcactaggtagatcgaaaatgtttcaattgtttaaatcggacgttgtttcgccttatataaaaacaatgtttcagcaaatagcgaaagaatgtttcaagtcactgcaacatttgatcgatataaagtgaaaatttttttgtggaacaaaaaatgaaacgaattctcttaatagatgatttacataatatgtgggtgatttgttgcaaaagatttttttcaattcactgcaacattaaatctatacataaacattgtgagtacactaggcgaaacatttttagtggaacattgtgagtacactagtggatacttattgaaacactcgaccaacatatgtgcaacatttacaaataaaccagtgaaacacaataaactacttactgaaacatacaaatagcactatgagatacattaaagaaagatatatacatcgcgacaataaataaatatgtgcaacataatagaatttcaattgaaacatctaattttcatatgtgaaacattaattttaattggttgaaacatatgtgtttttttatttaatataatcatgtgagatcttgttataaagatttaattgtaacgaatacaatggtgtaatggttcgtagattggatgagtaatttagaagaaaaatcgttttcaagtttgctaaaagtgtgttatgtacatgcaagtaacctcgtgtcatctctctttcatgcatattaatacccaaaaaggaagcatatgtaacagagagagatgatctgacaaaggctgcatgcagtaaaatcacagtaagaggcgtccgatttctttgtcaagatcggacgaccggattgaagcattttcctagttgtagctgtcgtctgggaggcccagttccataatctctcagcggactacctccccacctccgccttcctcccccacagcgtgcacacttcgctcttcagctctcctggtattgagagtaagggatgttaatcaaactcgatgtaaagttgaggtagaaagtggacttatttccctcgtgcatcgccggcaacctaagggcctacttagatcgtttggcaaaatttttcagcatgtcacatcaaatgtttggacacatgcatgtagtattaaatataaacgaaaaaaataattacgtgtaaattgcgagatgaatcttttaagcctaattgctttatgatttgacaatataatgctacagtaaacatttgctaatgatatattaattagacttaataaatccgtatcgcattttacagcaggaatttataatttttttattactagtctatatttaataatttgaatgtgtgtctctaaatcctatgtgacccatggaaactttacatatgcatctacgcttcggcctcggcacacggcccacgtcgtgtcgtcaccatcgtcacttcgctttatcgggacaaagggagcggctgcccatggcccacggtgcacccgttccacgtgagcgcgcgcgcgtaccgaactttgtgggccaaacccgccgcacagccagaaagatgccgcagccgccgcatgccgtccacgcgcgccacgtttcgcggcgtccaccgtgagccaggttcaacgcaccagggcggaggagagtgacgtggcagtggtcgtaatttcacctgatcttcgtggcctatctctcgcaggaggtggcgcgtggttgacgcggtcagaaaagcgcgcgcggccgccctcgaggcgccagctgggcacccgcgcctgaaacttctggatggtcgcccccggaaatatctccgtcctcccaaccacatctcagccgtcaaccacccatcggacggatggtaaaaaaaaaagaaaaatgatccggttagatgtggggtggtgggccccacatgtcactggaaaggtcttgcactgttctagacacatcacacatctgcttcgaggcgaccgttgcgttttttttcctgatgctccagtggaaaaaagagcggccttgaagagcaagtttaacagcgtagccaactactggctctaatttatctatagctaatctaatagtttatttatacaatagttacatactacattattaatacatagttccatatattatacacacactgtgtcttggagtctgtgctacagttggctacaaatctgtagctcgctgcccttctctctctttatttatcttcttaaaatatgtttgcagctggcttatagcctgctattatgtgtcttcaggcgtgtaatcataaccaaactaattaaccgctagtgagcgtctaatggagtagcatcaccagctaaacgtatttcagaattgtggatcagatcaactttttgtctaagaatctttagttgctccggctttcgcaagtgtaaaaggcactcgcaattggtaacacacgccatagccacactgaaaaggacaagcatattagcagttgcccctacctttcaaacgattctttcgcctgattaacatctttttcgtccaggttgaaagttgataatcacaatcaattaggcccctttgcaatgcatggttgtctgaaaattcaaatacagtaaaagtgcaaaacagaagatgcagctagtaatttccccacatagcagaaaccacataaaaccgatcaattaggtatcaggtcacaattaaccatccggataagctcatcaggagtgcatctactaccatcttctcgaatgatgtgaaaaaaatggcaaattgtcaaggttaaccgtaaatctacagtgccaatttctgacggcacatcctacgagcctcatagattattcatattctctaataaacaaaaagatttgtgagagaataaaaataaatttatagataaaatgtttatatatttgttcgtagcgatttaaaagtcaatgttaaaaataaattacgttaaaaatatcttaaaattaactttaaaatttaaatttagattttaattttgatttattagccaaccgacgagactctacggctctgtgcgcaacagtagcagtgtctggaagcagggatagctagctgcagctgtagcaaaagcaacgatggccagccaaggctgggcgagacgtggaaataaagcgaggaaattcctaggcagaaatatttaaaaggcaagtgggcatcatggccttgtttctggaggcttcctggactgcgtggagacgagcgacctgagagagagagagagagaaggcaagggaaggaggagaagaagggggacgaagcggacgaagcgcgcgcgcgccatctttgctttgctttctctctcttccctctcctc

SEQ ID NO: 40591 - DNA, 8351 bp, Oryza sativa
tcacacatggtcgcacacagctgcgtgaccgatgaggccgttccctcgaaaacccgtgcgttgcgctctttccaaatcaaccatgtaacgaggatgaccccggcgtcgaacgtcttgcgatcgatcttcgcaacagtttgccgggcagcgagccaccaaccggcaaagtctgaggacggcggcgagcaggagaggctcaaacgagcctgaaccttcacccaaacttgctgcgagaaggtgcaggcttggaagatgtgttggcaggactctccatccttagaacaaaggtgacaaattggtgcgagcttccaacctcggcgctgcaggttatcagctgttaaacaggcattgcggaccgcaaggaacatgaagaacttgcatctcactggcgcgcgggatttccagataatcttgccgagcgggcaggatgttctaccggccgaaaggatagagtaggcagactgcaccgagaagtcgccattaggtgccgccttccagatcatagagtcagtacttccggggtcgagagaaatcccggcgatcacgtcccagagcgcaaggtattcccccatcgcttggacagacaggccgcccctaatatctgcaatccaggagttgtcgcagagagcggcagccaccgtgatgtcactcagcttgacgaaggagaaaagaattgggaatctgtactgcactgatcctccgtctggcaaccagctgtcgcaccaaaacgaggtagaggctccgttccccagcagtactttgctaccagcggcaaagcagtgcagtgactttctgtcagctagaggcgcaacgcgcatccaaggacgctctggctcagcgcggcgcagccaaatccaccgagtgcgaagcgcaattcccattaggcataggtttctgatccctagtcccccctgctcgatagagaggcaaagcttctcccaagccaccaagctgcaagagcccgcagcatcttcatcacccttccaaaggaaaccccggcatttcttctcaatttcgttgatcgcccaagctggtagttccaagacggacatgaagtagagtgggagcgatggcgccaagttcatgtttttgcatatcagaacttgctcgttagctgcgcgtgattaggcttctgttctgtacttcgtaatctagtattagccaatgattaaaagctccaatccagcctgttcatactctattattagtcatttttttgtgcttgtgtgtgtaattttcgtagccgtctaggattgttggaatatttatttatgaagacctaagtgttcaaatctgttgctctgctcgaatggtccaattctgattgtactgcactttgtgaaaagttccaaaatttaacattacctgatctgcaacttgatgtagagatggcatccggacaaatgctcatcctccagcagtgcaaagcacatggaggaagccaaggagaagttccaggagatccagggcgcctattccggtcttaatcttccttatctcaaactccaccctgttctgtaatcacttcacttgttacaacgattatgctacagataatgaactgatcacaaccaaagaaaacggatttagctagttggcaaacttattgcatggagccctcgtgctcccatcccattgttcttgtgcagtcctctcagactcaaacaagcggttcctctacgacgtgggggtatatgatgatgacgacaatgacgatgacaacgtaaggattctagccatgattatgatttattgtcattgttggttcaactttaactcctactgcctctgctgcagctgcaggggatgggggacttcattggtgagatggcccagatgatgagccaggcacggccaacggtaagaacagttagcaccttggtcctagtactagatgcttctcgtaggctctagctgagaggtggtactggtacatcaggaccacaaatttagctgcaaccgtgattggctaattagatccccttttgtgttgtcataatgcgtgataggttccagctagcatttattactttctatgttcttttgactaatcgtattatcatatttcgtttcgaaaattctatcgctgtattttgtaagcaccatcatacctgttctgttctgtcctttgcaaaagtacgctaaaatggttgaaaattaacttactgcttttggtctgagaaaacaagtatacacatggtaaattattgtggtttgtggttctagaactctcgtcatgatacctctggttctcagcgatgattttgctacagtttattgggaattctatgctatttggggttgcatgtcatttgtcatgcatacaatcatttcttgttcattggaataacaaaagaaaatgctcatatatgaatgctaagttatcagaacttctccaggctgtttatctgaaaaaacttgtaaactttggaaatttttgtatagtttatactggatattgtttgttctatgttcatatgtcacaggcttaaaaaaggaactgttatgaaaagctccatgcccctcaactgaaacttttaggtgattttttctagaaccaagctggaaaccggcctctttttctcctggacctgatgcatccaagataaatataacaatagcaataaaataacaatgaatcattggatttgcagaggcaggagagctttaaagaactgcagcagctattcgtagacatgttccaagctgatcttgattcgggtttctgcaatggaccctcaaagtgctaccatacccaggcccaaagccagactcgaacatcctcaacctccccttcgatgtcaccgtctccaccgcctccagtagctactgaggcagaatcgccatcatgtaatggtattaataagcgtggttcatcagcaatggactctgggaagcctccaagagccagcgaagtcggttctggacagagtcaatcagggttttgtttcggggtaagtacgcatatgtcaatttctgtttacttgtttggtttggcaataatgcatctaggtaggcgctgctgtgattacttaattactgtggtctgattaagcagacactgttgcttattgttgatggtgatcaccaaacaatttgtgactggatcatgtgataccttttttggggtgcaagtaacagtttatgctatttggtggaggtgtgctttcttcatcaaagaatacaagttgcagctagattagcttgagaagcacgatttctcttgaaaggaatgtgctgataatgtgaaatcaacttgacctgccgttgatcactgaacatgtttttttttttttttttaaaaagtgcttaacggccaggtggtttattattattattttctgagggaaggggtttatgaattttgcttaataagtttaggcatcagataccatacttgtactctggaatagattcctttggctagctttgctctttttcactgtattgggcaatacactgtttacatttattcaacatatttattcattattccaataaagatttgctttttggtagagcattgtggggtcctggttgtctggacccactagatgtttgggcatatgccatatggggccattcactgggatgttgcacataagccttttgcggccttttcatttgtaataatcatgaaataatccagaaagttgtggaggatccaccaagtgagtacggatcctagctccaccaccagatgtgctattcacatgaggacttgctgatcaactatgagatttctggatagggtcatttgaatttccatcactgttacatcgttgttgtgtggtccgtatatggaacagtctagtgtgctaccttcttctggtatatattaaaattgattgcgataggatttttgtatatgcctggtacggcatttcttggtggtgttctatgtcatttaaggatatcacaaggtttggacgagattatggcttgtctagcatcttaaatagagcccatgcgtcattttctgcttttctgtatgtcctttcttggattgctacgttgccttgtgcctttgctgacttgttcaatttgctattttatttttgtaacacgccttttttgtgcagcactcctggtccaaccttaaatctccaaccagataaatgcttatgataaggccgtgtatttgctatttccttttaagattatctgaaaattcagactggtggtgccagttgcgcatgctcgcaccaaacttgctgtgcttctggttacttggatgtctttgataatttagtgcccacgaggaacaaaaagttccgttgtcggattcttccactttatgctctttctatagttcgcctggttcttctgtagcgatccatttgagccacacttttgatacggtactgatcattttggctggtgcctttctgcagcagaagagtgatgctaaacaagcggcgaagacgcgaagcgggaacacggccagccggaggaggaacggccggaagcagaaggtgtcgtcgaagcacgacgtctcgtctgaggacgagatgccaggttcgcagtggcacggcgtggcctgaccttttgttcgtgactggtttggtcctttgatgtgccggagcaccgagctgctgccgctgccactctgccgtggcggtggcgctgctcggagtgagtgaccgggcgtgccaaaactcgtcgatgctgctgctactgcgcaattctttctctccatccgtgtcgcggctgtgttgtactacgtagacattgcattttacaattgattctcagtacctatctgtcttgctgttcaatttcaagaactgaagaagtcatgttggggaaatcaatgattgacgaagcttctatgataaacagaacaataggggtggggtgatcacggttctaagagttgaaaagggatgcaatggtatacataactgccaatctatagaagttttccattttatatttacacattagaacattggacgtataacagtatatttagatatgcatactgaattaatacaattctttaaacaatctatacaatagcacaaatagtatgctgccctatctatacaatagcacaaataatggtctaaacagagtcttcaatgagctaaggtcctttttatttaggctttttaagccatatttaaaaaagcttaagtccaaataaaccatcactctttttgtttgacttttttaaaaccacaggtcacccttacactgttaaagctaaaaactaagtttgagtagctttttttaaaatgtaaagttaagatatattccaccaataaacttaaagcttaaaaggcacatgtagccaagaagtctaagctcaaacgaaaatggttggagaagattgagaagatacgcaaaatgaggtgagccattagcgcatgattaattaagtataaagtattttaaactttaaaaatagattaatatgattttttaaaacaactttcgtatataatttttttaaaaaatataccgtttaatatttcgagaagcgtgcacgcggaaaacaaaacaaactttctcacaatctccttgggagttaaggccgtgttctttcgaagggtttagaaacactttcagttatgtaaagtgatatattagctcatgattaattaaatagtagataaaaactaaattaataaattaatataatttttaaaacaatatttttacagaatagtttataaaaatattatttaatagcttaggaaatgtgagtgtgaaaaacatgagagtataaggtgtgaaacatgataaaaaaaaacacgaacaaccgtgctccgtgctcactgctccctccctcttgataaggcccatgaaaaagtatctggcccatcaatccatcacgctcttacggcccagagagcccaactccacccctcttcttcctccgctccattctcctcccaccctcccctgcgccatcgccgacgcgcgccgcggcgaacccaccggatcatcttctcgcgcgccgccgaattccctcccgcctccgccgaatccaccggcgggcgcccgatccctcatcctcctcctcctctgctcgtgccgcaggcgcgggcggactccctctttctctctcggtaggcaaccctaaccctcttgatttgcccccaattctggtcgttccgtggaattccaccccatccgatccgtcccaggcgcgcttggggccttggattaggccggaaacggatcggttgctgccgtagggttcctggacgttcgtagggattggattttggtttgttgctcatttcggtgtgggagagtggagtggaggccggagggttgagatcggtgtgctactacttgcgggggcagatctgatagggagaatcgggtggatagtggggattttgtaactttctcgtttgatatcaaggattgtggattggcgtttcctgcattcagagtttactcttcatactacgtggttgatggcgctaatcatgtttctaaattgttaaagagttggatgataacgtttaacttccttgttttactgttaaaatctgcatatgttatggcaccgacttaattatccttaattggactttttaccgttaaaatttgctagtatgttttatggtgtgatgatttacttctaggtttgttattggaagactggtgtaatcaatcttataccgattatttacccctcttgctctctgtgcttactcgttggtttattattataaaagacatataaatgtttggtcacccttggagtcatacatactacatagttttagtgatctagcaccttctgtggattcatccattttgttcaaactacttacacatatcattttctgtttcagattggaaggaatagctgcttactgttgaatattgacttgcttttgttgctgtcacaatgtcgggcctgctgaatgtgcgtgcttatccttacaactgattattgtgctttcgcttgatatccctattttccatttcaaactttttacttgatttctctctgactagtttgttcatcaaatagtttgcttatgctgcagcttcgcgtggataacgagcaatagatttgtcttttatcacctgataaagtgataattgtcctctgttataacatagtgttgatttatttatattttatacacacatttatttcttacaactgcggcactgtcctcttccattctttgccatccttacgtgagttttctgtgttgagatgcttcatatgaaatttgaagcctgacacttccatatgagaactgtgatggcagggaatattagcattgattgcctaaataagctatgcatgtacaggcactgcattatcagctactccctccgtcccataatataaggggcttttgtctatgcaaatgcgtagccacaatcccttatattatgggacagagctaatatatctgtggtggataatctgtttggttgggcactatttattcttttatgctgctgcttaacccaacatggtatttgcttttgaagataatggcaattccatatgacctgctttgttctttgttttgacaacttgccattttttcctagcagtcaaacctgaacaattctgcatcaaatcttcaagactcaactggaagaccgtttacagggtccttttctggtcaatctggatcagttccagggggtttccatcactctggtgagcatatagtaaaatagcttggttagtttgttcgcacaatgctacattcatgtagtaaatcttcttgccatttttcaaggtttgcacaacatgcatggaagtttaaatatgccaaatatgcctggatcgttttctcagaggaatgctgccatgagtggccttccatcctctggggttcaacagcctggagggagcatgcctgggagatttgcttcaaacaaccttccagttggcatgtcccaggttgtaatgacttccttcatccatattgcaattttattgtttatgctgacggcttgtggaaactaaggtacattgttgctggttgaaatgatcgtgtaacctcaccatgttactgttttgttgcagatccctcatggtcattcaggagtcggtagtagaggattgaatgttggtggaggtccagcatttagtagtagcctgaatattggtggtaccattcaaggcttatcctcaaacctgggtgctggtggtagtcgtaattctgttcctgggatgtcagtatctccatctttgggaaatttgggtcctaggatcactggttctgtaggaaatattgtgggtggaagtaacattggaaggaatataagctctggtggttatctgtgccaagcatagcctcacgcatgaatttgagtggcaatgttggcagtggcggtctgaatgtccaaggatc

SEQ ID NO: 40592 - DNA, 918 bp, Oryza sativa
aacatatcatttttaaatacttctgtcagtcggtctacactttacaatgtaacctcccatgtgggctaagtttccttgtgatgttgtgctaaacttgtgtctacctgtcgaagctatgtgcctgccagtgagtgatgcatacaacagggttgctgctgcctatgtctttgggtccagatatgtctgcattgtagtgccccaaatagctctgttctgtgaatggccaaaggcattaacagtcagatgagacacggctttgaatacatatataacgacatgcagctgaacatacatgtacggtttggttcatgattgtatagggcgtaacacctttgggccccctaattttgcctaagcccgatggcttattgtggtttgtccattagagaactgctaaacttcgtatctttacttatggtatttgtatgtttatgagggctttccatttgtgatttcacgctgattctgtttaggccttggtaggtttagtttgcacaaggttcaagcttattttcctaaatagttatgctagaaatggatgattctctactatcttcaggccccttcattattgtctctttcatgtgcaaacctcgcagtattgtcatcctgcagtccaccattgcacagatccacgttccattaacggtgcctctgttactattcttacactacagagaatattgtcatcagaaaatttcacccaattgtattgccacctttttagtgagctgttttcagttgttgttgggtggtacttaatctttcattctacatgtatgctctgctatttctttctaccaatggaaatatttcataccaatgaatttgggctacaaagatgatgtaatctttgttaggttctatattttacattctaggcacataaataactaccttatctccccgcttttgccg

SEQ ID NO: 40593 - DNA, 6397 bp, Oryza sativa
tatatttttatttttttctgtttgcatcaattggtgtaggtatggaaggcgcaaaaattaattactctactgaataaatgtccagattttttttcttggtaatcatcagctgggttgaaagttgaaattaacaaacactctatagctagcaacgagacgatctctgaggctccctatttcaatatttgttggctagctagcttgctttcatatacataaatttgtctgccaatgaaatgaaactacagttcgatcaactacttgctgttgtacgtgcaaaagatcgatatatatgtatcacacatcacgtcggtcgatcgagagcgatgtgcatcttgaaaattgattgatccaccatagctagatggacggagcaataatgggtgacaatcataaaggagaaaattccatcgatctatagcacaaacatcttatcagtaccaatatatagaattgagatctagtgcagtcctaactgtgacagcaagttaggaactacacatcatctcagccatccattttttcaatgaacggtctagatctgatgctatagtattgctgctacagtagttatacagtttttttagacgtgaacagtattttgtagattttggaccctcagatttgcatcaaaaggtcctagtgtgactgcttaggttacagtcacactaggtactgcaccggatccaaatcccaatatataaataccataaaattcccccacctttcaaaaaatacgatatgtatcacacatcatgttgatgatctattgattgagagtgatatacatattgaattgaagtgcgatgtaatgtccatgtatcgctccttgtctttctagctgataataaaaattcaggtgggaaaactctttccttcgatgatatattgtaattgattgatcgacggtagctatggactcatggatggatcaatataatgggtcacgataaaacgtgtgcctcgcaacaacggaagtagcatcgaattgctccaacttccatagcttcctcacagactccatagatatgatagcacgtactccctctgtcccataaaaaacgaatctagaatcagatgtaacatattctagtacaataaatctgagcatatgtatatccagattcgtagtactaggatgtatcacatccgatactagattggtttttaagggacggagagagtacatctgtggagtagcaagctaggatgacgtgacggcactcacttgatattactttttcctccgtctgcgactttaggatcggatttatgtatttcaaaccctgttttaacattgtcaatatatattatatgtactaccttcatattttaatatatgacgtcgttgatttttttatttagaccattcatcttatttaaaatttttgtgcaaatataaaaatatttaaatcatgcttaaagaacatttgatgataaatcaagtcataataaaataaataatacttacataattttttcaataagatgaatggttaaacgtatcttattaaaaaagttaataatgtcatgcattagaaaatagagggagtaattaataaagtttacacaaactattggaaacatataaggttgattgttactggatttatcatgactgaagtaacatattttcagactctgtcgattgatgtcgcaattaaactctacttgtatttctttcggttcgagtctgagagagtatgcacctgataattaaactaatgaataagtgcatgaaattatggaattacttgccccaggtggggttttaagtagtatattatagtgacaacatggttgtttaaaacattatcccaatgacaacaaccatggaatgattgagatgagaaatatgattaattttaattagttagcactactgtactagcatagcaaatttgaagggaaaaagtccacttagactcccttaattgttcaccgaatctaattcgtgaatcttaactagaaaaccgggtaagacgactccccgaattagtgaaactagtccaatttgactcctccggcggtattggaggttggttttgctgacgtggcgctgatgtggcggtgctaacccggatttcatgccacgtgacgcttacgtggcattagagttaaaacaaatatctatgggacctatttgtcattcaaccaaaaattattgtgggacccaccggcccacaaagcatcatttctccatcctttcttcctcctccctctctctcccttctctcttttctctccccattctctctctcccttccaaatcggcggcggcggcggccgggggccatggcggcggcgaggttggggtcatcgacggggagaggcgaggacgcggttgagcatgagcccggcgccctcgatgagggcgaggagcatcccgcccatgagcgcggagcggccggcggtgttgaggccctggcgcatggagaggaagccgctagtggcggcgccggcgatgatggagttccacagatcctccttctggtgcatgaagaccttggtgcagtcgaaggcggagaagaggtcgccccacaccgcgaagctgtcgcccacccgccgcgttcatcagcacggcctgcgcgccgccaacgaggcgctcgccgttgggggagttgtaggtgcccttgaggaagtggaagagggagcccctaactgtgcccatcccgaaaggcctgcccacgtcgtcggctgcacgggtcagaccgggcgccgcattagagggggcggagtgggagcagcggcgggccggcttggagacgggataggcggtggcgcggccgtcaccggcacgccgccgtcaccgctctagccctcgcccgcgcgccgccgtcgccactctggcccccggccgcctccaccgccgatctggaagggagagagagaatggagagagaaaagagagaagggagagagagggaggaggaagaaaggatgaaggatgacatgtgggccccacgtgtcagtgggtcccacaataattttgtgttgaatgacatatgagtcccatatatattttttttaactctaataccacgtaagcgccacgtggcatgaaaaccgggttagcaccgccacatcagcgccacgtcagcaaaaccaccctccaataccgccggaggagtcaaattgcactggtttcactaattcggagagtcgtcttacccggttttctagttaagggtcacgaattagattaggtgaataattaagggagtctaagtggactttttccaatttgaagcgctgatatcaaagttgctcaaagtgtacaagcatgttgccaatgaattatgggccgtgattttatatctaactgggctttaatttggtgttgggcttcaatttagcttcagaggttgggccacttccagatttttaataagtaaactgtactttaaaaaaaaaaacaagcaataccatgccagatggcagcatttttttttccagaaggtacactaatttaatctgctgctgcctaacctttgaattcaaattagaagcaattccactcaattccacccccattcattcaaaagtggcttaaagagttggtttgaattgtggcctaaataggccttaccaaattttgtcaatgctaaattttgacaagttttgacataactaattttggtaaggaaaatcgtgtttggattaaagttaaaatagcctaagtttatactattgaaatgacttattttcttaggcatgtcactaaacactattgaaattacgaaatattagtaaatctaatttaggcttcaaaccaaaccagcccaagccgcaaaagtggacaatttgccatcttcaattcggtatctcttcacttcatccatttgcccttccaacttccaacatccaaggcatattccacttggagctggacccactgacagtgggccccacctcgtcagtgacctactctccattaattacgctaactcctcacgtcgtctcgcccgcaaaatgcttctcttcctcctcttcctcctcgccgccggcgaggccgcggcggcggcggcggccaccacgctcaccgcgacgccggcgaagctcacccagtccgaccgcgagatcacgatccggtggtcgggcctcccggacccggacggcctcgactacgtcggcatctactcgccgccgacctcctccgaccgcgacttcctcggctacctcttcctcaacggctcggccacctggcgcacgggcaccggcgagctcaccctcccgcgcctccccaacctgcgcgcgccctaccagttccgcctcttccgctggcccgcgagggagtactcctaccaccacatcgaccacgacgggaacccgctcccccacggccgccaccgcgtcgccgcctccggtgaggtcgccttcgactccccctcccgccccgaccaggtgcacctctcgttcgccgacggggtcgacgagatgcgggtcatgttcgtctgcggcgacggcgggaggagggtggtgaggtacgggccggcgaaggaggagggggagggctggaaggaggtggccgcggaggtgaggacgtacgagcagaagcacatgtgcgactcgccggcgaactcctccgtcgggtggagggatccagggttcgtcttcgatggactcatgaagggattggagcccgggaggaggtacttctacaaggtcaatcacttgcctctgctttgaattgattgttaattactacactataaagatgaatttctttgtagcgacttcacttctgctaattatatgtgttcagcctgcaattgcaatttgggatttagggtagtattgtaggcacatgaaaatttaggattcgagtcttgagagtgatctaaagctccttttttatttcggatccagggattgaattttgttgatttagcgagtatgacttatagtacgttttgacctacgaattcagtttgaggtgaagatggctaatcatcaaacttttagagatactaacttgagcatgagcacccgctttggaaattatgtttgattatcccctttttagaactgaagttggttatagtactacactaaagatgaatttttatgtagcgatttaacttctgctttatatgtgttcagcctacaattgcaatttgggatttagggtagtactgtaggcacatgaaaatttagtgctcgagcccaagagtgagctggagctgtgttttttgggctccagggattgaattttgttgatttagtgatcgtgacttgtagtaagttttggcctataaattcagtttgaggtgaagatggctgatgcatcaaacttttagaggtaattactggagcatgagcacccacctcggaaactatctttgattattccctttttagaactgaagttggttgaagtttttgtctcaacatttcatgggttattacatgactcgattggcaatactttctttaaggaggagtttagagatcagttatgtcatctgaaaatcatgattttcttttttctgactagctactaagcttctaccaatcaaacatgcttcagttctttcctgcagttagaatacaactgtatgtgaattgaggtttaggatttcagttacaagggatttcactcaaatttgttgttgctctatcttaagctttggttgttatgtgacttccttcttaactgtttgcttcatttgagtgacatatgcattgcttagttgctcttatggatcatgattggatttttacggatgctccatttaagcactgtagttcatactatttttgaatgttgggtgagttcttaaaagacctgatgagataccttttaggcagaatttcaaacgccagtttttgtttttgttggttggtactcattattttcaaaattctggttttctagtacttctctaaaatcagttttggttgtaagtacctttgttatctatttgcctttttgttctattattattatgtatggaaagcatgtatgctatacttttgatgaatgatgattaataagatagctgtggttatgcgacttacttcttcactgtttgcttcattgagtggcatgtgtattgtttaattgctctatgaattataattggatttttactggtgctccatttgagcactgtaggttataatatttcttaaagtttggtgattccttaaaagacctgatgagtataccttttggacagaaattcaaacgccatttttcttttgttggttggtacgcattattttcaaaattcaggttttctagtactttttaaaatcagtttttttaagtgcctatgttatctatttacctctttgttctattattattgtgtatatggaaagcatacatgctatactattgatgaatgatgattaataatatttgaatttttatttgcttctttttgctgac

SEQ ID NO: 40594 - DNA, 9292 bp, Oryza sativa
ggcccattggccaaacgacattttgcagtgtggtattcctttattttgcttacttttgttttttggaatgtgcagcgggcctgcgaaaaacatgtttgctgcctgtacttgagctcttattggggcttcacatcaaagtatcattatatatttgtgtctgccttgtccatttgattgatgtgggagaaatagccaattaaaccctcaagtttcaactgttgatttaggccaaaatcattcatggacactcctgagatgctacattgacaatccaatccaatccaatcccagttagaaactcgccttcagaactgcctcatataccctcacccacacacacacacacacacacacacacacacacacacacacacacacacacacacacacacacacacacacacacacacacacacatatatatatatatatatatatatatatatatatatatatatatatatatatatatatatatatatgtatgggatggaacatttacaatccatctgtgaggcctgatgctaacattttagcatggtgaagtggaaccatatcttaaatatgcagagaatgattgatcgttatctttgtagacatccatgaatgaacgaaagtagatgaggttgatctagattttcgttcgttaatcgtcaaacctgatcttatctatgtaggtgtagcatcattttctttgtttaaaccgcagatgctgcaccaaagtttgtaatttatgcagcccacatatgcccccatgcaagttgttcattttttcttatattccagaccttttcatattttagctatgtttatgttaatctatgtgttttactgttggtacctttaatacaaagttctcatggtccttccccactccctaaattatttaggttttggtatcagttgtaatgaacctggtgttctgtaccttcatagggcataggccaacaacgaaagcactctggatactcccctttttctattactttgtaattttataggtcttaattgtgaataggatatcctgttgatgcctctactgctttactaatctgtactccctctgtttctttgccacaaattgggcctttggcctggtttgcactatcttgatctcaaatgagtatttgataaattaattttgctgtttaaacctatgacgttgctccctagtccttgcatttatatcttttgcaatatttcttgaagcatgttgctagggcatagaaatactatactaaagcactaaagcaacaggaaatcatgaaaaaatcaattacattctctcttctctttttctgtgtgataccacttgttctattacatgattatgccctcggttctttcttagatgttgttttagggtgttccttaatagttgtttcaagttatcttggtggaatatctccaaattgtcctgtggttggtattctagtaggttagcttactcaggttcgttcccttgtaatttagcagggtgacatgcatcagttgataaatttacctgtgtaagcctttctgtttcatccacttacgtgcttggctatgggagagttaaaggttggtatagaaatctgagatgggcatagttatcatgttgcttgatatctctctgtttggtattggattcttaattcgtattgttattgagtactcttcatctacttccagccaactgatgtgaaggtgggcatgtttatttcattcttcctcctctttcttgctgtatatcactccattttgttggtctgtagtgaataagataactgctttgttaagatttctactcatttgtccaaaatagtctgcggtggttgttgagaataaacacaattgggtcattgactcatcataattgattcacttcttttgcaatatcagaacctaattcaattcttattgaccacacattgttggcataaggactgtggttatattattctgttgttttttggtgggtttgtaatgttctttcatctgggtaatcgacttttcgggcggtcccatgtgctgtcacttggactaaatgcatctccaagaaaggatacacatagaacataattgcactaatgcaatatatatacttcacataccacatggggataatttttttctcctgatttcctttcaggatgtcaaagtttgcccgctgatggaatatgagtcagaattctttggatgcatggttcatgaaatttctttgtgggtctagtttcccaaatatggtaacatgcttatagtatgcttctctacactttctaagctttcaactactttggttcagcaaacccatgcactggaatatactccctccgtattttaatgtatgacgctgttgactttttaacaaatgtttgacctttcgttttattcaaaaaatttatgtaattattatttattttattgtgatttgatttgtcatcaaatgttctttaagcataacataagtatttttgtatttgtcatcaaaagctggatttgttgcaagtcagtgagcggctccgtcgtccggcttgccaatgccagaaattttgtctggtaggcagccaccgaggaggcctgatatagccgcttcagttcgcccagggcattgcgatggattggcggcccaaattgggcatggcacaattccttgaaggcgtaccaatctgggggtccgtgatgctgctcgtagtgaaaataccattcctgagcgtcaccggtgagatggtacgtggccagccatacacgatcaccatccggtgtcttctgtcctcggaagaattgttcacaatgattgaaccaattgaggggatcgtctttgccgtcatatttgggaaattccagtttatagaagcgaggaacgcccgtgccagaactgttgtcctggggcgcatgagaccgtctcgtgaacagcggtggaggaggcggaggcggcggcgggggcggcggtggtggtggtggtgggggagagccagatgatggtggtggtggtggtggtggtggtggtcgccggaacattccgtcgccaccgagtcgcggcggagttgaggtcgatgcagcaccctgctgctccagcgatgtaaggcgagatgaggcgacggcaactgagcggctgagatccgccaagtcacttttggatgcgaggagcgacatgccatgaagtacgtcggccatggactcgcggagcttggcgatgtcagcattggagaccggagctgcgaccgcagctgcggctgcgacggtggctgcgttggtggaggattcgtccgttgccatgagctctgataccaagttgtcacgagccccggcgtaagaacgtatgtgatatgaatgtgtgattggcggtggacgagggggtttggtggaacgacgacccgtgatgaacagcaagggatgagcaaatagagaataggagatgagagaactagagattgaatctgcttaattaaactccaccgaaactgtgcctctaaataggcgtacacgaattaaccaatgtgctaaaaacaagctaacaaactgataaacagactaacaatctgaactcatccaatcgccgcactgtagtcatccggcacgcagcttccgcgcgctactccgccgttccgcccggcgacgcttgcggaaccacacgccctctgcgacgatacgtaatcccgaccatgacatctaatgtgtggatacaggctgctgttttcagatatatgtcaaaactaacataaaacattgttgaatggtagcaatcagcaaatagaaaaccttcggccattcacctaccattgttctgaatattattcatgttgtgcagccgatgtccaacttggaaaagcgcatttttgctagagccatgcagacctggttagtattaggtcaagtttaagagttattttttctcatgaaaggctgttaaactctaatgttctttgtattgttacttagggctgagcacatgattactttgagcgagggcaatgtggaaatgttaaccaagcttaccaagtctatgagcacaataattaaaaggtatggctttttggtatttaccttgttcttttttctgtggtatttgttttcattatacgtttgaaccttttttttttgtttgcattgtagccttgagaaacccaagggcatagctggcgtgttggacaacatcggctaccgccttcctgaggacaagaaggggaagttcaccatgctcgttatcattctgatacccacagttggatacttctttcttcggcttgtggctgcgtatgagaaagtgttcggtaagattgatgtcctagagcgagtgagaggttcgcagtcacagggatgggctcctcagcagggcaaaagagagtgactccggattttgtagccccattttgtagtacttactctttggtacttctggaggagcacttttgatacctgcgcatctagtttgtttgatacttctgttacttctagaggaacacccaaaggaggtttgatgactgtgaaggaaatgtgattttggaagtttgatgattgtgtttgttgtgatgattctggaagtttgatgattggaatatctaaatattgtttgtctcgcaaataattatggcataatttgttttaaagcgctgttggatgatgggattatggatgaaatttactttattattttgtgggtgtaagcgctgttcgagaacccaacaaagtgaacattaagttttggattttcgtggcacgcttttcaaactgctaaatggtacgttttatgcgaaaattttttatatgaaagttgttctaaaatatcagattaatctatttttcatatttataataattaaaactcagttaatcataagttattatcttttacgtaaaacatttaatctttatttttatttttatcttcaggagattcaaacagagccttaactgactaaattaaagattggaaagttgataagttaatttaagttctctaagagatgtagatgctggtaaacagttttcttttggaaaatcgtaccatttaagagctcataaacgtgcgtgataatacaagttaaatagaacgggggaacgggggactatttgttgtgttggctctcaatatgcaccaaattctgcagaacgacatgatttacccgggcttcctgttgctactgttaatgaccacatccagaaaacaagacaaccatattaagagtaattctactattagggattcgaaaaggaaacaccggtaagcatttgcacagcatactttgcagttacatgaaatatataaaaaaggaaaagggtctcagttaaatgttgaagggaggtctgagtcaacaatttaagcatggatggaaggtactacattacttctaaacccttgtactcttctttcactcttcaaatccaagcttcttgtcttggcagaattcaagcctctttctcctcttcacgctttggcagttgggactctgtaagaagggcaacgaatgcggccccaaacaagtacccggaaatagtgacgccagcaaccatccacgcatgtttcgtattgtgtgtgccaatcttcttcatgcgctcaaggatcaggctgcagtatattcgaagggattagggtgagtgcagagtgtacattagtgaggaaaaatacatgacgcatcccaagtacctctcagagctttctctcaccatatctctttttgacaaaatcttctctatactccttacttttccaaggtttctttcattctgcaaattgacatggttaatacaaaacttctatacctcaagctgtataatgatttgttttatgataatggataccccagttaagcaacagatgtaatatactaatattatccatagtgcttcagaaaaataccagtcttagggaactgctaaaaaacagtcacatgatttttggtataaaactttcaaacataactgtagtatagttgaactacattacaactatagtataattgtagtttaattacaatataacaacattgtaacctctatatatcatatgtatgaaattgcatgaatttttttaatactcacatacaagttatatacagtaaataaaagttataatgaagttagtatatttatggtgtgattatcttacaattataatgaagctatagttacatttgaaagctttccactcaagttcctttttatagtccctagtcttaaggggaagaaatggatttgatagaagtgaaagattgccccttttctattggaaatttgttgtcaaatggccgaatgcccattgcaatcatgtcagttgtttccgatagatcttgcacaatcacagcacacctgttcagtctctagatttttctaatccattgcaaatcatttcaacactcaagaccatacttggtcatgcatagtatggtcttgcataaaattaatgagggttgtaataaaaccagatcccaagcagtcaagattaaatttgcaaggcaggtataaaactcagtccatatatgctagcaaaagtttgcaaccaaatcaatgagagaagaacttcacagccaagacaaagtcagaccccctgataagcacccttcctgacaaaatctatcatgtatacttacggtgcatttggttgcctgggtgctgggtggcctggccggtcccattaaacctggttcaaatggtccagcgcgcatgttgaaactgtttatctagttgagtttgtttgcccaatcccccgactgaagtactttggtttcatgcatctgcacatttttcaaggtatctagaggggacaatgctcatgggaagcttttcttgactcaagcaaaccaagccggtaagtaatgaaactaaaactcattccctccaggccatgctccagctaactttttgcatgcacagagacaggctcattggcctatgcaggaaaccaaactgctggctactgcatgatctgagccaagatgatattgatgcaaggaaccaaatacatccttagcttctgaaacagtcgagtttgcatattgacacggctaattcaaacttccatatccactaaaagatataatacgatttggtttatgatgagtatcaactcagcagagatttcttgtcgcctgataaattcagaaagctatcatacattaaaaaggcaggtttggattttggacttccacccttatgttgggaactttggataaatactgaaaattaccaagtcaattctttcgactgagctcaatgaactaaaagagaactagatgtgatatgttaaaatgacatatctcccaagaatcacttagaatagtgacattttgacattaacatgaagagcaccccattatcttgcacatgcaagccacgactcgttgactcaagttaagttttcaaatttcaattatcaataggcccttgcatggtgtcaactcatctttcaaatcccctttattttctaatatattgctaaccatatctatagttctatacagagccatcccagactttacttggtaaatgtataaaattagtacgataattataaacccaaaatcccaagaattcaaggaaaaggtccaaaaaaaacagaagtaaatttcaatccaggcctaatcacagggtataactaagaaaatagaaagaacaataataacctgcaagtatgttggggaacctatggtatttcacaattccccccaaacaaagctagcagagttttagctcaatagatttctcaatctttctaaaaacaacattataatcattgcattaatcttggcgaaacagattatcccctcttaaagggccatccagggcaaataagcggagtcgaatggttcgctaaaagtaaaaaaatccgactcttcgtagtcgaagagaacaagaacgtgaattgaggaagttaaagaacaatcaatcgattccagtgagtttaattggttaacatttggttggttactcatcacacaggatgatcaaaagcagaaaattaagcagcagctgccctaggtagaataagatttgattacaagctaaggtgattagaaaggaggctatttgctcaactgaaagccagccagatcaggagtagccgggaaccttgacttgactattcagagacttaatttggaacagaatttttttttaatccccttcctcttgaggtaaaccggatcgaatgtaaagaacgaagtatgcatacaaagtagcgggtttgcggtagagaggagtacgcaccatcaacacctggatgtacctatcgagagggccctcagcctcggagatgtcgagacctcggccgctgttgatgtgcagccgtgtcggcagcgctttcgataacacgccgtaccggactgccctcccagccgccgccaccgccgccgccgccgccatcccgccggttcgctcctcagttctcaggcgttagggtttgctttttttttttttttttttgaggagcaccgagaccgagagaggagtctgctatattgattttttttagcacggctttacacacgtcagaatctatcacgatctaactatatgtaatattattatttcgtaatttttagatctccgagatcgaaatgtttcagagtttatatacaactctgtcttccgttacatttgtttttcatttatttttccccaataatttaaggagaaaagacgttttaacccttgccatgtatgaattgattacgagctggtttggtttactagcaattcttgccctactaatattttatttttagaaagtgtttaaaccttggtaagttttgtcactactaaatttatataacatatataatttgtaatagcaagggtataaattggaagcaaaccaaaactagcctggtggttacaagaatcttagtagtacgttagatcctgggttcaactctacatggaagcaatttttttaggatttagcactttgttctttcagtggtaggcgacgtgatgttcataggggtatatcctaaatatttgacgccgttaactttttagcaaatgtttgaccgttcgttttattcatttttttgtgaaatatataaaattatatgtatacataaaaatatatttaacaataaatcaaatgataggaaaataattaattattacttaattttttaaaataagacgaatggttaaacatgttttaaaaaaatcaacggcgtcaactatttagggacagagggagtgtggcatagccaataattaagggagtatgtggcatagccaataattggcttaggctaagagctgtttaggctgtgtttagttcacgttaaaattgaaagtttggttaaaattagaacgatgtgacagaaaagttggaaat

SEQ ID NO: 40595 - DNA, 1279 bp, Oryza sativa
ggagaaaatgctggagctagcacgattcaagcgtaaatcacacacgcctcattgtttatgccagccagcaatgtactcactcattttttcttgaccactttctgtcttcactttaaaaaatgcagtgtgttgtcgagaataaagacagtggaaacactcaagtgagaagcaaaagaaagcatttcttttccattgaattagaaaggagcacaacctgtttgttggagtattgccagagcccgagagcaattacaacatctaaattgggcaacagcaagcaaaagaaaaggagtgctccaaattaatggcatctaagtaaaagctagatatcttcctttccttttttctgcttctatgtactaacaatggcccctaagacgacctaaacctcccctgttacctataaaatttcctacaatgtacacaagaagcaccaacaacagtcagtcagcagccagtcagacttggaccctctgccttgttactcgcccaccctgagcgctgaagtccagcactcttgctccaccaccagtccaatcttcgtcatcggtgtcctcatcaccaccaccaccaccaccaccacggcctcttgtaacagccgccggtcttcttactctcgacgagcttcttggagtcggacgttttttctgggccgaaacggtgtacatcccgtagtccacggtgtcttctcgcagcactgtcttgaaatcctgtccatcacgtccaaattcacatcaaatgttacacacacagcagcgcctgccaaaccccagacaataaaacatgctactacaactttgttccccacaaatccagaatttttcagcatcgctacctggtatacacgtgctgcatcctgcgggcagctcggcaaactggtgttggtattactaatgttcaatgggatattctgcttggagattgtttcgccagattttggtggatccttcaaagaaaatgcctgtaatgttgaaagttcaaatagaacttgtgtcagtaaaatcatcttaggattaacaatgttcaaatatgggactggcagggcaaacctgacaccgggcatcggttaaactatagacagttttcagatgtctcttcagcttgagaaggagctgcagggctatcgcgccatggcaatcctcctgacaacaaaaacaaactgaaatgaaaaaaaaaaaaggctcaccgatctatgcattgatgaactctcactagccactacgccgatagttctctctaactcacctgaagtttggccatgttaacaactggcgtgctg

SEQ ID NO: 40596 - DNA, 5932 bp, Oryza sativa
aaaaaacatgggaataaactcggtactgttgcttgaaaatagataaaggagaaccaagcacgattaagtaggccaaaactgtatttagtaacaaaactgtatttagtaatcttgcatggggctctgtaaataataaaagcatattcatgtaactaagcatgaccaagaagggaaccaagcaattatgtactagaagactagaaccaagtaatcaactttcacaacacgtattggtgaaatattctgaaaaggaggatcgccaggtccatgtctcttgtctttacagatcatacgaaggggtagaagggtagagaatattacttttgaatttagttacaggaatctgtgcacaggtattgatgaaaaatagcgaaccaagagctgatcaccatggagcaactaaatgggtgaccgtcaaggagagaagtttgttggcaaagaacaattacaaaactgcccatgtctatgtgttttctatttctaagttacctttttaaatcaagggtagatattcaacacagaagaaggtacctccagtacctctgaagcattgtaaaagccctcagaataacaatggacgaaattcagttttcgtggcatggaactgcgatcgttgaaacttgaaagcaaatttaaccttgagcagagcagcaactcatccaacatgcagcacaccattaacaaacgagatgcaatgcaactgtactaaaaggttcacagcaacacggtgctaaatgatagcacgagacagcaacacagggaatgtttagtccaaggcagtcactgtgaatactactgttcatacaggcattttgaagctggcaaagctagaacagaagcttagcacacagtaataagtacatgtagaagaaaaatctaagtccagagaagtaagtaactatccagtccattttgaattcgatggtacaaggcagaatggagcaattggaggctgaggtcctaggggaaggctcaatttgcagagcgtttaccttgggaaggcgggagagggcggggtttgatggtgaaggcgtcggggttatgcttgagcacctccctccagagccaggagcactggctggggtccgtctcgacgttgtccgcctccgtgaagcccctgcagcatggcacgagcgaaatgagcagcgtggaggcgtgcggagaagtgaagggaaggggggggattgggtactcacaggtgggagacgtcggtgtcggcgaggatgcgggcgatgttggcggcctgcatgatcatgtcggggcggtcggggtcggcgagggggtcgtcgtcgtcgaggaggccggcgccgaggttgagcgggagcgtggggagcgggagcgcggaggcgatctcggagtggacggtgttgggcaggcggcaggcgcgctcgaagccggccctccggcgtccgcctcggccggggtccatggtggggctccggcgagcggagcggaggggagggcaggtgaaaccctagattcgaggagggcaggggtgggggatcgaattcgaattggaattcgaattgcggcggaagggcggatttgagattagggttgcgtggcctagataggcaagcatttaccactcgcctcgcctcttctagcctagcctagctgctacagtgattccagttcgcgcccgcctcccgccggcgaatcgtgccgcggaaggaggacgacaacgacgaggagacttttttgttttttttcgtgtgtaccctttgtttcgtttttaggagagagaatgaagatgttgggctactttttgaaaggaacaagtctattttatctccctcctccatctcttgcctgtgtaaatcacctttcaatcgtaaaaccgagtataatacattcctcatatttaaaaaccggtgtaaatcaacctattcggtggtttcaaaaacggtttcaacctatgtgccgctcataagacccacatgtcaatgataaatatataaaaaaaattaatctcacacggccacatgttcagtcatcctaatcttcatatgtcagccaccctaatctccttttctttttcctcgccctctttcctcgttctctttaatatctcttccatagtctcttgaatactttcaaacccaaatatgaggttgtggagggctgaaaaaaaattaaaactgatgaagaatttttttatacacataattatgtatagccctgactatgtaattagttgaatataactaaataaatactcagagagtagataaatcaaccagtcgagtggttttattaaacaattattggcaaacatggtgtcaaatatgaattaataatactcaaaatggatttaccaactccctattaacaaccaagaagaaatatcatgaacatcataaagccaaagatattggtcttaaaaagttgcacacatatgtggtttttgttaaataaaaacaatgacgcagcagttggctgattgcatttgtttaacatacgctaaacagtgcttatctttaatgtaaaaaaagttaaagtgtaaactataaagctcactgttcaccacctatttaaatcacattgtaccaactcttctaaataaaaggttgtgtaacagcaagaaaagagaattttcaaggtattggatactttccacgtgcatactgcaaagacaaatatacttgagtccctaaaaacccgtggaaggtcagtaaatgtttaatggacttcagcccaaaaaaaagcttaaagattcctaaaaaacaacacgatactgtgtatcgtcttgtccaccgcttcatcttcacaaaaattcctcttcgcgctcctattcacttgccatcgccgccaaagttagggctaagcttgtgtaggtatttcgctgatctttttttaagtactgcacttgactataatatgggtgtagttagaagttactagtaatgacggcgactccctcgctctctcatcgccgcctatctattttcctccggtggctagtgagggtagaaggggaaaaaccgggggagagagcggtttccacatgctcctcccctagccacagccgacccaacgcgactcctcgctcggtcccccagccgaggagctcgtagagccgcgtcccttgcaagaagacgcgcgcctctactgggggacggcttgggcggaaaagcgcccaagcgaacgggagctggacgccgtgagccaaagccactcgctgagctacgcattgtagatggcctaaaagagctggccccagtacaatgtcaacacttttttgtcaagattaaaggctgatgcaccatataagccaataaacatgcagaagaagcattttattcacccggtggtagtgtggcactgatgaaataataatttccgtaactaaccgaggagctcaacaatgaacaaatcctctctggaacacaaaagcctcataacaccaaaggctgttgtttaagttacaagtgttgggctacaaaattgatgatgctgtgtaagaacctgtgttctcacttctcagtctcagttatcagtcttttagtgtggttttggtacaaagccatccaccgcaaagtttcgtgtagctgctggtaatgccagtcgcatgccatcaagttctggctttgctatcacttgacagccaagacgagacctgaatacagttcacaaaattgatgccagattagaaaggacacgcatttaaattgaacaaaaactctagtgcatacaaagctaccatggtatttatacaattacaacttaccagcatgagaatatctcacttggctattttaacatgttggttgataagttactttgtctttaatttccattatgtcatgcatatagcttaagtcacggatagcggcaattagtttgtaaaggttgcacacagatacaggtggagacatatcaggatgattaaggaagcaactgcatatcgtatcctctcatatcaaatgcccccagtcctttgttttcccctccctccctcactatggccatcaactacttaaactattctaacaataccatgcatactcattggttgatacccaacattcttgtttgcacgataatcagacagcaagcaccacggaaccatgaaactggataagccaaattaataaaaccttcaagatatcttcacttacgtttctgtaagtccaaatgcaaggtcaagcatatcattttcttcatctgttggatcttctagcttattataataatttacatcctggacaaaattgaaatggctagttagtggcacttcaatctctacaatagcatgaaaaataataaaaaaaggaatggttatatagagcataccataactatgacatgacaggttgaacacgcaagtgaaccttcacatgctcctgcagtacccaaaatactagaccaagttactaactacaattaaaaatcagtcaatagtcaatacatgaaacatgtcaaataacatcaagtaatcaataatggacgccatgtctattgggtaaacataatttgctttttatagctgttcttatcagcaaaagaagttaagaattgaaagcatagtacagttgcaatgataaatcagtaaccttcaagttcgatgtcattttcatgagcagcttctaagatggacattccaacagggacactgattgtctgctctgtgccatccttgttcacaaatgttacagagatcctgtgcagcacaaagaaatttgctcattagaaaaattaatcggttgttttggacagctatttcctaggagggaaaaactgaaggagaagcccctttaaagacaacaaagacattgaagaaactcacattacaacgacatgggatacatcactaccttgtccaatacaaatattgctaggtattcaaatttcatgctataccagaaaaaggaaaagaaaggggagaggaaatatacttacttctccttgctctgactgccatcgtcacgatcactactagttgttgctgtggagaataagatgttcttctgaaaagttacagaccagtgctcattacatacaaggacatttgcaaatggtaaatcatctcttctggtagtacagaacataatcccaagataaagatggtggtggagaatgtgcagatagataaaatcttttgtctctcagtttcagaatgcacaattcatattggtcatttcagaaaatccatgtcatatctagaaaacatttatgattgctctttttgtagggattgtcagtaacagctatacaaatttcagaatgcaaacatcataaagggtatataagatacagttgacttggccaagttaagctctcggtgaaaacacatacaaagggtatgcaaaattttcgtccaaactcaccactaggcatcacaacaacaagatacagattggactaaccgttgggacaaaacgtcggctgagttgacctcgataatagctggttgtactgcttgccaaattccctactgcacaagagggagaacaataaaaagccaatggtatagcaccaagatttactcaacaatagtggctcagcctaaaccggccatagaatggatagtggaagcatgcatatcgttcatacaaatcgatcgctctctcctctttaatcattcgtgataatgtatagattcgtcatggtttggaagtatttctcagctgcttccagaggattaaccaataaaaaacaagagagacacgaaaagggtgcgtaccagctctgttctcgcgcagaagccgcgccccgagctgcgagatcctggacaacatcgccgcagccgacttcactacccaacaccaccactcccgaaccctaacagcaacaatccaagagcgtacacgaatcagcgagaaccgcgtgggggccaacaaagcaaccgaacatccggggggagcagaaggcggagagagaggagacgaaccttccggtggccggtggccggcgccgccgctctcctccc

SEQ ID NO: 40597 - DNA, 1843 bp, Oryza sativa
ttttgttctggggacatcttttttctgttctgcggtctgttccttgtgttgattgccatccattcaagcgggtaaatcagatttgatggtttggtggataaaaggtagtatgtgattgttcagcacggtttagcagcgggctagctgctgctaagatttaacatcgatatggaagtttgagaatcggtggactctaatacttgtgcgtgcttccgttgctgccaagccatattgcttattgtctgaatgctcgctcttaaccatttcatgtgctcatatgagcaatctgatttttgtatcaaatatgttatccctccttttttttttacaatagcagatagtgtttatgtgtgttaattgtgaggtcaatttttttttacaatagcagatagtgtttacgtgtgttaattgtgagatcaacttgtgcattacatgtatgtacatgtcactggttcgaacatgttagactttccttgttaatggtgatttttctaagccagttaagtagatggtagcagataaaagttctgtatgtcgactgtagaattaaaatgttcagggcgtgatctgtagaaagatgtagtaggggtggctggcaggttgcagattcaccagcactgttccttttttcccccaaggagtatatagagaggaacaattagcttgctggagaattttcctatgatacgtgtaacatgttttatgtgatctgtcagaaggctgttactggtgcttaggtctatatgtgatttattttttattttgtttgtggtgtcttgttacattgtgtaactggctccttgaagtgttttacggcctttatccgctgcatgtgctaataaacacttttaagttgcacaaataaactgtgggttccattttgtcttatatttttagatttactggatattgcttgggaatgtaagttgcagagtgttgtagtaaatgatattatggtttgttgttctgtgcaatttactctactgttttcaatggaagggttcatatacatgttcccaattatcttatttctgaaattctccgtattgaatcctgttatcctgtattgatttcatatgcactgttgtttgtatgacagaaatagtcatctcagctagtgaaaatggtgcaatacaatttcaagcgtatcactgttgttcctcctgggaaggacttcattgacatcatcttgtcccgcacccagaggcaaacaccaactgttgtccacaagggatatgctatctcccgcattcgtcagttttatatgcgaaaggttaagtatacccagtcaaacttctatgagaagctgtccactgtcatcgatgacttcccaaggttggatggcatccatcctttctatggtgatcttcttcatgttctgtacaacaaagatcactacaaacttgccttgggccaaatcaacacagccagaaatatcattgcaaagatagctaaggactatttgaggctgctcaaatatggagactcgctgtaccggtgcaagtgtctcaaggtggctgcattaggtcgtatgtgtactgtcattaagcggatcagtcctagtttggcatacctggagcagatcaggcagcacatggcgaggcttccatctatagacccaaacacccgtactttattgatttgtggctatccaaatgttgggaagagctctttcatgaacaagatcacaagagcagatgtggatgtccaaccctatgctttcacaacaaagtccctgtttgttggtcatgctgattacaagtatttgcggtaccaagtgattgacactccagggatccttgatcggccttttgaggacaggaacatcatagaaatgtgcagt

SEQ ID NO: 40598 - DNA, 10553 bp, Oryza sativa
ctatagctgtagcgcgtttctcgttaaaagcatgtactactagtatcacaaattacaggcccggtagatcctactactaggagttaatagttcctagaggtgcgaggtgtgtcctagatagatatccgatcgaacatccaataatcatccatgtcagcaggaactctcaacctatgaaatgaaggggaaaaaaaagaaacagaagagggaaaatatatatatggtcactggatgctgctacttttatacaccagaagaaagaaaaggagggtgaatatgtataccagacataaggaggaggagttggttctcctagcgagcgttgacggactggcatgagtcatctagttatctgcgccacaaaaggctgcagcagccagcgaaaaggaattgcctctgctgctgctcctgaatcgcgtgaaatcatgggggtcgcccgctcgtctcgtccgtctcatcgctccccctcctgtactgacagacacgacgagattcctctcctctcctctgctccccttctcttccttccatcatcgatccgccgcagggaggagggatcaggcgacgaccaccaaaaacccacaccgatccgatgagagagagagagagagttgggaggccagatccgatctccccattagtaacttatccctggaaagaagaagagagggaggggcacgcgaaattccatccctgcccctctcccttatctgactcactccttcccttcgctcgctattcacggactcatcgtacgctcggctggagtactttattagggctggctgtgttttcccaactaatctcttttttttccatcatcacgttttttataaacttctaaacggtattttctttcataaaatttatatatataaattatttagaaaattaatattgatctattttttaaataaaatatagctaatacctaattaattaaatgctaattgatagctttgttttacatgcactgtaaatttaatttcggaaccgcaatgaacaaacacagcctagttgaggctgccttcgcaaatctatcgatttattagatatataattacgttgacaatatttacataaattaattcgtttatattttttttatgaaatttaaaatttttaatgttaactcactgttatttaacatacatcctttcaaatatatcttacatctaatatctatagctctgtcaaacataatttttatttttattgaattccgatgagaccccttggtgccaaatttaaagccccatagttattgattgttttgtgcattcttatccttatataagtggaaattcaaacttttaaaacatgattttatgaattttttttctcatcatagtttattttataatattgtctttttatcactaacaacacgaatatataaaaggaggcaattttgcatctaaccctattttgcacaccacctaccaatttgaccccttctatgaacttcgttcgtttgatccttgttttaataataactaaagatatagtttggacttattatgttaaggtaatttgacactattttctcaaatcttttaaattagtttgacctaaagattattttttgtcaaaaatttcggtttgacagatgtttgacaaatttaatatagactagaaaaaatacccgtgcgttgcaacgggtaaagacgttatttctataatatattaagagctgagcaataaattgaaatattgtatcgctatacattataattgaaaaggttaatgaaaattctaatattgggatcgctatatattataattaaaaaggttaataaaaatctttcttgggttttgagccgaaagccttcattacttttcagcccaaggccagtccgctacctccctttatttggcctgcttgcttcaacccagccacgagtgaagccgttttcagccctaggccggtccgctacctccctccgtttggcttgcttccttcgacccatcaaatccggctgaatctttctcgatcacccaaaaatggttaagggtttttgatccacttacctcttttcgttttacccaaaatcaaagcgtaaaactcgagataaaaacaatgggggaagatcgtcgtcatcatcggcaacagttagattaaatccgcaaaataaagctaggaaaatcatggagaaaataatgaggaaggagtgggaatcgatttttttttcaatcaaattggagtgaaaacgcacaatcgatatggcgccggcacagcgcaagggttcaactcggtagacgtgccgcaaatagattggataaaaaacagacgagaaaaaccaaaagcgcacgggataaaaaaacaggtgacaaaaaaaccagaagtgctcgggagacacgcggtgaacaaatcggatttaaaaaaccggaaaaaaaaccgatagcacgtgcatagaaaaaactctttctcgtgaaaaaaaagcaaacggactttttttttgtttttcactggcgagacttttcttttccttttttactgtagtcggacgatttttttttctttttttactggtgacgacataagctttttttttctttgttgagtcggaattttttttaccttttgagtcggactttttttttcttttttacctactatatggaaatttcttattatttttaagtggagatagagatacagagattaaaccaaaacataaaattaaaaccgattgaaacacggatgacgtatcaaataccggcaaaaacatcttcaatttttataatagtagagatagagatttgacaaaagtgtgagtaaactataacaaattcttttgacagcatccaccaaaaaatgcatatatcgaatcaaaaagcatacgtacatatatattttagatcaaaaggctatcgcccagctttactgaaagcataagaagtctgtgtacagaaataaggctggggattccagcttacatatcaagttcttagccaacgacaccggcaacaaagctgctgactcagcacaaacataccatacaaaaagcaaaagaattaccataggatgacacataggataaaagagttttgaaggcactctcttcacagtgcaagcaccactagtgggacccacaaatatcttcaccaaatccccaactgcttctcctccctcctcactcatcacgccaccaaatccccaaatccggcgtcagctcaaccctcctccatcgcccattcccccgccgcctccgcccctgccgctggctatcccctcctcccttcgccggctcctcttctccctccgccggcgtcggccggctctcatcttctccgggccgagcggtggcgtcgtcctccgggccgagcggcggcggcgacgtcctccgggccgagcggcggcggcgctatcctccggaccgtgcagcggcgtcgtcctcaaggctgagctgcggcagcgtcctcgaagaagcggcggagcgacctggccaaggcggtggagctcggcatcaacgggctcgactcgcgtggcagcggagctcggcgtcgacctgtccaaggcgacggccgggagaaggaggaggtgggggagtagatctggccggcggctcgttctcggcgttctctccttggcggccgcggagcccgctctctcctcggcgcgctcgtcctcggcgttcttggcggcggctcaagaacgggcggcgcggttgtcctcggcgttctaggcggcggctcaagaacgggcggcgcggtcgacggtgccgcctcgcctcgccgtcggccgagcgcgcaccggcgagcctttcccctccctctctgtccgccgccccacccctctccctcccctattccatcctgccgccgctgccgcatccatccagccgccgccgccatttttgtttcatgggagccgcgcccagtgcaagggagagggcacggggcggcgaaggcacgctgcccacagtgcgcatgcctcgcgatttcagcgtcgcccttgacgaagtttcacgtcgctatgtttggtcacgagtttctctgtttggtcccgggtcttagcgccacgtcgacgaaaatcctacatagcacaacaaggttctgcttcacgtcctcgcactgtgaagggcctaagagctaccaaggcttttactagttactgccctctatccggcagatcagctgcttcttcctacttcttggatgctggcatgcagtgagaccctcaaagcctccagctctcccctcagcttcaatggaaccaggtttttccactgtaagaaaaatgacaatgctttataaggcacatacgtacatatatatagtacaagcttaccaagtaaattataatgttcgcatctattttttatgtatctttaacgatgatacaacagtgatattaaacatacgtaatggccacgctactactgtctaacagcataacgtcatgtcagccttcacacataagcacacgcatacatacgtccaacaagcaagtaccagcgagcattctcccaaaagtttttcttcttagaggtggggtaattgtcacgcccagaaattcccgaatagaattccaaacagaatgtgcattaaaatccccgtccaggaccggccggggtacacaagcgacaaagttgacatatagatccacgtcttacaaacattataaaagtcttacataaatgcagcggaaaacttaaaggataactggagctaagccttgacttggactgcagcgggaacaccactccacaggcatcctcgacagcacggacgaagcctactcctcggagaaaccatcatctgacgcatactcaaattctggggtttggggaaaatagagcaagactgcgtactacccactgtactcagtaagtcataccggaataggggtatgatgcaggaaattatcaagggatagctataatggttcatttgcataaagcggacgattataaacagaagttgaaagcagtaaaatagttgtaataattaatcaatattaatcatccactgtccaacgctataccacgttgtaacaggcccaaccatccacctatactagtcaattccattagactggtctagggtgagtataatcacggtgaatctagttgaccgcccataaccgcgggcacggctattcgaatagttttactctaatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcaatcccctctcgtgcctaggtgaatccggaagccgcataggccgtcgcagggtccatccaaactccatcacgcccacccttacctggatgcgtcggctagaggaaagctatattacaagcccagccgttgcccacgctggcttgtggaaagtacgaggaattcttccagtgtttcccacgaaccgttccttaattgccatgggtgcgaccatcaaaaccatgcacccacggcccaccatttaatattaattaattaaccaacaccggagcggtgagcattaaccaacaacaatcctagaatttgatatctatgcattaatgtagttccccattgtgtgctagttgaactaagcaaagctaagcattccctagtccaatctctagtcatgttatatcccaagctaacaaaggaacatgttaccagatagcatggctatgacagtaggtaaacatcccatagtgatattgtaaaacaatgtagtatttgaaggaaaacaatggagcatttgcaatataggatcaacatgttcaagtgacaagcatgacttgccttgctctgcagctggaggaatttcggcgacaatttcaaggtacaccggagcgtcgggagagccggaatctaagcgacaaacaaagcaaacaatacaaacatgctataagactactgaaacagagaacaaaatcatttttaatggattctacacattttccttgatttactgagacttgaatgggcttaaacggagctcggatgaatcagttatgaattttagaagattcactgtgtttttactataaacggaaaaatccttaattgatttattgcgcaataaataaatcccggggagagagagagggcggcgccgacatgcgggccccacatggcagtgactcgagagggcggtccacggcggaccgggtccacggaccggggaaaaccggcgtaccacgtggtgcacacgtggcaccgacgcggcgtacacgcggcggcaacgcggcggccgaaccgacggccccggtagatcggacggcgggggtggctcgcggccggcgcgcgcgggcacggctcaagccggcccggcggccatggcgcgcggtggcgcggcgcgcatgtggcggcggcgcgagatggcgaccggcggcggagagaggcggcgtcgcggcggctaagcggcaacgcggtggctagcggcgcgggagagagagagggagggggaaggggaggcctcaccgacggcgaccgacgacggggagcaatggagggcggcggcgacggcaggacgatctccggaaccacctagcgaacaccgtggaaggggttagtgagggagagggaattggaagagggtgaggacaccggccgaaggcggcggccatggcggtgctcaccggcgaacggcacggagtaggttccggcggcggacggggtggcccgtacgatggcgaatgcggcggcgtcgtcggcgcggatctgcgcggcggctagcggcgaccggagcggtggcggcggcggcgaagaggagggcgacggcgctagggcgttagagggcacgggagggctcggcgagatggggaaaaagagagaggggtggcggtgacgcttaaatagaggaggggaagctcggacgtggtcggtagaggcgggaatcgccggccgacgcgggggagtgggggaggagagagaggcgggattcgaatttcgaatcccggccatctcgggcgcgggcgcgggcgagagggagggggagtgggtgcgggggatgcggcgcatgcgcgggcgtggccgacgtggcccggaggaggcgggaaacgtgggcgcggcggtggttgcggggcgcggcggcgccggctagaggaaggggacgggcccgacaggtgggccccacctgtcggcgaccccgggagagagaggagggaggcggctggctcggctaggcctcggcctgtcggccggcccagcgggaagggggggggaaaggagaatgggccggcggcccaattgaaggaaaaagagaaaagaaaaaggaaaaagaaggaaaatagattttcctgggattaaatattgcttgtgctcaattttaattggttaaaattatttctagagctctgaaaattccactaaaaatcttgttagaatatttcgacatgtagaactcaagaaaaattccacatgctaaatccgattattatttgcattaatttattagggttttctcttgcttttacaccgatattttctctggtggattataaattcaatttaggcttgggaaagaacttcagggtgtgacagtaatcctggttagaggcggggcttgcccgggtttaagtttgcttgagaccggctcaccattcttcatgtcgatgtaattaaaactttatttcccccaattttaatgaaattgaccggtcaatctttggccgtcccgacaaaaaaaaaagaaattattttgttaaatcctcattcccttttactcctgaagcagactatgccggcctgctgttaatctcatcactctctccatcagctgcattttctataatccttctcagacaatctatttccgactgttgtagcttgtgataatcttttataaaaagagaagaggaaaaagaagaagaagaaaattgacctgctcgggttgcatatcctcttcttttttcttgagatggttgggttaatgaaagtgtaactggtgcaggtatataacatgtttgcgtggtgctgctgaaattcgtttgcgtttgcatggtagaacacacctttacccttcaaatttcaagtaaagttgtgcgaaccttgattgacccttgtgtgctgtacagtcatgttgttagtactggtatggtatctttgttttcagttcatatatcttcgttgttttctacgaaatttcaataaagtttgtgtgaaaattctctatgctacatacaggttcttgcattcacatattccagattttgctctctaaggcctcgtctgagatagctgaaattgataggttgatggataatgtgatttttgtgatagccatttgacttttaaagtagtactagtagcttggaaaacatacaaacaagaaatcaaggttgtgttagttcacactaaaattgaaagtttggttgaaattggaacgatatgatgaaaaagttggaagtttatgtgtgtaggaaagttttgatgtgataaaaaagtggaagtttgaagaaaaagtttggaactaaacaatgccttagttcacaccaaaattggaagtttagttaaaatcggaatgatgtgatgaaaagttgaaagttaatgttgtagaaaaacttcgatgtgatggaaaagttgaaagtttgaataattattttggaccaaaacacggtccaaataagagaagataatccctccggagcgtcgaagagtctaatctcctgatggtgtacggcggctacggcctggaaaccagaacacaagcacgactggaaaactttcgacttcggggtaacgtggctcatctggaaattaagaatgcaatgctcaaatcttagacggaagagcagagcaatttatgacggtgtttacatgcaggtgtgtaaaattttgacgtgtcatatcgagtattatataggatgttgcatagggtatttggacactaataaaaaaataattacataatccgtcagtaaaccatgagacaaatttattaagcctaattaatctgtcattagcaaatatttaatgtagcaccaccagggtttcaaaaaccgccgggggcccggttaccgtcacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccattttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgcggtaaccgcgcggttaccggcggtttttcacacctgagcaccacattgtcaaatcatgaagcgattaagcttaaaagattcatctcgcaaattagttgcaatctgtaccataattattttttagcctatatttaatatttcatgcagatatttaaacgtttgatgtgacatggtaaaaaattgtaaggtgggatgtaaacaggcccagtgcaggagtggaaaacttggaaggctgcggggttagcaagcaaccctacgattagtagcggttttggtgtgtggcaaaccagtggcctggttcggtgtgagagccttggctctgcttgtactacaatacaattttttgaaccctctccttttcaatatatacttcggccggctacgccggtccggcgaaatatttatcaacattggccgtgtttatatccaaactttcaacttttttcatcacatcaatctgtcatatacacacaatttttcagtcacatcgtaccaatttcaacccaaacttttaactttggaagaaactaaacacagccaccgtgaaacttgcatagcacaatgctttcccatagaaaagattcggttctatctctcttactttttttccctgttatttaagtttcactgctaagcaatatgcatatttcactgatgtcttagttgatttcagctgtttgtaatttgcaattggatataaggttaattgctctactattttgtattacgaaaacttgaggaaggcttgcatatattttcagttccggttccatctcgaatagatactttatcgaatgcctagcattaacatttgtggcgttgagatgttataacttaacactaaaattccggtttgtatttacataaattttttgacattgtttattgttcaagtaagtttttcataagagtcaaattgtcaaaatttcggtcgtttgagacgctgcccatactccgcattctccttccctgaagaattgcagatacacaaggctcccattttaccttttctttttttttaaaaaaataacaagaaccacgcata

SEQ ID NO: 40599 - DNA, 2024 bp, Oryza sativa
ttataacagcaacaatgagagataacaaatcagcggcgcatgaatagcccatagaacgagcgctctgaccagtacgaaaacgtggagggggaaaaaacgaagccattaaattaaacagaaccaagatcgcgcatgaccactactgataacataacaaaatgtagtagaagacgagcaccatacatcccctcagtgtcacatgcatatactgagaacacaattcaaatatatgttaatatgttacacaccacggttaggacaaaaggatattaagtgcaatggctgttatgtcagcaataacaagtcatcacaaacacacgatgagagctgataacaggagaacaagtgcttcctttcccgaatcgtttgcatgcatacttacgcactcccatctattttagcactcaaagtcccaactgcactggacgcaataaatatcgctgcaacattaccgccccacattagcttatctcgaaactccccattgggcaccccccaagaagttaacagcctgtgtatatgcatgcacatatatgaagctgaatccagggtgaaaaaaaaaagaataacaaacttgaacttgtaagctaccacatacctgttgagataatttctatcttcgctcttcagtttcctcacttcctccacatcttcaacaatctccctttgtgccatcgcctcaaattcatcaaatcgcctgatacttttgacctgattatcattcattaccttgaacatcaattgtgacaagattgatcaagaaacgagtcctattgttagagagagaagaattcatagacttcaatatcaatagttttcaggatgtcttcccaatgttaagagaataaaatgaacatttgcatactgcagggtaaggttagaagttagaaccagagcgggccagtgctgtgcagtggtttgcaatttagtgagttgagtaatcattactaatgcaagctatatttttctgttagtaactcttcaaaatgattgtattctctgcatatgctttctttttttacaaatataatctaacatgaatcacacacacccacatttctttaactatatgcaattatttttttaggcatacaaatttgagactggtgcatacatgggttatttgcattcttaacatgtactgcagaagattgacatttcctaacttcaatctatgttggcaacttggcatcaacaaggaagcaaaaatcacatcgttcctagaacatatcctctctaagctttgaatggaagcctatctagcactccaaacatatcctctcgaatttgcaatatctttgatataacatcctaaagtggattttgcaaggtggttttacccatgcaatatatgtggaacatacacaccaaactctctcctatgtatcaatctctctctctctttcaccaacaaaccaagcactggaacaatgccaacataccatcacagttggtcaaaataaagagtgaggattgatgaagtatcaaagtatcgttgtagtttgccaaaactgcctgtttaagcttcccataggcaaaaccaccatggaaaatcacattctatggggttatatgggttaaactgtaaactttttccgtgtgcacattttttttgggtgtgtacgtgttctggggggtggagtgggggatctgaagctggtgttgaagttccagttggtggattggacttctgttcaaagtttaggaggtggaccatttattctaaccaaacagcattatattcatgtggccatctttttctcccttttctgttgagaaagatactcccttttatttaataagtaataacacaaggttgaactacatagaaagattctcccttttatttaataagtaataacacaaggttgaactacataaatacaagaaaaaatcacatgggagtcagagcatcattttaagaactagtataacctaccagcgatagaaaatacaaagcacatttatcttgctgaagtggccaaaacatcatttactgatagcccacctaacaaagacacgat

SEQ ID NO: 40600 - DNA, 29262 bp, Oryza sativa
gactctgagctagggtttcctcttcctccctctcgattcgattcgatgcgagttgtagaggcttaggctgctggaataaaataaaaagaaaatcagaagatgatgggccgggcctacccagacagagttaaagcccaaatccatcgccacctcttgtctctcaagagaaacggctccaagttcttttcctttttctacttactattattattatataatatatataaataatcctcacctacccgacaatctctctcccaccccacccctttctcgtttcgttggaagaagaagaagaagaagaagaaggtggtttcgctggaagaagaagaaggtgaaaccctagatctgatctcggatgacggcgcgatcgttgttggccggtaggatggtggcggcggctcgccgcgccttccgcagctggcccctccacacaatcacaaccaccaccaccaccgacgccgccactgccatcgccaccaaggaacagcacaaggtatgcaggagccttgattgaccacctgcctatctttgttcatgttgggttgattgatccgcatccatatccgctcgcgcgagcccttcttttgatttcgattctgtatctcgtaatttggtcgatgcgtaggtggtcagtcgtcttgatgtgatggaggatataagctttccctacatgacacgcgagatggccgccgtactgcggcggagccgtgttgcggctgtcgaacacaacaattttaacatcaggcagcttgctaatccttaccatgggtatgttggcttctttcctctctctctctctctctctctctcttatatatataactggagtatctcggacgcaacagcacaatcagtttatgcatattgatctaacctgtctcaatttgcattgttcgtaggccggctgatggagatatcctgtatgacagggcatggattaacaatcttgctctgctttttactctctccacgttatttggggcgtttagtactctagccaagctaaagcagacacggacagtggaccaatgtgtccagacccaaactagttaaagcaaccactgaggttgtatggattccagtcccaaacttgttaaatcaaccgctgacgttgtattggatatcatactctgtatgtcgtaatacttaatttcatatgctattgtcataacttgagaattacttcctatatgttagctttatatgtttctggatgttctgttgtgtctgcccccaaaatacaacttgctcagttaagatttctcatgctactttttgatgatttgttcaccatgtcgttaacatggcagcagtattaggtttaggcacatctttcttttgttattacttattgcactggaatatcatcaagctagaatgtggactacctactagcatagcaagttacagtagtgtattatagtaatgatattgagcttggatttggcatatgttgtgcctacacgactcttttacatgaatcagagtagagtgtgtggcttcgaaagctgcctcctttggtccatcatgcctgctcccgtaacttgctttaaaaatgcataggaagttataacctactactgggagtagctactcccaccctagtagatgttctcctcactttctaattgatattctgctatataactagttgattttctgctccatttctagttgaataattttctgcacattttcagttggtagattgctcgtttcatgtcatatatatactgctttttttctgccctatattctgctccttgtcaagatgatttaccgatcctcttcaagtgaatgtatattccgctcattttcatgttcatattctgtttctttccaactgattattttctgctcccaacgaacatgaaaccatgccgaggataatcatcatctgatctcttttaacaaatcccataatgggttttgggaatagcgtggctccaagcaaaggaattaagagacgcagaatcagctgtagcaagtccaactagcatatggaagtcctcgtggacagataggcagtaacgcagtacaaacattttgtgccttatctttgtgtttaactgatccatctggctaacgaacttctttgtacaggaatctgctatgtattcttagctgcgtgcagcaaaattatctagcaaaatgcaatcaatagcacaacaacagggcaatgaataaaactccctactcacctgagtacctcacaatgtctaagtgtccctttaaaaggcactagcaatcgtgcacatgcaatgcacattttcagccatatacatacatacatacatacatacatatatatatatatatatatatatatatatatatatatatatatatatatatatatcataagatataaataatcacattaaaaaatataatttttatcgagcaactttatgatgctttaaaaaatgcataggaagttaaatcaatgtgcttcatcaacaggtgatctagtaacgatgcacagataccagttaaatagcatgtcctttattttaagatagctaaacatgtactttctctttctccgtttcacaatgtaagttattctagcatttttcatatttatattaatattaatgaatctaaatagaaatatatgtctagattcattaacatcaatatgaatgtgagaaatgctagaatgacttacattatgaaacggagggagtaccaaaattttgcaaatcaacataatctaaggaggctacactataaagaagcttgtaatcatgctaaagaaaagagagtcaatattgataatttgttttgttagaatgtattatcaaatttatattgaaccttacatatgaataaacatatctctgaacttctataaattacacatgtttatttacatggtgaatcattataatctaatacaaccacaacaaaattcctaaatgaatttcatggttatccactttcgataccatttgaagatctggctttacattcagactacctttacccgattacttgcatattttgaattcgagctctccattgatattttaccttgactaaatccgttggttggttttgatgaaaaaaatgattccaacttgcatatgcagctgtaacagttaatcttcaaagttcacaacgaaaatatgtgtaatattgaaagcaccttataggaaggaaacatgtatagaatgaatcaaattctaaagtaattaaacaggtgcaatcttttaacagtgtaatgcccatattttttattgagagggatggaccagtgaaccatcatctctgctagtagaaagtaaattccatgcataattctcaaagaatcagattaaaaacatttagtagcattatctgaaagctaaagaataatttcttttagtgcaacaaatgattatctctacattacattttaatcaaatttggaaaaatataggtacctgaacaagtgtaagcctagaatttggaaaactatcatcagctttatgaaatttattccttcgtttttgttgcatagaggatggtggatggttgggtcagcacctgaaaggaggagcatagtactaccattcacctaaatcaagaccaaatttcaaaagtttgtccaacttatttggtagtgccacatgttttttttgtgggtactgttggtacaaaatccaactagcgtaatcaatgtgtattctgtattcgatcggctcgagatgagcgaagtttacatatttagagcaagttcaatagtatagccaactattagctccaattcatctatagtcaatctaatagctcattcatacaataattacatactatactattaatacgcggtcccacctgccatacacacattgcgtcttggagtccgtgctatagctggttacaaatctgtagcccgcttctcttctctctccttatttatcttattaaaatatgtttgtagctggcttatagcatgctattgtacctgctcttatacaaaggccattgaaaggggaagttacagtgctatcgagatgaactgagtgactgccatgcaggccagctcttgggtctcttcgtcatttccctggggaataagttcatctaaggttccttaactttacactgaatccgattttcgttcttgaaccccaaaaccagatacaacttgtcccttaactgtcaaaaccggtgcaaacaaggtccctcggtggtttggaaggcggttttggctaatgtggcgcttacgtggctggcttgactaggtcttcgtcccacgtggcattgacgtggcgcttacgtggcaattctatcccagaaaaataataaaaactgtgggcccacatgtcaattacacaaaaaataataattttaaaatggtggggcccacgtgggccccacatgtcagcctcactcctcccttcatccctctctcttctctctttgttcttcctcatcctcactcccctctctctcttcttcttcccggggagtgccggagcggacggggcgggtgggcggtggagcaggcgagcgaggcgggctgtccgagctccggcggtgggcaacggcgccagcgacgggagcctcgaccgggggagaggaggcgccgcggtagctggagccggggtggtcggcgcggcggcgggtgaggtggtggtaggcgcggcggcggagagaagctgctgctgcatctccagcatgatgcagactctgctttccggattgcttgctattggaagaattgaggagtcgatcgactactattggaagagttgagctagataacttatcactgacagttaagctatagctattttttttctccatatctgaattttcttttgttgacaaaaccattgctatgcggccaattcatagatcatcaggcacacgttcaattcacaacaagtacttttctttgcgaatccacaatccccgctacgaccggctgcctcgccatgccagtatatgccttggcgaccccttcccgggctggtcgggagaccggcagcgtggtggtcggcgccgccgcggggtcttgcgccggccacatccccgccctcagtaccgctgccaccgctgtcgaactccatatccttctcgagtatgacggcgatggcgccggagtggtcatcctcgtcgtcggagcccgcggtcgagcgctccgactcctgcggctactggtccagctgtcgcgtgagcagccacggtcaccaccacgaggccgcggaagacgacgacccgtcggagagggaaggcggcagcgagggcgccgcctcgccgaggtcgccggctgcagtcagtgtccgaagaagagagaggataatggaaagaagaggatgacatatggggcccatataggtcccaccatttttttattttgtatgtgaaactgatatgtaggtctcatggtttttattattttttcggatcgaattgacacgtaagcgctacgtcggtgccacgtcagttgaagacagagtcaaattagccacgtaggcgctacatcagccaaaaccgccatgtaaaccactaagggatctcatatgtactggttttgatagttgagggacccgttgtatctggttttgcggttcaagcatgaaaatcgaattcattaaccagttaagggaccacggatgaacttgttcctttccctggtgacaaggttgggctatgcccaccaaggaaactgggccggcgctgaggaaatttaattttaacttttctaggggaaaagaaaaaaaaagtgaagcagatggttttctcaacagaaaaaataccaatagaaaaacaagatggatggtttctagatagagacaaagaaaaaaaaagaaaaagggaaagatcgactgtgtatagatggaaacaaaagaaataaaaagagaggcacgagagaaattgaagagaggcatgagagaaactgggaaggaaaaaatagaggagatcaggaggcactggagagaatttgggaagaaaagaaaaggtaaagaaataaaaggggagaacgggaggtgctgatttttcacgggagaaggaggagattgggaggaactgattttttccaggggagtggagattgggagagcactaattttttttcttcaagaggaagggagttgcgcgcgtgaggaggggccgagggggaggagaggagttgcgccgtgcgttgggggaaggggcggacaggagcgcggggccagcatggaagggcgcacgcgcgggagaggataagggcacccacaatggttatctataagctctttacaagagatctatgtcagcatatttttctatttggaaggtattaaacgaatagagagagcaaagctatctactaacttagagatagtctatagagaaaaacgaggcaatgcatgagagagctatagataacaatgtagacatactattaaggtggtttactattaatcgagtcaggtgaatgggagggggagggtttgggcttgttagttgctaaaacacctatgataggtatggcctcaataaatgcatgtttaaaaaaataaaattgactgcattaaaagaccaaaagggcatgaaagacaccatgtatataactttctagtttattgttgtatacaacgtgcttaattatattcattctatgactaatttcatgttaatacactgtcaagaacatcggtttaaaaaaaactagtcctatttctaacaaaacaatttgaagaacaaacagaagctcctagcgtactgtgcttccaactggtgcttcttctgcttacgaccatcttctccacatgataccgcggcgacatatgtacggtcgttggatcactaagatgatgaaccagcaacttatcccttcctatctttagatcttgactaagaaaagaaaggaagctgtcacgctacttaatctgcaaaacgaattggtacccgtcagaatataagaatgaattgaaataaattacacacgaatcacgctggcaaccgccggtgacggcaccggtgaacctcgcgacgataagtggcggcgacgatgaacctcatggacgaccggcggtggcgatgacaaacctcatagcaaccaacagcgtgtaacgtcgtggcaacgaagctagcggatgaccggcgacggcgacgaaaccttgcagacaaccggtatagcagccgtggcgaccaacctcgcggacgaccggcggcgtcacggcatggcgaccaagctcgcagtagcagtagcacagcatcatccaccatccattttgctttagaattcgtgctatcaaaaaactgagtattaaacgaattagcgtcctattcctatccctattccctaatccgatctgcgtccggccatcgtcttcttcttcttactgtgggagtgcaggcctattcttgttgggccctcaacagaactcggcccagcaactaaaaattctcacagcctctttttttttcttcttttctggctcgaaaaatctttttatttttcttttcgtttctcgaagttaagaataggacgcagttcttctctcggctctcgctctcgtcgggagaaatttggaccggcaattctgttcccaaaaaaaaaaaatcgtacaattccgcagcctaaccctagtcgacgcgaacctccagccgccggaagatgctgcgaccagcggcggcggcggcgggcagggccatccggcgagccgcgtaccactccgacggcgcccctcctccccgcaagctccggggcccccgattcagccctctcaacaggcacaaccacgaggtacctcagatctatagccttgttcgtgcacccatctagagtttacccacccaaatttagtgtagaaagagagagtttttcatgtcttgttcaaagtacgaattagtcccaaatcctcctggctcagaaacccagtccctccttgtgtcatctgtttatcattgcacttgtttcctcctgctatcttcaaaaatatcactacctttttcctgtgcccccaaccttacacacacacaaaaacaacaactagggattcaagtatttagttactgcctcaatattcatgtgcaactttccaaagtattcggttcgccttcttctgggattactctatacggttgttatgttgcaatcaaaagcacactcctcttgggtaagagatggcactactgtcaaattccattatgccatagattgtccatgcttatttatgatgaatgaatttgtacaattgagttatataatttcataaggtttcaggcgttgtgatgtttttaaggtgtgtgttaagcatctgtcacttaatttgcactagaattctgactcttgctgttaccacagattaaaagcttgtcttttgttcaagcctccatctctaatttatttatctctataacttaaataccttatcttagaggttcaattaagaacgctctcacaagaaaaggaaaagctttcttgcgcacagtgcacttgtgccaaatgatgcatttaaagccttcatcttttgttcctccttcctatgttgttcaaagttagtttggtgaaaccctcgtggctcagaaaacaatccctgtgttgttcacagttacacctgtttttcctacaaacttgggaaatcttttttcaccttttcctttttttctttttacaaaaatatacttgtcctcccatattgtcagggtttaactactaccaattcccaaatattcggttcaagtgccaacatcaaacttcactcagttttaaattcggtatttctgatgctgctgcaatgttataactaataatatgccaattgaagctcaccccccttgatgaaaataaggcactgtcaagaaagaacggagcttgctttccttctattatggccctctgaatgcatgttccctagattatatatcattgtgtacacttacttatgataaatgagtttgtagggtcgtgtttccctaagattttggctgtgctcactgtgaagttgtaagaaatccagtagttcttgtgtgcttatgtagtagcatctgaacatcttactctaaatttttcaattttaagttgttcttctacagttatacaaatattgttagcttgtttattgcgcaagcattcatatacaatgtttttccttgtcatagtggttgaattaagaatctttaacatcttaaagaaaggctatgtcgggcgcagcacacttgtttaaaaatgatagattttaatccttcatctttagtcctcgtttggaagtgatgaaatgtggatggaatcaaaatggatggtctacttgattaacacggtgaattaatatcttgagaaattaacttaacaaatagctagaaacaagtgttctaaacaatacagtagaagaaagttattttcagaaatcgtattttcggaagtgtggagcaaataaatcgatccagggtagattacagttgatcatcacttcagaaaggggccttagttttatggatgacttaattatcactgtgcgggtacagtgatattgaacgtgctaaattttatggagaactgcagttaaatataattcttttgtataaatctgatagcagatgtagatgtctaatattacgcacgttgatgtgcaggttgatgcgttgctcgaggaaatcaagaatacgccggttagcatgatttccgatgacttaattatcagaactgtgcggcagtacgtaaacctctgaattgcagcttctgttattatttgttgtgtgtcttgttaaccatcctaaattgataattactattacctgtccttgtctgcttctctagttctattttggctcgtcagcagattcttgttcaaaatgttctccgatcatgggttattgctgcagcagttctctcaggctattgctgggggtacaacagagtggccaaacgtcctgtggctggctctgaaccaccaacagaagatgaggtgtagaggacttgacagtgttttcttttggagatgggagtctagaagtctgggagaatcaagaacgtagtgaactaagcatgtgtcataatctatcctgtgtatcagtgactctgtgttaactataactaattagtcctagagctaattggtgtggggattctgtaatgagagatctcgttcggtttgacctgtacatgtttctctggttgcggattctgttgccgaaactgatatgtgtaatgggagatctctttgggttgatctctgctttattttgttgagcaaatttgcaagaagataacggtttttgcccttttttgaatatcttttgcctcctcacgaaaactgacacgtgctaggctagtttgtaaaaaactcctcgttatatacataatcttacatcgaccctctcaacacctgatgtctaagctgttttttttttaatataattgtgaagtgaaaaatctgctttcagggtagcactgtagacataaagagtataggggtgtttctgaaaacaatcttcccttgttccacctatccccactccgctagccaatcaggaggcatattcatcagccctcggtcgatcgtgcaaggtgggccgtgggctgaaggcggagtcgtggacgcggagacagaaacggcgtcgcttcagctgcaatttttagttccccccttcttttttttggaaaaagtacaccgaaggtccctcaacttgtcatcgagtcacagaatcctcccccaaccgtaaaaccagatatccggggtcaaaactggtcacaataggtccttcgatggttttgaccaggttttgtcgtacgtggtggctgagtcagcgtgggatctacatggaccccacatgttagggtgccacgtcagcacacactctctctctttcccctcctctctctctctccccctccttctcactcttctctgcctttgactgtaggccggccagtggggtgaggcgggagaggaggtcggcgccgtggcggctgctggcgtcggcgggggctgcgatgggggagaatggagggcgtcggcgtcggcggcggcagcgacatgggagaaggggagggcgtcgccgcacgggtgaggtcgaggacatagacccggccggcggctcggtggagctcctcggcggccgaagatgggcctggggaggcagtagtgacgcgggaacaacgcgggcgtgcagcggtcatgcgcgtgcgtcgttggcgcgtgcgtccccgacggagcgagcgagccgccactatctcccctaccagccacccacccgaggacgagctcccgcaggttggggtaggctgcggcggggagctcccatgcgccagttgcttaggctatggacgtccaggaattggactgcgtcgtcgacgtccttgccatcgccgccaccgccgttgtagaggcaccgccctagaagggcgccgccttgggtggccgtcgctgcttggtatgcgtcattgaagtagttggaccacctgaactcgtccagcactccggcgttgtggtccatcgtcgcgacggggttggcatgtcctaggttggtggtggcgacgttggcgcgctgctgactgctcggcgtcagtcgcggcggggctgaggtcgtccatggaggtgagcgtgctggagctagaccaccggtggaggaggatctcccaaggaggcggtggtgcatgccgtccgctgcctccgacgacgccacacttggccgccacctggcgtgccgcctcgtgcaggtgggcattagcgacgtcttcgccgtgcccggggacttgaacctcacgcttctcgaccacctcatcgctgagcccggcctccgcgtcgtcgactgctgcaacgagctcaacaccggctatgccgctaacggctacgcgtgggcccgtggcatgggcacctgcaccgtcaccttcaccgtctgcggcctgctgctgcacggccgccgtcaccgcagccattggttctggaatcaggagacgggcgacgaagcaggcgccgccttcaggaatcaggagcgtgccagcgcatctccgtcgttgccgtcggcggtagctcgtcggagtggctccgtcgtcgtcggcggtggttgaagcgtgtggctccatcatcggagacgacagcctcctaggaccggcacagttgaagcgtgtgggcgtggctccgtccggcaccgtcctcgtcctctcccttgcgcaagtgaattgggcagtcgtcgagctcgaggccgcgtttgctgtgagccaccgccgcgctccttccccgccgggcttgtcgtgcccactgcaccggcgacgcactccgtttctcccgcgtcgttgccatcgagcgacggctcgctcgctccgtcggacaagaggagaaaagtgagagagagatgagggagggagagaatgggggagagagagagagggggagggtgatgacatggcatcctgacatgtgcggcccacgtgggacctactctgactcaaccgctacatcggacaaaaccggagtaaaaaccaccaaaggacatcaagtgaacggttttgtaagttgagggatgtcatatatctggttttgtggttggaggacgattttgtaattcgatgacaagttgagggaccatcggtgcatttttcctttttttttttgccaatatctattttaactgggctttgggccagaaattttttgggtggtcaggggaccaccctttggatccgctggtgatgctgaggaacatgtgaattgactgtcaggggttaactcatcatctgagtctcatcccagagttgtaaaacctgggacagtcgttaagtatcatctttgaccgttaattcctgcataaaggaatgcaaaatataatatcaaattaagtggtagggtttactaaccgtttcctctagttttggtaagtatttatacgcaagtgattttttggatgaatttacacccgtcatgcaaagaaatatacctatatgggactaaaccacaatgcaccgtcttaggggcccacatgtcatcccctagaggaaggcagtggagagtggtggggctcacaggccccacctccaccttccacaatgatagttgtgggtacaccgacctccacaaccgccattccaaccgtcatatggttatataaaaggatgagctccagccgttgcacaacacacaacaacaaaaacaaaactcactttcatattttaggcatcactttattagtgtggaaaaaatagatagagagtgaggggaaggtctggaggaatgccggagttgtcggtgctctctcctcacttgtacctcggtggatgcttcatttaataaagtaagtgtttgagatttcttatggtatttaattagcatacttaagtgagatatattctcaccattgcagattcgacacttagtatttatattaagagcttgtttggttctttaccctactaattcattggcagtgctaaagtctaggcaaactttggcactaccaaaatattggtaagataaaattatttagttaacatttgaattgctgccaataaaaagccaaattcttatagtatagtaaagaaacttctagaatataaccaaatagaataggggcgctaccaaatatttggtctcaattcaaactaacacacaaactattcaatttgccaataaactagcatcttaagtcgtgtgttcacacggttatgacctctccatctattaaaatattgtttgtgttaatggacataatgtttaataataattaataataaatatgtttttaacattttttttaagaagtgtagctataacattaatggatttatatatcttgatttgtcattaagaatatcatcgtaacaacaaataatttatcatatattagcgcaaccattacctcctacaatatctaaaagagtcaattgtagtaataatgtaaatagccacatttcttacgcgttgcaattctttcatcaccagttgaaaaactgcatatgcaccagccttcaagatcaattgacacaaaataggggatgcaaactcaaagctttttcatctaaacgaaatggcaggagacaccacaatcacattcaaatgttgcaaacctcaatcagtttagttttgtcccatgaagagaaagggcaagaagttcagagacctgttccctccataaaaaaaaaaaaccccacatctgggtttgaatctagacataggtcggctatgttaagaattaaatccagaagtgtttttttatggagagagtaattgctttatcatgcaccaagcttttccttttcaagatcctacaggagatatgtgtgtgtatttgtattaaattgaaagaaagaaacagagaaactaagtcccaatgtaaagttgagaagccaaagattacaaatatgtagtccttaaaattccaaccaaccaacgaactatcatttgtcccagaccatagtgggaaacctcctctaaacttttccaccaaaaagaaagttgaagtttatgtattcactttatacccagtttggccaatccaacagaatcatatgataaatagggattgttgacagctgagaggccaacagtctggagaaaatctttgggaaactatgcagaaagcttatatgctttataacccatcacctcaattatttttttttagacaacaggtaattgcattacccaccttggaaaccaagcccagagacaatccatcacctcaactgcattcctgtttctagacaacatacaaaacaggccaccatacatacaaagatgaatgaatattggtacaataaactgacggggcatttgcgtttttaccctattttaaggtctaactaccaaattgaccttgctttcttcagtttgctattttgaccctctttttttaaaacgaacgttaggtctggccctattccgttaaggcaacataatggtgttaattcagagagaaatgacttttatgccctcactcatttgactctattttttcaaagttttttgcttgcctaattttgtgtatttttatctgaaaatgtgacattatttttactaagataagtgacaaatctaacttaggtttgagggatttgacaagtttgaaacagatttaaattttttcagacaaaattcacttagatttgatatattttcgacaaacttaacatacatttgacagatttttgataaatttcacaaaaaatacataatccctctacaccagcagcatgcagtcctccagaccaggagagcaccggctccgtctccctccagccgggcaagaacaaggagaggcgagagaaagacggagagcagcaatagcaaaaacaaagcagcaaaattctagggagagagctacaaatcggacgtccgatgttgaaaaaaaatcggatggtcaaatgtttcagttgaccgttggtacaacattaagttatacatggtgaaacaaaaaaaatcagcctataaaacatatagaaattttgtgaaacacaataagaacacatggtgaaacatattgctatcacgtatgaaacattaagcttttattgtccgaaacatatatttttctttcacaacaatataatcatgtgatatcttgttgtaaagatttaattataacgaattcaacggtgtgattgaatcgttcatcggataagtagtttagaagaaaaaagatttttaatacgactaaatacttgcatcatgcatggtgtggggagaaagctaatagatggtaggagagagagagagagagagaagaggcatgagttatacattggtgaaacaaaaaatcagttgttgaaacattgagttatatatagtgaaacaaaaaatcagttgttgaaatattttaaaaatttttatgaaacataacaaaaacacacgttgaaacatattgctaccgtgtctgaaacattaaatttaacggattgaaacatatgtttttgtttcatcggaatgtaatgatgtgatatcttgttgtaaagatttaattataacaaatataatggtgcgatcatatcataaattggataagaagttgaggagaaaaaatattctgaagaccattatagcatgtatgtatttgtgaagtggacagggaggtagtagtttatccgtccgatttttgttggttgcgtcgaacgtctgatcctaagcatttttgaaattctagcagcagccaaacacctgctggcgagctcccgcgccatcctcgacctgcgctgcatgcctccttccgcggccagtggcggcgggctcctgtgtcgcgcgcctcccttcgcaccccgccgcggccgcgagctcccgtgccacgcgcctccttccgcgcccagcggcggcgggctcccacgccacgcgcctctcttcgcaccccgcggtggtggcgagcacctgcgcctccctccttccgcacggagtagctgctgccgccgtctgtgcaccggcgctgagagatatagggttgagagtgactggataggattgggagtgaatggatagggttgagtcatgaaaggtattttggtcagtttgattaataatgtgatttttttcttttcctaaatgaaaccctaacggtataatagaaatagggtcagacggtaacttcatttttgaaaagcaggatcaaataagcaaactaaaaaaaaaaggtcagattggtagttaggctctgaaatagggtgaaatgagcaattgtccctaaactgatagtatgaaagacctacatccaaggccaccataacgactcaacattggtagaattcaccttgtaattgtcctttcaactggtgccaagtatcaaaccctaggatagataaactgatactaactggattaaggatttgagttgtgatatttcctatgcttttctctatcccaactctgctctgagctctgaaggactgaaggtgctcaactgttgatccattattttcactacagaattgcgacaactactcccgccccgggacgatctaagaaacccttgtagcactccaggatgaggatggagtcaggatgggaaggggagagtaccttcactggattggcggtggtggtgggttcgccggggccggttgagggcgtggccgccatggaagaggcgcggcgcgggcacgacagggaggcggactgccgtctggatctccgccgccatgccttcccttgggtgggtgtgtgtctccggcaacaaggcggcgggggctcgccggcggcgacggcggcgtggcgagaaaatgaagaggtgaggatgatgagaatcttaaagcaatcccagccgttgtaaatcgcttggttttttccccttaataaaaccaaaacaaaaggaaaagctggagaaatccttgtaaatgtatgggcctgggctgaatttcagggggccacctacaaatcatgcctcggtgtcatcatcgtgtttggatctcctatgacatttcttccgcgtttagctaccaatgtcgattttggggttggttttataataggtaaaatgaagcaaacaaaagaaaatacacattgattgagataagagtactagaaaattgttggcatgcaaacaatactttaatccgttcaaatggggcgctgtttcaccaagtagatcagaattgtttcactaagtagatcgaaattgtttcaatattttaaaaatctgaaacacaaccaaatcacctcgtgaaacattttgctacaaggtttgaaacaatggtttccaaaaaaatcgggcattgtttcactttatataaaaacaatgtttcagcaaatagcgaaaggatgtttcaatttgctgcaacatttgatccatagatagtgaaacatcatgagtacacttgtaaaacattgttggtggaaaaaaatgaaacagattcacttaatagagcgtttctaatacgtgggtaatttgttgcaatggcgcgtgtggtgaggcgcgtggtaggaacagcgcggaggcgcgggaagcggtgggcgcccgatttttttttgccactgatcgggcgcctgatcgctggcatttctgggatttcagtccaatcatatctcagttccagatacatgtgcatcaaatgtactgctctattggataaactttcttttataaaacttatacggattaaggagtaacattaatttaaggtatgttaaaaattgtaagtttaataaaaataataagaacaaagtcttgtctatctctttattgatggctagcttactttatagtttatacaagagcttctcaatatagagatgtagtaagtcttatttatcaggtcgtcgataattacatcggtgatgctagctttagtgttcaggacaccgacttattccgagccattcgttgtgaactataatagcggaagaatacataaatttaccttgggagccctaacttctctgtaatctcattctcactaactaggaactcaccatgatctactgccaatgggaggcttgtctaactttgcatttgctgggctttgcaccattttagtagcaaagcaacaaaggtttggtccatctaacataacacttctacgagctttgctacgagatgatgcgtattttaatattatatatatactagataatgctccgcgctttgctacgagatatatgtaaaatcaaaggtgtttttgattattattctgtgatgaataattggccattggagattattggttttgttatttggaatttattcacgaagtggttttggagatgattggatttcacaggtgaatctacaggttatcattttatgtgaccggtcagactgggctgtgtatgccggtcagaccggcggtgatcgagcggtcggactggctagcccgcggtctgaccggccgacactgtgtcggtttcggtgatggaccgggagtcggcttggggataagacgacgtccgtggtggtcagagatcatgcgggatacttaggctagagctgatgaaagtggttgatggagattccatatggcatacgatggagttattgtgtgcgtatgggatgcggagtcgaatttggaaggagtccaaatttggtacgattggtcatgtaaagtttctttcttgtattagtgggtttcctaaggtgtttaggactcctaatatgagtttggttcatggctttaggctgcctatctcatgtataaatagagggggagcgtgagtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagaaaaacggcgcagacgactccactccacaggcagcttgaccagggctacacctaatcctccacaccatcagcatcactgtagaactcttcctctgataaatgattgcaaggtgagtatatgacatactcagcaagccacgcagcaaatatgcaagtgcacaaggataccaaagaatggcataatatatggctcatttgcaaaagcagcatttagcaaacatttgagaattataaaacagtagagtaattaatcattaattttaatcaacactaaacagcacacccatgctgctcaggcccaaccatcctgaacaaccatacccggctgtacatatctatctccaaaccaggaatataccattccaaaccaggaggctaaacaaattattaccagttatagcatcttttattatgatgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccttataaacaaggcatggactccccagcgacccccgtgggcttatctccgccacttctcagtctggtgccccgcaatgaaccatgttatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgattaaccatcatgagctatcattaagccatcattaaataatagtgagtcataagttatcccaatagtgtgctaatgtttctaagcatggctaagcaatcatatctactatctagctgaaccaatatataaagctcaactagtcaagttatgataacccaaggtatcaaggaataaagtaatcaagaacaaaagggctataacaaacattaggttaattccacccaatgacattcgaaaataaatgcaatagttgaatagaaacaatagctttaaacgggatcaacatgctcaaagggatgtttgggatctgtgtgacttgccttgctggccttggaactcttcaaaatcttctcctgcaaaaacggactctccggaaacgtcggaatctaaacagaaaggagcaaaatcaccaaaacagcacacaaacaagcatgaacagtacatgtggatatttttaacatgtagatctctattttagaaaaaattagaaacttgaaccaactaaattcgagctaagatgaattagttatgaattttcaaagattaaatcagattaaatcatttatttagattttaattgaattatgacgcaataatgaattatttttgaaaaggaaaagggaattattgcgtcagcggctagggttcacggtgaaccgggtgcacggcggcggctcacggaaacgaacggccgatattgacccatccaaaacggacggccaagatccatcggtccacggccagaccacgagagacgacgacgatgacgtcagcggtgacgtcaccaccggcggcggctcaggcgcgcaaactcgccggcgaacgacggcacgacgacgcgaacggaggacaccaacacgtagagggcgacgcggcgaactcaccggtgaccaaaacaacggcggaagatcaacggacggcgatggcgtcgaggaagaagcggctgcaaccttcggcttgacgacggcgacggtcctccggcaacctacggcgacgacggaggggcggacgaggtcggcgacggcttggcgatcacgacggcagccttcccgagcgacgacgacgacaggatcggcggcggcgcacggctggacgaacggctacgacggcggcgctaggctacacggtgctagggctctaccggcgacgagaggcgaaggcgagggtggcgacaagtagcggaggacttggggggtccttttataggggttggaaggcggcggcgaagacccacggcgaccggcgacacgaaggaaagtctagggttcggaggagagagatcgatccgaatcgaactcgaatccacggatttccaaacgatttagccgacgattccaaaagagaaaaggtagaggagatcccgaagatcttttcccctctattgatttcaccggagaaggaaaggcacgagcgaatttggaaggagacggcggcgcggctcggctagggttccggccgggcgacggcgcgaggaggacgacgagtccgacaggtgggacccacctgtcagcggccgagcgcgcgcgcgggcggctgcgggcggactgggccagcttgggccggggagagggagagagaaggttttgggccgactttcggcccaaagccaaaagaggattttaaaaacctttttcaatttaaattattcatgaaatgcaattccatttattaaaaatacttccttagctcaaataaatcccagaaaaatctaggaattatagagttaagcaaagtatttaatgaaattttatctggccccattttatattggaatttattatttaaaattagatcttcttttctaggcttttaaaataaattctaataattccaattaaacaacaatttatatgtttaggatttttagggtgtgacagtgaggcttcccggtatcgctttagagagcaattgagttgagttttgagttagggtttcgagtttagtcgaaatttttgtaaggtgtgatgttggtgcactttgtaaacacagagagaatcaataaagtcatcatctactttaagagttcttcgatttgtgtttcaccgggtttcggcggtctaaccagcggtgcaccggcggtcagaccggcgggcacacggcggtcagaccggcggcgacaggagtcggcggcaggcattctcgacagttcgaccgatcgatctacatcggtcagaccgacgttcatcaggcggtcagaccggcgcaactacttcggtcagaccgcgatccatcgatttcgagggtaacttttattttcgctaaaagtttttggtttttgggtataccaaccattcacccccctctggttggcttagttcttgtgattcgttcctacaatatatgttagatattgtagaaatgattaaatgatttgaattgaaatattttgaaaatgatttaagattgatgatttagcatgtgtatgtttagctttagaatgaaataaattatagatataattactatatgcttgcatgtagatctgtatgtgtttagtgggtattatctttatagaaagaagagatatgaacatgtgtgtgggaggaaactaggataatgtggcctacatgtcaaagattgtaggatcaaatttaattttagagtcaaacatgcattagcatgaattattttattattaattttatcatcacacaaatctgcttaagtccgggggtcatatcaaaggcttacttctgctcttatattacttaccactatacacaccacgtttgtagaacatcgatcgacattcaaaaaccaggtcgttgtcatattaccaatgaaaaatacaacttatggctgtgctaatcccatcaaagcaactaattcaccaattaatagaaattacaattagaatgaacatcaaacagacaactatatataagtcaattattgtttattaatttcgaactatattatatatatatcacccatattcatatatagctaatatatatatctctatgtaccctattaattattatctttccagtgatctcaacacgaataagtaactacttaccgtgctaattaatccatcgaagcagctaattaagattaataattaggctacaaattaaccccaaattaaatcgatggtgtgcatgcttgtactacccatcatgcctcattgccctaggcaccatgtcatcaaggagccccttgtcgacgggaagaacactcgccggcggcgacgacgacgacgacgggtagccgccgcagctggcaacaacctgcagctcatggttgcagtgcagaggcagctgtagcagcgacgacgacgacgccggagtagtagcagcaagcggcatcgtcggcggcggcggctgcaggttgctgtacagttgttggtgcgcggagaagggtgcggcggccagggcggccatggcgtggatgtgcgagaagccggcggcggtggcggcggcgcgggggaaggtgacggtgtggtgggagtgttggccctcgtaggtggtgatgacgacggaggggtcgtcggaggagcgctccacccgcttcttcaccgtgcacttgctgttcgtgcacctgtagtagctcctgtttttttttttatatatacacacacatgttaattaattaatttaaccaagagattgattgattaatttatttgcaaaaaaagtttgggggctaattaattacatttgcagaagaaatatatacatgttggggggagatcagccagcttatattagcttgttacattttagggttcaagggtttaggaccaatgcatcatctagaatactactatagtaagtagtagtaactacacttaacaggtatactctctccactaaaaaaaatataagacttggtttgatttggtatggtctccaatgtcaaactttgaccgtcaatttctcccaaattacattattattggtactgaaactaaaaaatagatgaaagtgcaagcaaatacgaattcaacgattatctttttttttgtttctagacatatacatgattagactacttgttgatcaaaagttgtaaaatttaaatcttaaaatacgtgtgtgcgcgtcttatatttttaaacacagagagagagagtgtgtgtgtatacgttatgaataaaagccatcaaaacaactgcacatgctttatatccgactagaaaatttgtgcacaagagcatatagaagaaaattaatggtagttgcctaataaggttatggttgtattatttaataaaattacaaatagtctttactctagtgctgaaaggagtaatttgggggatatttctagcttaaaacatcattcaccgccattgtaacagccaaaaaccattggagtttgcatcataacttgagaaagatacgactacctaagtcaatttctatttaattagattatgtgatatcatgttatatatacatactagcattcctttaattatagcagtcgtcctagctatacttactgcaaccaatagttattaacatgattggacacatttttgttgcatgcgtatgtggctcaccgaaatgaaatcatagaaaatcaaagtatacaatgttaatcaaatccagaaaattaatcaacgcatttcattccctgagttgcttaatttgcttcgttggcatattcatgttcagaatcgaagtaccgtgattgtaattatgaaaaatattggagtagatacgcttttacaacacacgcatacaactaactaaaagtacgtcgtccttttcgttcagcccacaactttaatatgtgaacccactgtgctgatactcactcatagttgctgcactactgtatcaattaatcgagaatgaatgtatatatgtgctgaattaattatattaatcatgcatatcaggaactattacttaattaattagaagaagatcgaaattagagaaaccaaattaaagcaaagacatcttattactacagcatgcatgcatttgtaatactccatatatgaatttatatgtataaaatgtaggtaggcaccttggaaaaggactgttcttgacggctttctggccatactttctccagcgatagccatcctccaggtgatcgatctcgctcttcgtcatgaacgcgaaccgcggttgccgcgccctcttcttcccaggcgtcagcgacttgctcctgaacatacataaccacacgatgaaaattaatattgtagagaatttccgtcagaaaggtatatagttcagatcgagaatttaaaagttatgaaaagaaaactactactataagccatcaagtagaagtagctaggcaataagaaattatgttactgacgacttgcaatgaaaatgtcctaactcgatgcctaatactcctatatattcatgatcctgtcttaattaattaattaattacgtttgttctctcaccagatcgacctcttttgcaatttaattcgcaacctaattccaacacgtactcgtacgtacgtattcgtacttccttttgtagctagtgcgcattatctaggctacatgcatgcaccgatcgattaattggcaaatagtagtataaattaatgaaacataaacacttccaaggtactcatagatttttgctatataatatgagagattgagagtatatatatatacacgtatgtagagtacgtagtacgtgtctgaaaaatatacactactccagtacttaattatctctagcaaaaaaaatgaacataagctcacctaaaagctagcatatatatgtaaataaagacaagacaattcaatttaagaggaacacattaaattaattaggaaattataagcacatgtgcgatggaggtttagcacgcgaatcccggcgcaatgttcgaagaagattaaccacacaaacacactcccttggctagaagctagtagcgtctttttttaccgttttgcccctcggagaaatgcgtaaattaattaattaattatccacgtaaacgaattggccaccgttaaatcatctccatccaaacaaaatgcaaagcaaaaaaaaagaggaaaaactgaaaaggagatagaagagacttgaaaagttttaaattaattagttccttgtttcgaattcaattcaattttatagtatgctaagagaaccataatttggataatttggagggaaataacaagcgatttatcgagtaaattaaattaatctcttgcaacaaattaactgcgattaattattgtacttacgctgcctcggtggacgcggcggccggcttcccgccgtcggcgtcgtcggtggagcacgacgacgcggcgccgtccgcggaggacccggccggcgtctccggcagatccagcggcggcggcggcggcgtggccagctcgcccggtggatccagcggcggcagtagctcccccacggcgtcgacgacggcgagcccgttggcccagccgagctcggcgaatatggccgacgagtcggcgtacgcttcgtcggcggcgaacggccagtcgccggcgcccgccatggccatggcacactccggccggccggccagccggaggagcagcagctagctagtagtgcagcagagagagagagagagagagagagagagagagaggtcacttcacttgcttggcttaattaatttctctggattttaatcaacaccgcttggcttgctttgctccccatgagcctttttattttgtagtagtagcaactccagtgtcctcccttgtgtcgttagtgagctgctagctagctagctgtggtctctgcatttatttcactcctctctcatacgttctctccgtcgtaaaataaataaatctaatatatgatatggtatattttatatttttaatatggatagacacaccgtctagatttataatactagaatatagaatgtgttacgttccgtattaagtttgatcgtttcagaacggaagaaatacttattcatattattgtctctatttccttatgatgaaagttaatccagcctctttatatagtctggttcaattggttgagtaaccgtatattagtaaaatatacaaacaacgaaaaaaatataattagaacttttatatctatattattagcacggttcaattaaaagataaggcttgaaaataaactatgataaaataaatctctatctaatttaaattttttattgcggttaataaaatcaagcagacgacgtcatctctacaattatatataccctatattttcaattaaaataatttcaatgcatggaaatctaattaaacacttttagctaatcagatgtttaggagaggaattacaaaatttaaaatttaacaagtaagataatttagatggaatttccaatcttataattaatatttgctaaacaacttaaaaatatctaaatatttaagaagggacgaaggtgaattggttatagctggcgcgcggtactttttcttcactgcgaaacagcggtcatgatagtgaaataacgcaagtatatatgtgcaccgtcgatcttcattctgttcacacaactactcagctatagctgctactatcataaatttattcatttttacaattttcagatactgtttgaatagcatattggctatatatatagcacgtatacgtagctaacattattctagataatttatatagcagctaatgcatttatcaactagctagtagcctagtagtagtatattagctagctctctacagtattacacatataattaattaatcaatccggtaattgaagttggggacaaagatatagttcaactcaaatcgtttagtttcgcttaagtcaactcaaatcattgtcattgtcatatatacatcagctctcgctagcgtccaccgctcgtcacttaattttactccactgttaattttcatatactaatatcattctgaaattaaactgtcaaacccaaaaccttaattagaactaacttgtttgtattttgagataaattacttcagtctctcgtcatcttgcatcgatctttggacctctaactagctagctggctggatctctgtagtaattatattaattactacaaatacgtacaagcatgggaccaattaagagcaagtttaatattacatccaactactagcttcaaattatctatagtcaatttaatagccaattaatataatagttatctataaatatatattacaatattaatatctggtctcatctgtcatacacacattacgtctgagagtccgtgctgatcgctacaaatctgtagcccgctgcttatctccctcttcttttatcttctcgatatatgtttatagctggcttatcgtccactattgtacctgctcttaaaggggtgtttagatccagaggtgtaaagttttagcgtgtcacatcgggtattatatagggtatcgcatagggtgttcggacattaataaaaaactaattacagaatttgtcagtaaaccgtgagacgaatttattaagcctaattaatccgttattagcaaatgtttactgtagcaccacattgtcaaatcatggagcaattaggcttaaaagattcgtcttgcaaattagtcgcacaatttttgtaattagttattatttttcatatattaatacttcatgcagatattcaaacgttcgatatgatagggtgtaaagttttaggacgtgatctaaacagaacctaaattaaatcatgcatgcagtactagaccagtggaccaaacagcatcgagtatttgcagttcattctaacgtaacgtacgtactagccgataattattagtacggtattttatgagcaattaacgccaccggctacaaagaatagtactactccctccgtcccccccaaaaaaaaaaaaccagtcctaaatacgtttcagtgccctaattgcgatcgatcgatctaagttatatatatatattgaccatttaattatagttgataggtccggctcttatccggaatctcagattaattttctggatgtcgatcgctttgtcctcacgtccaccgatcgagcggcgccacacgttaatattatcaaaatattataaaccgaatttttaaccatattaaacaattggtggaaccaattgccagaacccatat

SEQ ID NO: 40601 - DNA, 9760 bp, Oryza sativa
aattaatgcaggcattcgtccaaattaaacttccatttttgaacggttcgtgaattcaaatcttttcaaatatggcatataggagtaacatgcatgtcaaattgcactaacacaattacatgatgagtttatagtacgagcactttgtgtacaggagtatatatatatacgatatgatatctagagtacatatatttttgctagttagatatatagcctcttcaattcacagccgcaggtccagccgtgcgtacgtacatgcgcattaacattaatgaaataattactcgcttcgccgagccaaataaaaagggtttaaaagtgaacagtaatttcgatactactccatccgtccttaaatatacggggttttaggacacatcctatataatatgtgggagggagggagtatttgctatatattcgatatggcagcacccagcgcccgcaccatccgcggccctttcagttttccgatcgattatgggtatagtactaaaacaacgaacagaaaattaacgagatatacggtagtgattgctttcgatatagtattaattatctccgttccatattgattatagattagcgtgctttttgaaagaatgaagtgaaattagataagagataattatagttagttgagaataaaaaaacaggtggaaaagtatctatatactcacttcgtcccaaaatatatataagaaattttagatggatgcaacatatcgtacgacaatgaatctgctcctaaatagatatggaggtaacaaagttgatgatatatatatatatatatatatatatatatatatatatatatatatatatatataaaacatctatctattatataataaaagtccattaaacttcctacaaacgcttctaagccgtcacgtggcatcctacaaatactcctaagtcgtcacgtggcactataatttagagaattctccagtggtccagccattaattttcattaaattagtggacccattatttaccaccattagatttatcaaaaaaaaatttcctaaccccaaaccgggcccaccatggacatgtacgtattactatatattccctccattccaaattaatctatatatagttttataaggttactcctaaatgatctacatatttgtattcatttattaagtctattcgttatttgtgcattagagtaaatggacattgatgcatgcatccatgcacacaagtatttataacccacatgtaatatattgatttgctattggctagaaaatagtggggatggtgcatgcatcgagtttgttgctagagtaaatatagtatgagagagttattagcttttcttggctttggtaaacctattaaatatataaatcgatttggaatggagggagtatatgtatacgtacaacttttttaaggatagtacgtacgtacgtactttcaccccttcttccctcaatttcttatatttttgcacatatttattctcctattatcatactttattagctagaaaaaaaaacttttgtgctgaacaattcaacaactataacatctaaatcataccacaaatttttaatccaccgttgacaataaagtttaactggcctacttaccgataaaattatggttcaggctcatcttgaggagcacgactatatcacgggaatttagagaattctctagccattgattttcattaaattaatggaccaattatttaccaccattagatttataaaaaaaattcctaaccccaaaccgggtccaccatggacatgtacgtattactatatgtatacgtacatttctttaaggatagtacgtacgtacgtacttgcaccccttcttccctcgatttcttatatttttgcacacatttattctcctattatcatactttattagctagaaaaaaaacttttgtgctgaacaattcaacaactataacatctaaatcataccacaaatttttaatccaccgttgacaataaagtttaactggcctacttgccgataaaattatggtccacgctcatcttgaggagcacgactatatcacgggacccatgaataaggcattagcgaaaactccttagcggcaatagtcggcttcacccgatcgtcagaggagtattcatatataagtttaattgttttatccaattaattggtagaagtggtatttttaaatatttatatataaatgtggacatctgtgagacatgggtatttgggtatgatgttgtcggtgacatggggccgggagtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaacagtcgcggcgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagcatggcaaggaagtcgctggccattgaatgaaggttgaaacgggcgtccaccggagagctgacaagcggagcagaagacgtgcgctgtgcttgtcagaggtcacttccggttgtagactagccctcattgtaaaaagaatgtttcttttcttaggcagctagaggcccatgtggtgacccctaaccagataaaaaggaggcccaggcctaagaggaggagataactctggccactcggttctagagtctgaactctctctcgctgtcgagctctctgtattccttcacacacagatccaccagaacacaggagtagggtgttacgcttctcagcggcccaaacctgtctacgtcgcccgtgtcttgtgcgattcttctcgctgacattccttagatcgagggcgaagaacctcacttagcgcccccggccgaaccggcaaaggggggcctgcgcggtctcccggtgaggagccccaagctccgtcagatgtggatattaacttttttatggtattaataatgtatttggtttattttttatagagctgcaattccatctatgaaaaagaaaatgaaaataagttgtggtgaatgctgaatttatatataaccggaataaagtgatttttgattcgatatgatagccattttgatcatttagtacatatcaatggtctatttcttatagtgaatatgatgagataatgcttcttttagtattgtttttatagacaataaataaattgcccgcgcatcgcacgggcttccgtcctagttgtaataatagccagtgagatctacatatatattgagtactccctccttttcaagttataagacgttttaactttggttaaagtcaaactgctttaaatttgatcaagtttgtagaaaaagtagtaacgtttttaacctaagacaaatttattatgaaaatatattcaattattgatttgatgaaactaatttagtattataaatattattatatttgtctataaacttagttaaattacaaacttagtcaaatttgaaacagtcatcttataacctaaaaggatggagtatataatacatggagtagcttatctttatctttacctattataaaagtttaagatgtttttgccaaaaaattttcgtacgttgtccgattccctcctcgcgatcttttttttttgcgatttttccgtgttattttcctgtccaactccctccccgttcccactcgtgtcgcgccacagcgccagtaccacataaggcggatgttgcacaaattcaaatacgtgtggcgccggtaccacataaagcggatgttgcacaaattcaaataccgatacaaaatccaatcggacattgaatctagagaaaaagaaaacgaaacaagaagattaaaaaaaccgcacaaataaaaaaatcgcacaaaaaaagcccacgaccggctcaaatcgatccaattttcttcattgagtacttcaatacccattcccaaattgaagatgaatatatgaacaacaaacaataatccccataaccttatttcaagatatgaacaacacatacaaatccttaagattaaaaaaacatgaataaacatgaacaaatcacatgagtaatttattatcatcgccatcatcactgcttctgcttctggtgtgggaggaagaacaggagggggcggcgtcaccatcgcacctcccagatcggcccatctccgacctccaacactaatggatcagacaagccaccgccaccagaggaaagtagaggagaagaagggtatttgtcgcacctgcagcccgttgtcgccgtcagctcgctaccatggcggtcgtcgccggttgatgccgtagccggtggcgggaggagtccgcaagaccgagtcgccatcgccgccgcctcgagtcgcctcgcccttgccgggaagggtgagtgcaggaagaggaggagatggagtagaagaggatggatctaggacgccggaccgccgccgcctcccttcccactggatccggcagaggggagggcgccgcccctgcccaccgcctcccctcccaccggaagggagggcgccgccgcttgccaccacccgtcaacatcgagccctcccgcggccccatggcgagggagaggaggcgagggacagagaggcgtcgctgcgcggaaggagagccgccgacgccgaggagtagcttgccggcgctgctccccggctcgttgcgcaccgctgctcctgctctctaggcatcattgccgcgggacggcgggtcgtgtgtagagggagagaggaggcgtggagaatgagagaggagaggagaggatgtgtggctggcgacaggagagagacggggaaagagagagagagagtaaacgagagagggtggatagagataatgttctttgactagaaacagtcacgatattttctaagtaacgtactgtaccagcttctgtttttcttatactccgtttcgaaatgtttgacaccgttgactttttaagcacatgtttgaccgttcgtcttattcaaaaacttttgtaaaatatgtagaattataagcctacataaaaatatatttaacaataaatcaaatgattggaaaagaattaataattacttaaattttttaaataagacgaacggtcaaacatgtgctaaaaaatcaatagtgtcaaacatttcgaaacggagggagtactaaaatggaatctatgacctagatatgctattgattgaattgaattccgctgaaaaattacagtgggctgagatacacatatatacttagtgttgttctctttaattattattttctactagcgaaaagactcgtgagttataacgggtgaaaaaatatttaatcataatatacgtttttcatgcataaccatgtcaataacaatgtttgtatggatcgtttgcagctgagacaataaaaaaattagaacatcttcaatgtaatctcgcatgtttttatttaattttttttacctacgatggaaatattttttttctcgcatatttttttattatttatagaagacagaaaacattattttaacgctttttctgactttttttcttacgtattttttaaccgtttttattttctcatgctttttttaagttgtagaatgaaaacttctcttttgagtagttatattagattagagatagagaaagatatatactgtctacaaaaacgaatagaaatcggacttcttttccacacttttttttccaccttttttcacacgtgattttttagtttatacgagccattttttcgtcactttcttaggaaatcggacaaacttttttttacatgtttttgtggtttttttatttttcgccttttacaaaatcagacttttttccatttttatgggaatcggatctagcttttttttaaaactttttttcacctttataggaatcagatttctttttcggttcggatctacgtttttttttgccacttagtggaaccagaatttttttagttgtttttcgctattttttttctcagattttttcctttttagggggaatcggatctacggttttttttcaccacctttttaggggagtcggactttttttttgttgttttttttgctattttttttattttgacggacgaaggaaacgttttgaaattttttaagtagtagaaattgctgacaccaaaatcaccaaaacttttctactattataaaaattgaagataattttaccagtactctggtacgtcattcgtgtataagttgatttttaaccgtattgaaaaatacagttcgttcgcttttgaaaatatagatctatatttgagtcgggttttaatttcgttcgcttttgaaaatacataagaagtcgtataagaaatctcttgaaaaaaaactcgcgtgctaacttaacatgatttaatctcttgaaaagaaaaacttgcatgacatgattttctagaaaagtatatatccaagcaaattctcacagtaaacaataataagattataatagccttcacccgttgcaacgcactggcatttgttttaatatagctcatattcagactatatgtttgcacagtagatgtttattgattcttacgtacacagtacgtacatacgtatgtgcgtacgtgcatgtacgtacggtacgcatgctcttcaatggcaggcaacgcatgtaatatgtatatatatatccggcgcctgctcgatctctcgtactgaaattaatttaacctcgacgtaagtacgcgtactgtttattacttgggcgcatatatgatggctcgtaattagttagtggtggtaagtgtcaaagtacactcctgtcagtagtgtacgtagtagtaaatccaccgtgtgtatattaactccagtgttaattgtgctatcacttgtggagaaagagtttatagtcccggttggcaaccctctgtacgaatccgggattaaaaatgtccatatttagtcaaaaatacatcttttgtcccggttaatgtaaccaactgggactaaaggcttttttcttttttttcttttctcacgttcaatatctccaaatcattataaaaataacaaataacaaatcacaccacacaacacaaataacagatagcatgaatcacatatagttcacatatcacatatcgccccatatcatttacaaatcacagatcacatcacaaatcgcagatcgaacagatcacagatcgcataaattatagtcattcacatcacattaagaaggaaaaaaaagaaaaaaaagagtaaaatttcccatgctggccaccgccggggcagccctccgcggccctccgtgcctccgccgcttgctgccgccggggcggccctccgcgcattcaccgccgggcttccgtgcggggcagccgccgctgccggccgccgccgccaggaagacatgggagaggggaaggggaggaggagaaggacgaagaggagaaggagtgaggaggagaactaatggaggagaagaaaagctaaggataagactgaggagggacagacagatcgacgcgccaagagataaacatcgcgccggcttggagtgatttttagtcctagttggtataaacaaccggaactaaaaatccaaccgggactaaaaataattggggcttgacacgacctgacaacttcttcaaccgggactaaaaatgatcttaccaaccgggactaaagattaaaaaataccccttagcttttaaaccgggactaaagaaactttttagtctcggtttttattgaaaccgggactattgtgaaatttggccgaccgaccaaaaatagtttttccacccgtgtaccatacatggacaccatccatgtatactccattattattattaagctttggccagcagtttgtagcctacctacctcttcgtaattaatttcatactctaaatttagttaattacttattagagggcgtgcttattccgttcgtttctgattaacatatagattttaccttaattttcattagtatattttttaaattgctaaatggcatatttcgtatgaaaatttaaaatatcatataaatctcgtttttaagtttgtagttaaaacttaattaaatatgtactaatgactttcttattttacatgcatgttagtacttaatcttcatattcagtattaccgaatggggtctcagaggtgcctatattgtcttttattatatatatacatggctcatgttgtattatacttcatgatgttcgttaacatatagcagtattttccaccgtcactagcttactgaccgcgggggggggggggggggggagattaatgtcagtaagatatacacatataaatcgttcgtgatttttatatgacactctctaattaattttctatataaggattatatacttatctctactactctaaaagataggtttgtccatccacccctatcatctgttctattcaaggcattccctctctcaccatgcatataggtcacatggaaatcaatatgggtgcagctaaaaattgtcacacactatgatcatattcaatctatgatcgtagattcgtagtgtgttatatctataatcctgttacaaatcacgacagacaccttagtcttagtaatttatttaaataatataaaccattacaaaatgactacttttactcggtcattcggtgattgattagttaatcgactatagatacaaagcaatcagtttgattaacttttaaccgcagtcatcaaaacaccgacactataataggagggtttttacttgtaagttttattcaggagaaatgtgagtggccggaggagttcagcttggaagctagcttctgtgttccaagaaccatacagaagacgaaatattcgccgcgtacttaaacttttcttaaaattttcttttaccacccaactttttattaatactccctgtcgattgatatatatttattttatctttgatttgactgcacacggattattactagtactgccattagttcccctcctagagcaagcaacattgtccctcatttcggtcccacattttggagaccttgcatggtgatggaagatacacgtacatttgctcctcccttttttttaatagaaaacgttattgatttttcaataagacgaatgatcaaacgtgtgacaaagagtcatcgacattatctattaaaaaacaaatgtagtatttaattactactagaaaccaggaaattacatgcattttcgaatgaatttgttcatttctcatgaaaatccttcaaaattcctcctttctaattaagcttctatatgaaatatttaacatgatttttttagaaagtgtactgattaattgatctataacaaataaaagccattttgttttactccaaagctctttggtctatgtcttcaaaattcctcctttctaattaagcttctatatgaaatatttaacatgatttttttagaaagtgtactgattaattg

SEQ ID NO: 40602 - DNA, 770 bp, Oryza sativa
tgattaaggacctagctagaaggcttaattagtttacacgtacccatgtgcatcagtccaccatctctgtatatgatttgggaataatgcatcatatatgcaggctacttactagcgtatataattttacgggatgaaacagattctgagatagagacctcacaaaaacaaatctatagagagagagagagagagagagagagagagagagtaatgagatcgatcgatataattgattgatgacccaataattataatacatgatatgcatgtacttgtcaatgtactgcacgtaagggtaacagtcaatatttttttttaaggacgattgtcatgatcaatactactatgatgtaaattaatggccatggattagggatatagtaatatctactagtaattaattaaccagctaagaaactccttccctctcaaaataaataaattaacctaatacggggatgtgatatatcttagtatttctgtttaaatttatagtattagaatacgtcacattaattctatattttatttatttattttgaggcagagagtagaggctatcaccttctcaatttacattcatatatttatattgtcgatagtactatagttcgtatagcctctataatttctgtatgcctcgtatatgtagggatgcatatatgtgtgtgtctggcttatgctaccgatcaacacagctacaaaggtactccaattagtagtattgtacatgcgtgcatatatattttagtttgtcatttatatat

SEQ ID NO: 40603 - DNA, 707 bp, Oryza sativa
atatgtggctacatattgattctagaagtgctaataaatactatgtttgcatgtgtttagtgggtattatctttataaaaccactaagcacacaaagttcaacatgcaagcatatagtaattatatctataatttatttcattctaaagctaaacatacacatgctaaatcatcaatcttaaatcattttcaaaatatttcaattcaaatcatttaatcatttctacaatatctaacatatattgtaggaacgaatcacaagaactaagccaaccagaggggggtgaatggttggtatacccaaaaaccaaaaacttttagcgaaaataaaagttaccctcgaaatcgatggatcgcggtctgaccgaagtagttgcgccggtctgaccgcctgatgaacgtcggtctgaccgatgtagatcgatcggtcgaactgtcgagaatgcctgccgccgactcctgtcgccgccggtctgaccgccgtgtgcccgccggtctgaccgccggtgcaccgctggttagaccgccgaaacccggtgaaacacaaatcgaagaactcttaaagtagatgatgactttattgattctctctgtgtttacaaagtgcaccaacatcacaccttacaaaaatttcgactaaactcgaaaccctactcaaaactcaactcaattgctctctaaagcgataccgggaagcctcactgtca

SEQ ID NO: 40604 - DNA, 4746 bp, Oryza sativa
tgatggccatgaactaactgaagagcagcgtgaaatcttgggtcagattagaaagaagaaggcattgctcatccaggagcatagaatgaagaagagaactgcagaaagtcgtcctattgttcctagaaagtttgacaaagacaggacattcacaactgatagaatgggtcgccaactttcatccatgggttttgatcctagtgcagctatggaccgagcccgcagccggtctagaggtcgcaagcgtgagaggtcactgagcagagctgccagtgatggtgatgatatggatatagatggccagcagtccagcaagaaattgcgcgcgttgtcgaggtccaggtctaggtcgaaatcaagaccacctgaggaggttgttccaggagaaggattcaaggactctgctcagaagaagaaggcaattaagaaagctaaggattctgtgaggaacaggaacaaggaggctcgtcgcggagaggcggaccgtgtcattccaactttgaaaccaaagcatctgttctctggaaaaagttctataggcaagacgagcaggcgataagtgattcagcacagctgctggtcatcactggtttcaggtaggtggatgtggagcactacttataaacacataatttgtgacatgaactcaattatttctgggcttataactcatgttctacttgctcattttgtaggaagtgcagcatcattgcagcatggtgtgggaaattaggcgaaggaaggcctgattatccaatctgctggacttgttgtgctctgtttattcatactgtctgatggattgctgtgtatcccgtctcatcctctgccgagacataattttgttagcttatgttgtagctttacgctacattaatatggtttcgctagtattagttcgttacatggtactatgaaatactactcctgtaatggtgactttgttattatacttgaattccagtcctattcgttataattaattctttataataagatatcacatgattatgttttgacgaaaggaaaatatgtttcaaatcgttaaaacacgtttcatatgtgataacgatatgttttaatatatgttctcactgtatttcacaaattttttaaatgtttcatcatgtactactagggcccgttcgaatccaattaaaagggtggatggaattttgaattaaagtggcacgtttttcaaactgctaaacggtgtgttttgtgcgaaaactttctatatgaaagttgttctaaaatatcagattaatctattttttaagtttgtaataactacgtgaaacacttaatctttatcttcatcttcaggagattcaaacaccacctagaacatttgatcgcctgatattattttagaaaaatcgagcactgatattattttagaaaatcggacgctcgatttgtagagggttcacagcaatagatgtaatgttctgaaccaaattggataactgtatatagcccgttatcattcgcagaaataactaggactgcagatgagaaaagaaaaacaattactacttacaacgccgaccgaggtgaataggactgatgaatattactccctccattccaaaatactataaggcataatcacccataacccaaaaaccaagaaaataattattatcatcttgtagtttggatcatcctaataaatataatgtatgcatccaataaaattagagaacatgagagtgatgtatttaaaaaagtaataatttaatggagaagaggtcatatttaatagcctatatgcatgtatgccttatattatggaacatctaacaaaatgattgtaatggagggagtaataagaaagaaacatctgatccaagtccaagtgcaagtacagtatttggagcccatgatcgggcgggcatatacaaagaaagcccaaaactaccttagtttagctgctgggccgagtgctattgggccggacgaacacgcagacgcaacggagatatgtatctggagtcgaagcgaggccaacacgtagtggcgacggtgggaagctatggtggcgtggacgctacgacctgcggcggcgggcagggccatccggcgagccgcgtaccactccgacggcgcccctcctccccgcaagctccggggcccccgcttcagctctttcaataggaacaaccatgaggtgtgtgtgtgtgtatccatctcccttgataataacctagttcgttcttaggtttcgatctagagtttcccctcccaaattgaatagaaatatatccttttttttaagcctactgcctctgtgctaatacctgtttcatcatcgcgtttggttgttccccaactaggttaaaaaaagatggatttatttttgcttttcttatttcgaaattatgcccgtaatcccatatgttgagtatttaataaactactaaagatatatatgctcccgcgaaaaacacacacacaaattcttcaactaactagattcaggtttttcagattatgctgcctgtaccagtacgactgttatctgtttattgtgaggggaggagatggtattattccgtaatatgacagatcattctgcagttgtagatgatgcattattatgttcactaatgctcttgtgcttaaccatctcaacactttgctctagaattttgactgttagcactgttaaatttcattatgccgcataagagtgcaatccccctaagatgacaggtcattgtgcacacttgtttgtattgattattgaatgagttcgtatacgtatcattgcgtttcataatttcatagggttttagctgttatgatgttgctcatttgctgtagcatcttgacactacgcactagaattactcttgctgttaccatcgattaattaaagcttgtcttttgttcaagccttcatctctaatgttttagttttataacttcttttttagttttcccttccttttttattttaatttatttgtttggcaaaaccctccatgctctgaaaataatcctgtgttgttcagtattactcttgtctcccctgctagcttgaggggaaagaaagagagtgacatttttctgttcttacaaaactgtacctgttctcccgtatacttggggtttaactactctcaattcccaaacatttggttgaagcaccaatgccaaacctcactaaaagttatattcagtttttttttatcatgctgtactgttaaattatatgccaattgaagtgcactcctcttgatgaaaagtaggcacagccaagaaaaatggtgcttgctttccttcaactatgtcccttagagttcacattccccaggatgatataacatggatgagtttgtacaattaagtttgtttgggtcatgttccctaagtttgggttgcagaactcgtagggaatcgagtaatgcttctttgcttatgtagcatttgaatatcatactttataattttcaattctgaacagtgtgcttttagctgattaaaagcttggctcttgtaccagccttcacatccaatgttttttattcatctaacttcaactccttaccatagagattgtattaagaaccattaacaccagaaagaaaggcttggttgggcacagtgcacttgtgtaaaaggatatagattgccatcattcatattttgttttaattgaacagtgacatagagcgtgtggaattttaaggagaaactgaagttaaatatctgagtctttttgtacaagtctgatagtggatgtggattacaacagtacgcatgttgatatgcagatcgatgcgttgcttgaggaagtcaagaatacaccggttaacatgatcaccgatgacctaatgatccgaaccgtgcggcagtatgtaattctgtgaattgcagcttgtgtttttttggttctctatctggctgaccatcctatttactactgctcttccttgtctgcatgtgtagttcttttctggctcgtcaggagattctgtatcaaaatgttctgcgatcatgggtggttgtggcagcggtactcacagggtatagctgggggtacaacaaatttgctgaaagttctactgtcggatctgaaccaccaaaagaacatgaggggaagtagaagacttgacgattgtttttgctctttacggaagactgagtgtttgggataaaatgcagtgaattgtgcctcagaaactcgcttgtaaattggtcaatttctgttaactgactatcctgtaagacagggcttgggcgaccaatcttgctccgccttttacaatctccagctggtttggggtgtttcatgctctagataggctgctgctggtcgataatcaacggatgctctttctttttatagttaactcacaaggcagcttggtattacaactaaacaagtatatactgacagtgagaagaattaatttaaaaaattcagtaccagtaatgagtaaaataagcaaatttaaggcactacactaaaataaccaaagttataagtgtagcatacaactagctagtaagacagatacagtatgatgatatacaataatccatccatcttcagtggttgctctagcttgcttaatttgtattttaatgtatgacgccgttgactttttgtcaacgtttgaccatttgttttattcaaaaattttgtgcaaatatgaaaatatttatgtcatgcttaaagaacatttgatgatgaatcaagtgcacaataaaataaatgataattacataaatttt

SEQ ID NO: 40605 - DNA, 1457 bp, Oryza sativa
  unsure (1)..(1457): unsure at all n locations
ttgaaatttggtagcaaattaaagataaactaaatcaccagtacacgaatagctcacatagagcattcttggaggatggaacaaaaaaaaaacaaatatcttccaggtcactagacacgttaaatacaaggggatcaccacatgcttacaacacacgtactgtaatttaattagctggagtacataatactccctccgttcaggttataatatgttttgattttagtcaaagtcaaactgttttaagtttgaccaaatttgtagaaaaaagtagtgacattttaatctaagacaaatttattataaaaatatatattcaattattgatttgatgaaactattttagtattataaatattactatatttgtctatgaacttagtcaaacttgaaacagtttaactttgatcaaagttaaaacaacttatgacctaaaacggagggagtaatggttacaaacacaatgcaagtcgatcatcacaaaatatgtgtcaggggcaattgcgcaacggaccatattctaaggactaacgtccagttctatttcggctcgtcaggagatgcttgttcaaaacgttctccgttcacgttcatggtttaactgctatcagagttttcagacattctgctattagctctgaaccaccaacagaacatcaggcttttatatatatatataattagctctgaatgtagtgaagatgagcatgtgacataatcgaacatcagcatttttttatatatatataattagctctgaatgtagtgaagatgagcatgtgacatgatctctcctgtgtatccgtcactcttgcgtttactatatatggttatgtttgtcaacgccaggttgtggaggcacttgttcaagacagaaacttcaatcaggttttagattgccaactgagagaatcaaccacttcctttatgacattctgatgaccatcattcaggattcaggagggaattaaaaaaaagtgacaagcatttcagagaactcgcaacagcagctaagttacatgatataaaagggaggtcccaatcaacaacgatttaaatcatagacggtccaaggttaccacagcttgttagaggcatttgattacagaatcatttccagtccatttggaattgagtactattactcttctagtcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40606 - DNA, 743 bp, Oryza sativa
gtctagataacagaatgttgctttagtttcatttatttttcatatttagaaactattcagtactagatgatatatttttctgtgcatgcaggctttgggatacatacttattgcaaagcctgattttatgctacgtaaagatatctcaaccctaatagagtcatcattgtcttctgttgttgattatagattaaaggtatacactctcttttagtaatatgtaatggcacatgctctgtatagactgtttaaaatggaccctcctgtccagattcaaggattgcagaacctttttgagtatctacgtgatgcggaaagccagctcaatgcagagagtactggcaagcctacacccaatgcaacaaacggtggaagtgaagtgcctgttgctgcaggtgctggagatactaacatatgcggtggtattatccaattatattggaattctattcttgaaagatgcttggatataaatgatcaagtccgtcaaactgcactaaaggtgaattagaccaatgtgcatacttttacaattgtcctttatattttacaatataaacaataattgtttttttttagattgttgaaattgttctccgccagggtttggttcaccccattacttgtgttccacaccttatagcactagaaactgacccactggaggggaactcaaagttggctcatcatctgctaatgaatatgaatgaaaagtatggtgacctaccttctcattcttatgt

SEQ ID NO: 40607 - DNA, 6560 bp, Oryza sativa
aaagatacactggaagcacgtaatgatctgaagcatatggaacaacgcggcgaccttcacccggaaccaaaggagaaaggaagccattacttgagtccagccagctacactctaagcaaggcagagaaggaaagtatatttgaatacttggagagcataaaggtaccgtctggatactccacgaatatcaagcgaataataagcatgaaggagaagaagttcacaaacctaaaatctcatgactgtcacgtgttgatgacacaactgctaccagttgtaataaggggtatccttccagaaaatgtccgggcaacaataacaaagctatgtgcattcatgaacgcaatttcgcagaaggtcatcgatccggatagattagaagcccttcagaatgaagtggtgcaatgtctcgtcagttttgagttgatatttctaccttcatttttcaatataatgacgcatctgctttgtcaccttgtgaaagagatccgtattctcaggcctgtgtacctacacaacatgtttcctttcgagaggtacatgggcgttctgaagaagtatgttcgtaaccgtgctcgtccagaggcaagcatcgccaagggttatggaacagaggaggtcatcgaattttgcgcagaatttatcgaagaccttcgcccaatcggggtacctgaatcacgccatgaagggagactacggggaaagggaactctcggaaggaaaagcaataatgacggtagacaacaatttattccgtaaagcccatttcactgttctgcaacactcttcattggtagctccttacatcgaggagcacttggctctagttcgcgccaggaacatcggtaagtccgatgcatggattacatggcatcacattgatactttccccacgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatgcaacaactgccacgtattacggtgccatcgaggatatatgggaacttgactatggtcctctcaaggttcctttgttctggtgccaacgggttaggttgactggtggaggcataatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttctcccaggcaaaagaaaaatcgtcggagctgaggacaagactgacgaggattacgatcagttggataggcaaccccctttcacggtgacgattgaccctagcatcctcctatcaaatgaagacaccccttactcacgcagcgatcacaaggagggaacaatagtaaggagaaagtacgtgcggtcaatcgtcactgccgatgtaatgccgtaattattgtgtacacgatgtaaactattttggatgtattgattatccatataaatcaattgatgtatggcataatttactatcattcatatgctacatttaattgaatatcattcatatgctaattataattgactagaaaatttttaaaagtattaaatcattcatgtggcatttacagatgttaattagagtttttcacaatttaatttactatctttcatatgctacttatatatgactattcgaatttttaaaagttttaaatcatgcatgtggcatttacatatgttaattagagtttttaacatttaatttaatataattcctacgctaagtatatatgatgattacaatttttattaattttaaatcatgtagtatgtacatataaatcttaattagagtttttaccaatttaataatatcattcatatgctaagtatatatgattattagaatttttattaattttaagtcatatatttgcttattacgatttatccacttaatttattacagacaaaaataatttttcaaagtaattgtcattaatctttgtactttaaataatgttaatgcattaacttctattttagaaacacatatgtaagcaaaaataatatgcagtgctataatctttagtccaggttcttaaccctaaccgggtttaaaaagaatttggaaatagcgggaaaatatatttagtcccagttgatgagaacaacgatctttagtcccggttattctcaacaaccgggagtaaagatatctttacttccggttgttctcatcaaccgggactaaagatcgagggctatatatattcccgaagcgcgccctcgtcttctccaccaacacttaacgttttcggtcgatcgatctctctcggcctctctccttcgccgccactgcctagggcaaatccccgcgccgacgccaccgtatctcaccgtcgtctcgagctcgtcgtcctcgccgccacttccgcctcctccgccgccgccgcatctttggggtgagagccgccgccgcctctcccttcatcgatctccgatctcgatctctctctccgtcgtgccgcccgccacgagacgccgtgccacaacgacaccgcgccacgccgacgccgcgccacgccgccgccttcgccgccgcgcgcgcaaccccgccgcctccacgccacgccgccgcgcaacgccgccgccgcatgcaacgccacgccgccgccgtcgtcgccacgccgccgccgccgccaccgccgccacgccgccgcgccaagcgccggaccgatgccgccacaccgccgttaacgaacacgtgaacgagaacgaacacgtcaatatacgttgccgcgagaacgtgaacgagaacgagaacgatcgaacgaaggagagcgagaacgagaacgatcgaacgaattaacgtgaacgagaacgacaacgaacgtgtacgagaacgaacgtgaatgagaacgagcgaatgaatgtgaacgtgaaatgcaatatatatatatgttacttcgcatttatcctaatacatattttttgtatcttgcagaaaagacgtgttgtcggagtcgtccctcaagccggagtgaagagctagccctagaaggtattcgtgcaggcaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgatttttaatataagattattttatttgtaattagacttagtatataattactgactacggaattggtgcgactcctagcaattgacaatttttgtcttaattagacttagcatatacgacagttacacttagcatacatgactctttcagtcttagcatgtaatattatttgagttttaatataagattactttatttgtaattagaattagtacgtaattattgactacggaattggtgcgactcctagcaattgactattgtagtcttaattagacttagcatatacgcacgaaacacttagcatatacatgactattttagtcttagcatgtaatattatttgagttttaatataatattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaatcagtacttgaacgagaaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataatggaagtggaagaagatggacgtcctagtgccccggccgtagccgccaagaactatgtacgtcacagcggttgggttgtgcgggataacgtgcctgtcagtacggtgtactggcgaagaacaaggacacgcggagatcatgagagctttgtcctagattcggagaaagagatgctgtggaccataatgctcgagacattcacccttcccgcgggtacagaggacaaagtgaaaaggtggactctgaagaaaatggcagaacagtttcagagcttcaagggagagctgtacaagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcactacttggggtcaggaggctatagcgtcacgatgccgaagtgggaggagatggaggctatcttgattgagaggggtatcgaaccggcaaccgccaattggccggaacgatcgaagttctggtactatgctcatggtggaacgctcaacccagctgatggctcactggtcttcggcgatcagatacgagaggctgcgcgacgactaacagatgcagtggaagcctcctctcagggcacgttccgatcggacagatatagggacgagctgacactcgccctgtagactccagagcatccaggacgaacacgagggaaaggggtgattccttagaagattggtttcaaggaggacatccacacgtacaggagtcggatgaggagtaagagagataccgaggcgaagattgcagatctagagttccgggtatcgagctacgaactcagcatgcaagaggaggtgacaaggaaggttgatgaacgcatagccgcacatcggtcccatgatccccagccgaccattcctcctgcaatgatgagcccgtcaggaaaccgtagcagctgtgccttaacggggcaggtaggattacagagcatggacgccattcaaacacaggacgaatcgacctgtcccgttgatgacatcactcagcagacaccatctgagctgcatattccttacaagaacttatcaataaaggtaagctcgtagtttatatattttagatttagccattccgctagttgctgcttatatatgttgattactaataaaaaatatctcacaacatgaaggtggcgtcgggcatggccatcccaacggacccttcaggtacttaccactgcaggccgattccagcaggatactcgaaggtcgaagttgagttggtcgaaggcgcatacgaggacctcgagctggattaccctggaggagacggtgagacgcatctacgagacacaagccatgccattattctatggcgcaggcggtacatcatcctccctgggcgacaagcggcgtctcgtgcaccatctcctcctcaggatcttgcaccgtctcctcctcatgatccgccagcaccgtctccaccttaggctccagcaccgactcctcctcaggatcctgcaccgactcctcctcgggctcctacacctactcctccgcaagctcctcttccggcacctcaaagtcaagggcccccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcgaccaaaccaggagatcgagccgttggtgaccggtaaagaaatgatgatagaacaatttattactgacaccggtctaactacggatcaattgctaggagtcgcaccaatcgaaaagacggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggaca

SEQ ID NO: 40608 - DNA, 918 bp, Oryza sativa
attcatcgaccctcggaaagtaaacgtcgcaatgctcgaccaatatccacaagaaacagaggcaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaagaatttatcgcggcggttcaagaacaactcatgggattcatcaacgaagaaatccttgatcccaagggtgaattctactacgacggaaacacaattcaccggtccttagcttctgagct

SEQ ID NO: 40609 - DNA, 6738 bp, Oryza sativa
  unsure (1)..(6738): unsure at all n locations
ttgtcttcctaaaaaatgtatttcctccagtacaaatagatgatgcttttagcaagcaggttttggtttgcaaacatttgccatttagcagtgttgtggaagtcagtcaccatgactgtttagtcagctgtctaaatggaaacgttagccaaactgtatcgtatcattgaaccggtgtgccagtaatgtttcagagcaattatgcagccaatggcattattaattggtcattttcagtctaatcaggagctatagcttttctattaaactaatgtagacttgcagtccagttgcacaattgcactcgtttcatggacaagcctggtggtattaatgcattaacattggtattctttcagcaaataatgatgttttcatgatacattcagaaaaatgtacagatatttgattaaggttctatatgtcctctctactattgtcattaacacctaatgtatatgctagtgtgaacgacaaaaatctgtacaattccgcttaatcatctgtattcccactaataacttggcggcaccttgtcggtccgacacccatattctgtcttttgcaacactgccatctagatgtttcaaggcagtattttccaccaaattcccctgtaaaatgctacatggtattttgcaccattgtaagagcattttcatggacatatccaagcaaatccacctaggatgaatgttgtaatgaatagtggatgcattcaacatgagggctctaggcctacaagatcgagagtcctggatgaatactagacaaaagtaagagacctgacataaattcctacaccttaacaaaggttgagaagagttaaggaagggtaaggaatggtagttttagataactataagttggtgcagatacaaaacttttgaataagaaccacaaaatatggagagagggtctgtctggcaaacgggtcaggtctattggagagggattgttagatatgtagtattaggttggtttgatgggaatttggatacttatcttaggacgatctgtttctaggacacagattatttcttagggggggtcaagtagagtcatccatatagaaggggactgcactatcttcttgaatgaaccaaagataataaacaagtccctagtccctaaacttcagttgcgatcatggaccagcaattctagatttgttccccaactcagtgccctccttcacccgtcaccgttctaactcaagtttccatcatcaaacctccctctgaaagatgtcattagatgacatgtagtagttatatgcatgtgtagtgatattactttgcttttagacccaactcattggtaatgcatgcagcccgaatgcccttaggccttagggaattcttcatttcagcaaacattccttgtaaaggtgctaaaacatgtcaggtaaagaacctatcagtaccaattcgagcaaacataagattcataggactccagtgacctttgctaatacaaggatacaaagacaagctgtagaatatagtcagactatcttttactaaactagaattctatgtatagctggaatttatcagctcttatacatcaggttaaaagaaaaggtttactctttagttaaaatgtccttgctatgttgcagatcaggaactttctggaagactgctaacagagagtataaaagaacctagtggtagtggtgaatctgccattacttagtggctgggatcttccaaggatggatagtttctaagttatatgtctttttttatgttttgcttgcaagttatgtgtcttttcgaatttcaaacaaagatataatttctaagttaagaaacttaagatatattttttgaaatctgttgcaaggcacaaatattttgctagtactaagaaaaaaaatgatatgccaaaatgcgctgttaatgaaccgagaaatgttaaatgctaacttacaggcatatccggaagcaatttgtatgcaagggccaggactcgggacccctgtcgagtgtattttttgtatgtctccacatatccagcgggtaaatcaactaacctctcctgaatggtctctggtgcaccctgaaccacaaaataagaggatacttcattaaaggtttcttgcagaaggcctagacagaaacgttgagcaaaaaatgtttaaaatatcacaagatctaaaataaagaaagtacagagtaatgcaccgagctagctccgaaataactagtatcaagattttttttcgctaatagatttccctattaaatggtcactaatgcatccagaagactgttgttcaagcaaacatatctattgcagggtgcttgcctgatacacaatattttttatgaactgttaattagtttaatgtgtatcatagttaggcctcctttggaacatggggatttctcctggttcctgaaggaattgaacgaattcaaaggagaccttatatatttaagagtaaaatatacggccggtccttaaagttgagcgcggatatcacttaggtccatgatcttgtaaattgcacatctaggtccaccatcttgtttaagtgactcattgaggtccaaacctcgtttgaccgaagctgaccatctacgttgcattccacgtagacagctaatttgcaaatagccccttcgcgctacagtagagccctaggcacaaaaaaaatccccaaatccctcggccacctccatcgtcacctcgcccaccgccgccgcaagtcgtcctcatcgccagcaccttcgccggccacgtcataccgatggccgagctgatgcggcgcctcgtcgcgcaccacggctgtgccgccttgctcatcacgttctccggcctcgcctcgcctcgccaacatcagcgtcctccgtcgacgttgtcgtggacctcgacaaagcggcgcatgattgccaacgacgcagtattagaggggatgaagcaagtggcggacgagctcgaagatcaggacgccacgccgtcgtggacctcaacgaagctgacgcgcctcgccatcgttgttgttgccgccgccatggtgtcgacgtcgacgtgctgccccaggaagaactcgtggtcgttgaggatgtcgaacggcaccaactccaaggacggcacaccgccctgccacagcacgtcggccgtggtgccggtgctggagacgagcatcaccttctcgacggcgggcgtcgtgccgccccaccgcgtcacccttaaatccttcttgaagaacgagcgacgggcgaaacggcggtgggcaagcgcagcggtgggctgcgggcggagcggcggcgggcgaatgcggcagcagttggcgggcggcggagggagccggaggagagcttgcggagcgccgtcgccatgaccatggtgggcgagctcggagctccgtcaccgtcttcatagctagcgcgccggtggcgctcgcgcctaactgacagccagatccaccggtccccttcccgctggttgttggcgccagaggcgtcggcgagctcggcgcgcggcggggggaggtgtcgccggccgctcccggggggaggggtcgccgaccgtggccgtgcgtgtgggggaggcgtcggcgagcggggtgggtgcgacctcaacggcggcaacggcggcagggcgagctcgacttgagcaactgccacagccgcttgccgcgcgcgccagcggccagccagagcaggggcctttcccttccactcctccttctccttcccgtcaacgacggtgtgcggttcctctgggcgctgtgcaacgccggtgagcagttgccggaggggtacgaggcgcggcgtggtggagacgggtgggtgccgcagctgcgcgtgctgacacacgtcgccgtcggcgcgttcctgcgtgcgccacgcgaagaagggattggatcggacacgggaaagcaaaagggggggcaaaatgcaaatatgttgccacactggaccgccacgtaagccagtcaacccggtcagagatcctttggacctcaatgagtcacttaaacaagatggtagatctagatgtgcaatttacaagattatggacctaagtggcacccgcgctcaactttaagaaccggccgtgtattttactctatatttaattttgtttgaatgaagataagttctaacatgacaaatggtaaattattcctttgctgacttctaattttcttatgatttcaaacaaagagaaaagagccaagcctcgaataggtctctttggatagccgctcaaaatttagtgtaccctagttaatatccatctaaaacatatgtaggataacaaggtgaattcttctcactattcatttggttcaaaccaataataaatattcataaacatgtagaaattcaaaccttatgaaaatcacatttgttttggttgacttaaaatatctaagaacaagaaatcatgccaaatgcatgggcacactgggccaaaaccaaaagaaattgtttctgaaccatcctaagcagcaatcttactaacaaaagaaaaaagtgtaaaacatttatgtagtctctcggaattcctacctttatgaaagcataatatttctcatgtatactgacaacaacagacattctcttcaagtgtgaagcaaaatggtatctgtgtacaatctttacaggttgaccaccagacctgcaatgaagatgacatcaagtaaaataaataatagaatatctttttactttggaatcaataactaataactgtactggtattgacatttcagatatatttggatgtaatacatgcaagtcaatcaaacatcgaaatcctgcttttgatagaaaaaacatctagtctatcatctgtgtacaggactttccaatgctataaacagagccacagttgtgcatataacaaacagaagagagaagagaaattgtccagagagaagtagtccactataatcttggatatatgaataaagataaaaaattactcctaatacaactagcttgacttcagagaagggacaaagttggcagcatgccacataactgacaaggtgaaataacactagtgttaaaaccaatatgaaagtttatttcgcttgactagacacacagctaatgttcagttttacaaatctacttgataacacttaattaactatgacatagacattattgtctgatcaggtttaggtcatcacatgaacagttctacaatgaacacatatttacatctgttatttcaggcaacaacttactttttagatatggccttctcatcagatgtgtagatccagtctatgccctttatagcagctttttcaagggggtcaccaacctttgataagatgaaacataccatcaacaaaagaaggtatctaaacttccgttggctatgcttcacatagctagttatttctgacatatagtccattacataccagtttgttatctacgaatactaatgcatggcaactggacaatacttcttgtgtgcggagtggcaatttatttgcatctgttattaattcttcatcatcttccaaactaacaacaccttggaattcctgaaatgcatgtcacctcggttgacaaaattccacttgaattgaaaatacaacacatgggtaaatcatttaccatgtcatccgatgtcaatgtcccagttttatcaaaacagcatatgtcaacctgataaaaaaaataaagagcttttaaaagcttttgcaagaaggattaaacataagcacaacaaagttttttttattaaccttcccagcaaatggtatcctgaatggctctgtgcagaaaataccacggcgggctaatgcaattaaagatgtattgactgctatggagagctccattggcaattcagggggtatcacagaagtaagaatcaatgaacaacttaagaaaagcttatatctactccttgttgggtcctccagtccctacatacggacagaccaaagttcaaataatattgaagtgtgctatatagcatacaattaaacatatggattttcttgataattccatctggcattaccttgacaagcacataaccggatgcaattactgcgaagaatagcaaaaataggataaacaggccactctccttgctgtttgcagtaacctgttatattgttagaatcagagtgttatgtttgcacatcttaacagcattattaactctaatgcatgaaaaagttaccctctcagttgaaaataagatagttctcatcaactttccctggctagtctcaaatccagtcctcaatacaaaagctatgcaaccaccatcaggtgctcggagatttatagactgcacagaagtaagacatgtcagcaagattcccagtacatctcctccctccaatcagcaaaacttgacattctaacatactccacagaacgatgcacctctttaatgctagatagccagtttaaccttcattagtttaatatcgttcattagttccaagcccatctacccattaggcaaagcatagtggcatcagttgatacaaccagcagcactgccacatggagctgtgacatagccgaagttatctcaaccagaaaacctttgagattcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40610 - DNA, 5387 bp, Oryza sativa
gtagagatatttcttactgcatcttttcctttttgtgtgtattatttgtacgtgtcatttggccctcagatataattgtaaccactatatctttactatgcgttatggctatgagttgatggttgctgaaggccccaccctggtcttggcgtttggctatctgtggtacaaatgatatagatgactggataacgtttatgcttacatgctaaaccagccgcacatctgttctagttctagcatcagctgaggtggaaaatttacttttcgctttctttttcatgaagtattaaaaaacaaatccagagactttggatgaagttcttttcccaaaattggtaattggcatgccgagaaatcttagctgggtgaatttttaacctattcaacacaagaatcaagaatcaagcagagcttgcatttggctttaggattagctgtcctggatcattcaattaaataaaacctgaacacctttgtttgtttaaatgggatgggatggtatatagaacctacttttactaacaccatctttagctgatggcttgggaaatacatgtccatgtaataggtgttaggcatgttgacctgtattagcttggtattttcttccattctatcagtggtctgttctgcaagcttaactgtaactgaaaggttacttctaaattgataggcctgaggcatttctatctagtactttcttgtcaggtattattgcttctattgatgctttaaatctatatgaaagagatggggtgcataattacaacaatatttgatgggaacagtttttttgtgatctccaaattttcaggctcatgttggcatagctcttttgaatgctgaacctgtccagaaatcagatacaaaatcccaggcatcaaaatctgaaaataaacaagggaagttgaaaaaaccgaaaccttctcaggaaggatcatcatcacaattgacccaaccagctaacagctccgctagagcatccagtagccgccctttaactgcagctgagaggcagagagaaagactgcagaagatgatggatgaaatgaatgaggaaagtgatggccgttcagctcctattgtgaagcttggggatgcttccatggcttcacctttcacagcaaagcatgcctctgttgcccctacacttgacatcatccgccaggggagaagcaccctagtcactacccttcaaatgttcaagattcttgggctcaactgccttgccactgcatacgttctgagtgtcatgtacttggatggtgtcaagctgggtgatgttcaggctactatcagcggggtcttcactgcagctttcttcctcttcatttcccatgctcgtccccttcaaacactgtctgcagagcggcctcatccaaacatattctgtgcatacgtcttcctttccattcttggtcagtttgccatgcacttgttcttcctgatctcagccgtcaatgaagcaaccaagtatatgccagaggagtgcattgagcctgattcagagttccacccaaaccttgtgaacacagtttcatacatggtgaacatgatgatccaggttgcaacctttgcagtaaactacatggggcacccatttaaccagagtataacagagaacaagcccttcaagtatgctctatatgcagcagttgctttcttcacagtgatcacatcagatatgttcagggatctaaatgactacatgaagcttgaacccctgcctgaaggaatgaggggcaaactgatgctttgggctatccttatgttttgtggctgctatggatgggagcggattttgcgatgggcgttcccaggcaagatgccagcatgggagaagcgtcagaaacaggcaattgcaaatcgggagaaaaaacacgaataggatcttgtttttttttccttcacttcaattttttgctccactggcatagtttcaatctaaataggccttaccaaattttgtcagtgccaaattttgataagttttggcatgactaattttggtaaggcaaagttgtgtttggattgaagccaaaataacctaagttcactattgaaatggtctattttcttagatatgccaaaatttggcttcaaaccaaatagatactaaatactattgaaattgcaaaatattggtaagcctaatttaggcctcaaaccaaaccagcccgtagtttaggagaattttgtcggactgtaggccccattactaggagatacatggtcaatatccattctgcttacatgttggatgaagattttaaaattttccatatcttatgctaatgttatagcattgatggttgtacaatgaagctgaattgctacagcagttctctcacggcagaagttatccgaatttactttacattttatcgatttatggattttccacgcctgtggcattttgttttggtggacttaggtagggtggtgaatctgccttgaagcatagcttcgattgagctgataaggtccagcgatttccaaggtgatcgcaaaattggggtaacgtctactagaccaaattgctatttacactaaatctgccgagtagcggtttaaggccttatttagttgggaaaaaaattgttttggggtgtcgccttgtttagttggcaaaaaaaaaaaaaatttaagatgtcacatcggatatatagatatacatttatatcagattacaactacgagataaatttattaagtctaattaatccatcatgttttgtctcacaatttacacgtaatgtgtcaaatattcgatgggatagggtgaaaatttttgttttggaaactaaacagagcctaattccatccagcaaaatcatccatcacacagagaactgataaaaacgatatttcaatccaggcaattgatatttggtaatgtgttacacaaaaaggttccagaattattacgacaagacattttagataaccatagattgccctctagatatcaaaaccacattaagcaacagccgcagaatgttccaatggtagccagcacctcccaaggcaaatcagtacttgtagtccttgacgtgaaggctctcggaggcgccctcgccgaggacagcgtcacccttgtatgtaccgagggtagcctcggagttggccttgcacctggtaaggaaggccgccctggccttctcaatgttctccgccttgccggaccaggccttgagcgtgctctgctggagggcacggccgaaggagaaggacagcgaccacggcttcttggtgctgagcttgttcatggcgttgaggttcagggtcgcctcctcctcgctctgcccaccggacaggaagacgatggcgggcacggcagcggggacggtcctctggagggtgcggacggtgtactcagcgatgacctcgggagacaccttcttggcgtcagagcctggggtgaccatgttgggcttgaggagggtaccctcgaggaggacatggtgctcgttgagggccttgtagcacgcagcgaggaccacctccgagacgtaggcgcagcggtcgatgtcgtgagggccatcaacaaggatctcgggctcgacgatcggcaccagcccgttctcctggcagatgatggcgtagcgagcgaggccctgcgcattcagatcaatggcgagctgcgacggctcgttggggccgatcttgaggacggcgcgccacttggcgaagcgggcaccagcctcgtagtacttggcgcatctcttgccaaggtcatcatggccctgggtggtggtctccttctcggtgccggcaacctcgattgtgcccttgtccaccttgatgcccgggaggacaccaccctccttgaggacatcgacgaagggcttgccatccttggtcttctggtacagggtctcctcgaagaggatcacgccgctgaggtactggagggcgccaggggtgcagaagaggagctcgcggagggagcggcggttctcctcaacgttctcgacgttgatgctggcgaagcgcttgccaatggtgccagtggactcatccgcagcaaggatacccttgccaggagtgccaatgtaggcagcgttcttgatgagctcgtctgcaagatggcaaacactatattattaacaaaaaaaaagcagcatctctgtatggcctaaataatagatctatccaaattgccaggcataaactatgtccaatgctcaactagaccaccgaaaggctgtcacttgaacagatcaatattagatataaaatttctgctaacagaacatgcatgtctagatcaacccaacttatttctgtcccaaataatacacgacttataactaaagaaacactatgcataatttaaatcacttgaacagatcaatatagatagaaaatttctgctaacagaacatgcacgtcatctagatcaaccaacttatttctgtcacagatactacacgacttataagttataactaaagaaacactatgcataaactaaatcaatatggcagaaaatatgttttataatcaatcttttaacacacaagaacaagatctgctccacttatcactaaagaacccttatgtataaactaagccaatatggcatacagtaagtcaactagtaaccaatctttaacctatagacacaacaaaagatttcacgattacgatcacataaataaacgccactccatcgatttactgttcccgaacagatctactaacaaactcaccccgaaaacccaacacaagaactagatctaaacagcacgcaactgaaagcacgaacagatggagagaggagaacgacatggagaagaatgctgatggatggatggatccatacccttgtacttgccgcagtaggccgacatggttgcgggcggagcgaacgagggaggaggctacgacgaatagggagatcgaggagaggaaggaggcggcggctgtggggaatgaggcgagaagggagggggaggggggtggccttttgaaggggggcgatgatgagttgatgacccgatccgatctgtgggcgtccggccgccttgtaggaggggtaagaaaccaacaaatcgggtgccagtgtgcgccgcgagtctgcgacccgtccgatccgtgggaagccgaggaggcggctgcggcgcgcggcggcggccgccacctgtggcgtgggccggggtcctgtcctggtaggtgaggtgcccgcaattttgggccgagatagatttgacgagaatttttttcggttttagattattttttttaatatttacagaaataatatatcgaccaaaaaattgcagaaatagcccctaccgcccacctctagggcgacaagctgacgtggcaaacgggggaggaacgggcggtgacagagggagggtttttttttaggaaaa

SEQ ID NO: 40611 - DNA, 11184 bp, Oryza sativa
cctgccgccctctggccgggcggcaggcctcgttgcctataaaaggcctgctgcccatcccccagccgtcattcttctctcctcaattccagtgaaaaaaaaagaagagaggggaggagaagagaagaaggggcgaagccctgccggattcagacaccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgttcgttacgggccaactggggtagatctgtcagattttattgtatcagaaaggggaattgatagaccggctgagaggagtgtaccttctataaaaggatggttaatgaggggcttcagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccaaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggacgattctgacaacgagcgtgtagaggaaggtgattcgtcagatgatgagacggatattaatccagcagaatgggctagtgaggatttttctgggttgatcgtctctgaagaggatagtgtgagatgggagtacaaagaaaatgaggttattcagggagcgatttatagtagagcagaagatatgaaataggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctgacaagagtgtgctgcaaagggcgttcttagctctacatgcatgcaagatggcattcgtgaactgttgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgtgagcgataggagagttgcagtttgggagtatggaatgaggataccccggtatttgggaagatgtatagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatggaacatgcaggtattttagggatcggttccaggaagttcttccctctatgccgaacacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagtaatatatcatacatggagcggcgagatttatgggttcggcatagctggggagttcacagagactaacaatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactattaggatcagcagcagatggagctcgccctacgggtgaaggcactacctccactcgaccacgtcctaggcgtcgtcgtgccacgtctggctacgtggtgtagtttttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcatgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaatagtgttttactataagttagttgcactataatattttttataatgacatattaatttgttattgcaggctacgtgaggccggcctcctaccgatgtgtcggctggtggaggctgcggccggtgacgcggacccggccagacgatggactgtggacaggtccctcctagcagctttggtcgatcgatggaggccagagacgcacacttttcacttgccgtgcggtgaggtagcccctaccatacaggacgtatcgtacttattggggctaccgctcgcgggagacgctgttgggccagtgaccacggctgtggactggcaggatgatctgacggcacgtttcgcactagtacagcgcgcaccgcacctcccattcgagccgttggcacaccaccgcaacaccggacctacgaaaaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcggacttgctctggctttttggctgggtgatgttctgtggcggtcacgggcacgcggtcgacaagggacttgtgcactacgccaggagcatcgctgacgtcgcggtaggcgaggtgtctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactttgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccacggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccaaccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcatatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaagccgcccacttctcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccacttgttgccttccaccttcctcttcgacatcactgacttcgacttcacttcaggctcgacagaggacgtcatcggcccctcacagctgggaggcgcaccgccggtgcagacgcaagactaggcgcaggccactcctccgcgggacactcgtgctacccgtgctgtgccaccggatcgtttcacctactcccaggaccacgtgcgagcacaggcccggaggaccaagcatggtcgcggcgcggggcagggccagtagagcagtcttctctttgtttacttgcttcactttccagtactgtatgcttgtgtaatgactacattgttgttatatgtgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccactgtcacaccctgaagtttccccctctccttgctttaaaaattggctaaataaatcgtccgaagaaattatcttatttaacctagagctaattccctaattaataaatgcaattaataattgaattcggcgtggtggaatttttcttgagttccccatgctccaatgcattaacaagatttttagtggaattttcagagccttggaaataattttaaccaattaaaaatcaccaaagtgcaattttaatcccaggaaaatccttcccctctttttcttttcttttccttcctttttctctagatgggccgtcggcccatctctctccccgcgctcggcgcccctttcctggggccggcccgttccttctcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgcccctcttcgcgccccactccgcgcccgcgtcgccgcccaccttccccacatctcccagcccgtgcgcgcgctcgagagggcgggattcgatttcgaatcccacccctctctctctctccccccacctttccacgtcgccggcgcaatagggtgggttcccggccacgtccgcctccccctccgcctataaatcgttccccgcgtccttctctcgttttttcctcttttcaccgcactctcccgtgccgtctaccgccctcgcgccgcgcacccgagctccgccgcccgccgcccatctccggccgcgcgccgccgccgctagagccaccgccgcgccgcgtagtcgccaccgtcacgctcaccgagcccgcttgcacctcggccaccattcggttgccgccaatcgtcgccggagcgccgtttctctcgcacgccggtgagctctccatttccacctaactccggccggccgctctagccgccgtggtcgctctccctacccctaaccccctctctgttttctcctagcgtgccgccgccgcccgtccgcacctcagcatcgccgggtcaccgccgcctttcatcctccgctttggtcgccgtgctcgccggtgaggctcccctccgctcccttttttttttccctctctcccgtgtgcgccgccgtccttcgcgcgtgcgccgtcgccttcagccgctgccgtcgcttttcgccccgtcctccgtcgcttcccacgccgccgattgccgtcgccggcgaccgtgcgcgtcgccgccggttgccatggccggccggccggttttgaagccgagccgagccgtgcctagccgccgccgtgccgtccgatcggcccctcggccgatccggaccatcggtcccgtggaccggcggtggaccacccgcgtggtcctggtccacggtagaccggccgctttgagccgctgacccgtgggccccgcctgtcggcgccgccccctcccctcgctgacgtcagccctgggacttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaagtatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctctttttccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacacccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgttggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttacttactttgcttgctttacacctattctttcctcccatgaaccaccaaggagatgtcaatacagagaatggatagacaccagaagggtcctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgtaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttt

SEQ ID NO: 40612 - DNA, 30548 bp, Oryza sativa
agtacggccgcaagctctttatgggcggccaaaattgcaattagccccttgccgccctctgtacgggcggcaagggcctaatcgcaattttggccgacggcggcagacggcgcggtcgacccaccgtctaccacgtcagattgccgcccaccattagggcgacaggggctatttctgcaatttttttggtccatagattatttctgtaaatattaaaaaaaaatctaaaaacgaaaaaagttcgatttgacgacgtgtatgttcggcgaaatctttgggcctgggattgcccttatcaaaatttgcctaaccaaccaaacatctctattactccctccgttttgaaatgtttgacaccgttaactttttaagtacatatttgaccattcgtcttattcaaaaacttttgtgaaatatgtaaaattatatgcctacataaaaatatatttaacaatgaatcaaatgatagaaaaagaattaataattacttaaattttttttaataagacgaacggtcaaacatgtgttaaaaagtcacggcgtcaaacatttcgaaacggagggagtagaacacaactttaacatgaactagctgggtggcccgcgcaattgcgcggctagcaaaaaaatcatatattttttaagtatgattttacttagaattaattaaatagctatctcattgttaagattttgaaaaaccaaaccttatcatcctcatgtttctaattatatagtttttaaaaatttgctatcccttatgtcatctccttttttatttgcttgctcgatctatcactatttctattcattcttcttggaacatttaaaaattggattttctagtttttagagtttattatcacattgggtttcgtttttataatttctagatgtcccgtcaaacattgccattatgctcctctatgcccatccactatctcttctctttattgtcattgagattttaataagtcaaacataattatcgtttgggttcatttttactttctagaagtcccgccaaactgtcagcggttttgccattgtactcctctacggctcgctcgctgcctcccttctttattgtcattgagactttaaaatcggacatgattatcattggttttttttttactttttagaattttcgaaccttcaaaaattagacttgtagtttcattttttataatttttagaagtcctagcaaacgatgccactatgcccctctacagaccgtccgccgcctattctttattatcattgtgattctaaaaatcaaacataactattgttgtaattcattttttattttctagaagtcccgtcaaccatcggcggctttgcaactatactcttatacaccctgcccgctgcttctcctttttattgtcattgagattttaaaatttgaatatgattatcaatgtgttttttttttactttctagaagtcccggcaaccgccttacttgtttgcttcacggcatgcccgacgtccctccttttaatcgtcattaggattctatttggtgttttattaacaatttttatatgacgtatcaaccgccaccaactctactcctttataggcatgttacttaatttatctcgtcacgtgttttagatggtcttttctttcaatagtctttatttttatcaaaaaattagttatttataaattttattcctaattgaaatcttttttttctaatttcagaatttattttttttaaaaaaaattagttaataccgtattgtgttcttttaatgtttttatttttttattttcaacttcagttgtttcaaaattgtattcctacttgaactctcttttaatttttctaattttggatattattatattttttattcaaaattttaattaatctcgtattgggttcttatatagattcttgtttcaatattgcttatttttaattatgaattttagctatttttaaattgtattcctactttgaactcttctttattttcttttgctaatttcggatttatttttatttttattctgatttttaattaatcttatattgggttcttatatggactcttcttttaatatttcttatttttaattccgaatttcagctatttttaaattgtattcctacttggactctcctttccttttctaattttggattttattttattttatttcaaaatttgattaatcttgtatttggttcttatatggaaacttctttcaatattgcttatttttaattcctagtttcagctatttttaaattgtacttctacttggactctccttttcttttctaattttggattttattttatttcgagttttgattaatctcgtattgggttcatacatggaaacttctttcaatatctcttattttaattccgaattttagctaatttaaattgtacttctacttcgactctccttttcttttctttttctttttctccgattaatgtggaaatttctagcccaaacagtgaacatggtgcctcctttcagagctgttttaataatataatagatagatttagctttgcctgtaaacttgtgtcttataagcatagtttgacttcaatccaaatcaatattttcaactatagcatactaaaattttgttggtgctaaaactctaccaaatatttagtttaatccaaatagtccctttaatccacgaactatcgtggttaggtcaaccaaattatctccttaaactaaaataccaaacattttacaacatgaactattcatactagacaaataatcctcttagcattgttttagtcggttttaaattgagcttgcacacatgacatcagtgtggcaatccaaccaacaaagaattttctcttcctatgtccaatcacatccctagtcccctgctctctctctctctctatctctctcatgctggagattggagaaggtggacaatggtggaagatattgatgcaaagctcacggcgatggcgaacttgcgagcctccgcatggcttcagcttggttgggcaacaccatcctcgtcgtagagcgagtggcctccagacctatggtcgcgtgctccactgctctagcttgacagcaaggttagaggagagcctgcaacggagctcaaacttcattggggaggtgttggcggcggagtcaagctctttgtgggaaggatagctgagctcaagctctctaggcattatctcctggagctcgattgggtggaaaaggccgcaggcggcggcggagtcgagctctttgtgcgaagggcagctgagctcgagctctctaggcattatctcctagagctcgatttggtggaaaaggccacaggcggtggcgagcatcagtgcacgtggtggcgaagatgttcgaagagtattttggttgcggagcttggcgagatgtgcagctgcgtccgtgtgagtggtggtggagatgatgcgaccgtcggggtccatatatgagacttgtgcttttatccggatgtgcggcatcttcgttgtctccctcgctatcactgtcatattcccatcctcctcttcctcccccgtgtatcctccctctcccatggagaccagtggccaaacgtggcgtggacgcagcaagcgacggtgcgacgtatggtggtggtcgccaccggggacgagttcctagtgaggacgggattctcgaccccaagttggtttcgagctctacatccatgtgcctccactctgcctcgggttgctgcctcctcgatccgccttgcccaagcggtctccgcctttgccctccttctctagccataggtgtagagagagaagaggggaaactagggatagattggcttaggggcgggtgggtctagagattttttttatttgttaattggattgtcacgtttggcgtcacgtgtgtaagctcgagcaaaaaccacccaaaacaatgctcaaggagtttatttgtccaatattaatagtttatggtgtaaattatctagtattccagaccatgaagtaattcaatcgagcgcaatcgttaacagtaattcttttttgctacgaacaaattcttcacgcaggtgcagtaaagatgagttaagcacacgtaattatagagatttccccgcaaaaaaaatatagagatttattaacataacagcctatccacgtgggtccaactgtcagtgtgtgtgtgtcacgcgttcttctgacttctgactgagtgctgcgcccaccgatccgcccaatttggccccacctcgcagtgaccaggggaagaaaagttcggtcagatcccacgtgtacgcttagcaaattcacaaatcccaacctccccgatacatacgggtctccttcccacgaggccaccagcaaccgaaatcccctcctgacctccttcctcctctctccccgattccccccacccacccaccaagcgcgtcggaagcgatggcgtcggcggcggagatgcagccgctggccccggcgggctaccgccgggcgccggagatgaaggagaaggtggacgcctccgcggtggacctggaggccggcaccggggagacgctgtacccggggatctcgcgcggggagagcgccctccggtgggggttcgtccgcaaggtgtacggcatcctcgccgcgcagctgctcctcaccaccgccgtctccgcgctcaccgtcctccaccccaccctcaacgccacgctctcctcctccccgaccctcgccctcgtgctcgccgtcctccccttcgtccgtacgtgtgccctcctccccatctgatgatgcttcggttgacctctatcttagatttcttgtgcttgatgagaaattgagaatggttttattctgtgatcggtcgtagattcatccgcgtcccgctgattagcagctggtttgatttgtaggctacatagttgaatctagatagatcggtgcgttactatatgccttgctgttggaatcaaaactttggcctctagatctaggatctaattagttcacgaattaatacttagaattagacgtagtaagttctgcatcatggatttgcccactcgcattctgaattgggatgtgaagtaaatgtttgtgttatattataaactaatgctgcaattgcttttcctataaattgtgaatagcatttctatagatcatgttcagcgacgagtttatgacaaactagttaatgcaaacgctgtcggaaaattttgttacaaatgttatgagaccttaaatgatatgattcatatgcattttggtttggccttatttgtttcccttgacatcatatgatgcgtttgtgttagtcaagtgcggagtgtgatgatatgggcatggtggggctgtctttagaagtgtagaactcttctgaacacttgtgtatccagattatttttttttctttcaattctgaaatttctgctttgtgtttgccatagacaagattgttttatcccctagttggatcaagtaggcagcacacataactgtgtaagagatagtcaatgtatttagtccggtatgagttatattttaatagtatatggaaaaatatcaaggaaagtctcaaatcttggatcagtggggctgtttttttttactccctgctttttgttcatgttagtgttgcgagtaactaaacttcttcatctgaattttgagaaaagcctgagtagatgacattgttaattgtttggtaggatggaatggttttggtgctctcagctaattttgtgttatttcttgcagtgatggtcccattgtatcattatcagcacaaacacccacacaactttgtttacctgggtctgttcacgttgtgcttgagtttcagtattggtgtggcatgtgctaacactcaaggttggttttctttcctttgcaagttttagttagtttcttcaactgccaactgtactttttacataacaatcatttgtgtgctgcagggaaaattgtgcttgaggcattaatattgacctcagctgtggttgcctctttgactgcgtatactttctgggcttcaaagaaggggaaagaatttggttatcttggaccaattctgttttctgctcttgttttacttgttgtgataagctttattcaggcaagtgtacactcattttgatacaatatacttaattcaaatagcgatcttaccattacgaaaccaccaattgtaataagcactttgccgtgatatgctgtgttgcaggtgttcttcccattgggctctggaccagttgcattgtttggtggccttggagctttagttttctcaggtttcatcatctacgacacagagaacttgataaagcgccacacttatgacgactacatttgggcctctgttgagctctaccttgacatcctcaacttgttcctttatatcctgaacatgatcaggagcatgcaaagtgataactagccagtccatcagcaccaaccagacgtattgtcaacttgctcagtgacgtcagtgtgtcctgctctattaagtactattttgaacagcgatctatataaccgtgaaaacctcgtgatgtattttgctgtcgtctgactcaaaggatgagaccgaagtacaatatatgtatagttttggttgtgttgagtatgactgtcggaaatgtgatcccatgattgtgacgtggtgccaataatttttaccctgcgatgttcgtgaatggttttttttttcgtcttctgcaagtagaggttttggttcgtaattaggctctgaatgagcccatcttctcctcagttagtggtggagacaggagatcagcaggcaagcatgtacatcgacggtaggatactgaagttcactaatgtttctgatcttcgttacagaacaatctttcagaagaagggatattttattaaccactactcttgatcttgtttgttggcaacagattacttcgctcgagctctagtgtacagaaactataccagcatgctctttttctctgaaatttgaatgaaaagaaccacaaacgccagtaatattgggatttgaacatccgaacagcaaatcaaattgtacagaggaatgaatctcaggtatatgtgcgaaaattttgcacaaattttcagccatatataagcaaaccggatgtaaagctgcagccggcgtagaagtagaacacagcagaggccagcagggaactcgtgggatgtggctgcagcctgcagcggtggccggttaagttgacgggccgcagcggtggagtgcacgtctaccacaattcatttctgggccatataaatgttggatgcctgtaggtgtagacgtaaaacacgaggcatgagagatctgcttaactccagtacaggtccaaaactcgccttcgggtatgctagcgtgccagttgatttgattccgtaattaacaagaaataaaaacaaataaaccgcggttaaacctataaacgatagcaaatcggctaggtgccgatgacatatcatttatctttgagccgatgtcatatgtaaatcgatcggcggttgtaaatagataataaagaactaaatctactcgatcggttgtagatattggcaatatataattcttatatcgatatatacttaaatcaagtgattgagatagatcggtcgccatgccgagacagtataaatcacttagatcgaaatatatattaataacatgattatatatgttcatagcatagccgatcagatagatctagcatgtatcggctaatactccgatacaactctatattacgatgttaaaacagaagctgaatatacttagatgcaataatatcttaacataaagggcatatttaacgggtcaatgaagcgcatagagcaaatatagttaaatcagataagatcggctgccctctaccgatagatgttagccgattgtaggttagatagcgatattgccaaagattatgtaagatatatgataactcgacgaattacataaacaagattagagtatcataaagatggaagcgctaatcccgagaacgcaaaccgtcatgacaatttttacctcttgttgaagatcgaaaccgatgcagctcaacccgaaagcaagaactcgtcgaaataaaactaaagcaaaagggtggcgatgcgccgaaattgtattgaacgtgtgtgttaattgattacatgaggttcggggtctatttatacccgaaaattacaaactatattcatatcggacacgattattatctctaacaatctctaagataccacaagcctttgcggcagacttttacccaaacatatctctaaggaatttacataaaatatcctaattaatagatacaattgccttctcaggactctatccatgcacggcaatcatcttgaagcatatcaacccaacccgatgttgtacaccaagtcgtattgtcggaatcagctgtatcggctcacctagtttaactcggacacagccgatcctgactgtagccgatctggactccagccgattcttgctctgttctcagatcgatcttcgccttcgactccactttgatccaatcctcctttccgatgatgatattaccaaatttggtcgttaacagtaggccacaatctcattccggcccataaattatgcccttcgaccttgttcaatagaggaattgaatgggattgaaggacaataatttctcaccacaatcctcgcagacactcacgggggattaaggaaaatttaaagggatttatttcacacgtatagaattattccctatcaataccctccaatttctttctcctggggattaaacaaaggaaaaagtacaccaaaggtctctcaacttgtcacctagttacaaaattgttcttgaactgaaaaaccggatataacatattccccaacttacaaaaccagtgcaaactaggtcctttggctgttttgactccggttttatccaacgtggcagttgactcagcgtggggcccacgtgggctccatacgtcagcctctcctcctctcttcctctctcctctcctctctctcctctccatgggcgggacgggggagtagctgggcacggcaggcaggtgcggtgggcgtgggcggcgaccttcgatgtaactcgagtccgggagccaccaccaccaccagctcgccacccacccatccatggcgaacccaaggatagccatcgcgctatggcccccgctgttgtgtcgtcgtcatcgctgttgtcgtcgctgttgcgcttcctaaagcggccgacgtcgctccccttcctgctccccctcttcgtgttcctcacctagatctgccggcccttctccccatgcgccgttgtagagaagatggggacggctggtctagctcggtgacgcctgcgcccgcgcgcccatgcacaccggcctgccgggccttttccccgtgtgccgtcgtcgagaaaatggcgacggccggttgagctggtggcaccaccgcggtcgcctcctcccatcctactgctggtcgtcgtggcgcgctgccaggatgccagtggcggtggacgtctcgtggtggccaggcaacggccccggcctccgccgctcagcgatgtccgtcgttgacgccgcgcaccccatcacagccgacgaaggggagggacgacggcgagcgggggacgacgttgcccacgaaaccccaggttttccccgcctgtcaccgaccgcagacgatgcccttttccttcttccgcctctcgggccgctccaaccccgagctcgcacacgcggcgatgtcaccaccttctccggcgtcgtcgttgccgccactccggccgccgccgctgcgttgccggctgccgacgccctcctcttctcctgcctcggcccaccccgccagcctcctccccacctgccgccagcctacacagagaagactgagttagagaggaggaagggagaggaggggaaatagagggtgatgatgtggttacaccgatatatgggtcctacgctgactcagctgtcacgtcggataaaaccagagccaaaaccacctagggacccagagttatccggttttgatagttgagggatgacttatatccggttggttgagggacgattttgtaatccgatgacagggacctcatacgtactttttcgttaaacaaacaaggccttaacatgtcccaatcccgttctggtccataaatacaagagtgaccggtccggtccatccagtatgggccacacgttcgctgtaatacctttccagcccatgatggatgggcctcacgtaacacgttctagcagcccacaagttacgggccgcacgtatgagcgacaaccgcgtttccgcaagatcgagcagagctgcagaggaagccaaacgttttatcttcttggctaccgatgcatcatgcatcatcctactatcctagttctaagagcaagtataatagaatagtccactactaactccaattcatttatagccgatctaatagttaattcatataatagttgcttactatactattaatatatggtctcacctgtcatacatacattgcgtcttaaagtctatactgtagctagctatagatctgtagctcgctactcttctttcttatattttatctcattaaaatatatttttagctggttaatagtgtgctattgtacttgctctaactagtttaggatcgccttaactttggtattactgagtacgttgaaccacaaaatcccgaaagaacatgctactccggtagtactaatgaactggaatatcttgccacgccttgccaccctaactcagaatgcaagaacttcacataaattttacaaaggtgtgtttagttcatgtcaaaattaaaagtttaataaaaaaaaagttgaaaactaaaccaggctttaatcttaaatacgcactccgtccatagaccatagaacaattttccgcacctttaaactttcatccttttccattccgttacctcgagaagccaacaccgaccccgcggccccgtccatccccttgggaaattgcacgcgaatgattgcgccggagcctctcttttccccgtgagcgatccagcgccggtcttttccgcggccgcgggccccgtgctccccgcggcagcaaaaggcgcacacacacgcaaaaaaaaaaaaaaagcggcatcacaccaccgtgcgctcgcgcgggcggacacgaatcagccgtcacgtcgcctcgtgccggcgattcccagccatccgcgcaaagcgagagcacgaacgatcgcgccggcgcccttttttttcccctcccgagacagcggctgtttgctgggcaagtactgtgcgtgcacgctgcacgctgttcgactcacatgaaacccaagttgccgatggtcgatgggcgagcagacaagcaggttccgcgagcaaaactgagaagccacgataagaattcgatctaccggcgggagcgttgggtaaatagtgccagccatttttgatcaggaatgatgacgttgtgctcatattcttcatcggtactctctccgcctccataatataagagattttagagggatgtgacaaattccttatattatgagacgcagggagtaacgaagaaaaagtagcagagataaattcatatgcatcgttcttatgatagagagaaccttatgttactctactggaaagttagagagcactaaggccatggccaacgctccatgctagagcgtggtctcacccgcgaatattcgcgtcgcgtggtctcacccctcccgacgcgaatattcgcgccagctcggccgggaccgcgctctcgtagagctccctgaccccccgcatagcatcgcatagtttcattagcttttggcgaggaacgggcgagcagccgtgttgggggagaggcgtcgctccgtaccgtaaccctggaacgttgtagccaactacctcccgcgccaaggccaaaaatggcgaggaagtaggcgggggagaagaagatggggcaccgccgctgccgccgcatctatccggcgctgccgcgcctcgatccggcgccaccgcagcctccatccgccctaccgccgccgcctcgatccagcgccggggagacaggtggcaccgccggagaggggagcgccggggagagagggccggggaggggagaggcgacgcgctggggagagactccccggcggtgccggcgaggggagaagcggagagaaaggagacgcagggagagattgggtgggagatatggtgatgagaggaggggttgacgtttatatatgtttgtgatttttagagggtatactgtaaatattggacgtatatgcaaattaaaataatccaagggtttaaaagcaaaaatatgaccgactaacatgtactgaattaaaaattaagatgggggtatggcttacactgtgcgagggatatcactggtgtgattttatcctatttagcatcacccttttttatgagactatactctgcgttggccatgccctaataagatgggcagatgtaacggttttagtttcacaagagaacctcagacccagaggtgtgacttttatgcgattggctgtgtatggcagtatatggccatatggggtacggtccagacatatcagactgttgaaagaatgcgttaattgagcagagaaatcttggccccctgtagtgactatcggcaagattgtactatcatcatactatgaatggagaatattgaaaaatgaggattatatgtgggccttcatatcaacttatggtcccaatctggtagtgttcattaaaatctctttatatctctcatgaggtataataaagccacagctcttcggaacaatcattacctaaagaatttttgttttcccggggtcaagggtaataaaagaaacaattatggctacatctgattattagtgatagtactacctactatcttcattcataaatactccctccgtactcgtaaagaagtcatttagaatagcgacacggtctccaaaacacaactttaacttcttgtttctataaaaatatttattaaaaagtgatatatgtatacttttatgaaagtatttttcaagacaaatctattcatataatttttacatttttaaacttaataacttgagagttatttatgatttatatttctaaggtttgatttaaacattgtcatcaatgattttctttacgaatacggaggaagtatgatagatccgtgcattgaaacaccatagcaatcggaaaacatcatagtaagaaattagtacgatcaaacgcggaccaaacagacggcacagaaacagatacgtgatgagaatacatgcaagagttgctcatggccccgaagtccatatacaaagtttacaaactcatcgcagtcttttaccttttttttatttatgctataaacctaattaagttaatatctgaacttacggtctgatctaatctacaacaatactaatctagattgcatataaagaggaaagtccatcctattagcttaattttatttggcctcagaaacatattctttgttacgctagtccctcttttttttttcctgtgcattgtctaagagtaggaccatgtaaattaacgcttgtatactttttttatattgtttcaatctaaagtttgctttgcaaaacatgtcatcataaactttggtttgcaatttatttaacgcaaaaactaatcggcgaggcctttcgatattgtcttatcgcgcaacgccaaccatagaagccgtggagaagccagcgcacatacatgtcttttttttctattacacatacatgtattttttttcctcttcttacaaagttttctctcaaattacttattcgatctataatccgattacatgtgttcgttgcaattaaatcttcaaaactagatcttacatgattatactgcaatgaaaaaatatttatatttgtaaattacttttattatatacttaagttacttttatcatatatataaattactttgagatttgactaaattactatttatatattcataatgctttaagttgattatgtttattatagtttttagtcaattctataatttatggactttaaatttaatttttagatacaaaatatttttctctcgaatttacttttaatgttgtaacaacttacttctattttgtgctaacttacttctattgcatagctaagttactactacaatttaaataaattacttttaaattaatgaaatgtttaaatatattcaacatggatcttgttttgtctcatattttacgtagagtataatgatgtaaatagatcatgaaaattatacgtgatttaaaagatataagttattaaagagcttaaatctgaaagtaatttatgtataggacaaaagtaacttacatatataataaaagtaatttacaatatagatatttttatcagaatataatcgtgtaagatcttattgtaaagatttaattgcaacaaccataatggtgtaatcggattatagatcggataagtaatttaggagaaaattctctaggaagaaaaaaaaagacatgtactgttgagtgtactagtaactgttttttggaatagaagggcgtcgctggttagcaatatgccgctagcgcgcgatctagccgtatcctttatttaaatatgcatatgggctgagcgattcaagatatatccatccatgcgagaccaaacttatagccggaacggaacatcggagaatgtttcatcgtacaactatcgtaaaaaacatatcatacgtatagcagccctcatagcaaactcataccaatgttgctactataattccttgataagtaactgataagcgtggaagagggtaatgacaaccataaaaaaaaatcatatcttctatatcaattttgatggtggataacatgcggcccagttgcctaattgttgacttaaaagctcaacaaaaagtaactaacatcgaatgaaaagaaagacaaataatcactccgtcaacaaaaataagagatacaacttatttagacatgaaccctattagtaaatcttgattcaaagttgacgaaaatccatataaccatagtctctaaattttggcatgcaagaaaaatggattcctttttctcatcacacctttgtagattggcctaaaactagtctctggattatcatttcaactttttcatgataaattatccttggtaagagaacttattccgtagattgcatcgcatacgtgttcgcgaaaaaaaattgcatcgtcgcatacaatgtgcataacccttcattgtacctgactgaaaaataaaataggtctagaaacaaagcaacagctttgtgtaaaaccttttaaaaacaaatttgtttaacaaaaatctaaaaggccatataattgatgcctacaaatctgcagttgcccaattaggcaacgaccttgcccaagcagatatggtttataaatgacctctgaaaaagcaaaagtgaggttcatgcgtactttgtgtagcttctatgagaggtttgtcgcttaaaggctaacgactgttcatgatgcaaagcaaacataagctaaggctggacgacggcaaagtgatcttaaaagcgccttttaaatttgtgcaaaatttgcaggaatgagctgacgagaatcagacaggcaccatatgatggtacagtacttctacgtttgctatggtataattaaagtgtagagattgcaagtctgtggtgtactgagacgaactaaagagcaggggaatatagcattatttatcaaatattccaatattgcttgccttggcaggaatataataaagtaagtacatacatgcactccactggttggtctagcttttcggtgaaatttaccatcttattccaacttgatcgttacgggtgcctgtaataagcaaatagaataaaactgagcagaatacctatacttgtatgggaaactattataaactctcgagggaatgtctccttgttgtttacatctcactcaaatagttataaaaaaaataagaagatatattaatatgtaatatattatttcacaaacatataacttaaaaattcgacttctacatatcgcaacaaaaaacaaattaaactacagctagttaacatatattcacggtcaattttttctctgttgtgatgtattgaagttgaatttaagttctatgtttgtagagtgatatatcacatgttaatattttttttaaaaaaaataaattcataactatttgagtggtatgtaagcaatgaggggatgtcccttcgagagtttaaaatccactctcgtatttgaacatgtgaaaatcatggagggcatacgatttagcaagtagttagttaagagcaacataagtcggacggcttttagtattgatatatgattttcacaaattaataattctaaaattcataattactacatatgggacttagtaccggatgaaatacattatagtttgtattcttagtgacagccactactacgaaaaccatttttcgtggcggccattttggatttttgatggcagaatttgcaaccgccacaaagcaaaggccagtgaaaatcaagatcttcgctagcggttattgaccgccagcaaaaatccaatttcgggcggtcgtctttgagctagccgccagcaaaaaaccattttcgctagcattggcttaagacggccgccagcgattcgctggcggctgtgttaaatcggtggctgtgttaaatcggccgccagtgaaaatctattttgagcccaaaaagaaatacccatgcagctatacagccgccagcgaaaatacccatgcagccgcctattgattcattaatttcaaaattcaaatccacatctagattcgctgctcatttccaaattcaaacatgaaatacaaaatcatcatcagcacagatcaaacatcatttacacagatcaaaacatgtgcatcatatggaacaacatgcaaaaaaaagaaggaaaaaaaaatcaaatatagcagcatggtcggaggggggagccgcgggagcacggtcgacggcatcgaggtcggtgccgccctccccgtggtccggcgacggctgatccagccttcccgtggccgagcggcggcggatccggcctccccgaggcccggcggcggcggatccaccgtccccgcgcacctgagctcctccccccgctcccgagagccgctgcccccacgcccgagagtcaccgccgcgctcgcgcccgagctccgccagcacccgcgcccgcgcctgagagccgctgcccgcgcccgagctcaccgccgccttcgccgcccactccgtggagggagagagggagttagaagaggaagagaatggggccggatcggcggtcgtatgcggcggtggagctgcggcgacggcagccggcggtggtggggaggcgacgaggcgcggcggtggagaaggaagggaggagagacggagaagggagagaggcggactgggcgatgggaagggagaagggaaaagggataaggacggacttggcggtgggcggtgggtggattttgttcgcctcaaaaaagttttgtagtggtatttcttacctaccaccagcgaaaacgtgactttcgctagcggacacttaagaagtccgcctaaaaaaaatagagttttttttatggcggacctctgagcgtggccgccagcgaaaatcggttttcgctggcggtccatggccccccacccctcgatatgtttttgctagtggttttcgtgtatggccgccaacgaaaataatagaccaacaccatgaaaaatcgtttttctagtagtgagctattccatgtttggtaagtctaaaattttgaagtcctaattatagatttagcatgattccaaatatgtactagtatcgagttgtactcgattcggggtctgaattgtagccattttcatgtttatcagtattataaaattcggagttaatattatcaaggttgtatggactttactatttttaatgactagaaaaagtacccgtgcgttgctacggaaaaactaaatcgtggcatattttttatgcagtatttgagcattatgaattgtgaaattgtctcacgtggctggttattgcattgcgatggcttcatcctgattatgaaaatctcacaaaaaaaaacataataggaatattccaaattcataaatgatagaaataacatgaagatatgtctacatgggtgtttatgcagcaacctttgaaaaatagccaagctgtatcatctcatccatatcacaatcggatcaggaagagcatgcagccgatgctagctgcgcttctttctaaactaataaagagaaatttacgtctgtgcagtatattctagtacgaatcgatctgatgacctgttctcttcttctatacatgcgagcaacaaattcgagacatacatgtacatgtatttgagacttttttttatggcgattaaataggatacggatttgaagtcggactatcgtatccgtactcgaatcggacgacataccaaacaatcatcaaaagattcgagatcaaaaccttatcccctgtgtatgtgttcttaagagagagaaaatcgtgctcctaatagtgctcgaagttactgtagctgggtgatatagttcaacgcattttcaatggcggtcgtcatatgtcggttcgtttgaaccgccatagaaaatgatttgaggtggtggagggttaagatggccgccagcgaagatgtaggtatcttcgctggctgtcggtgatatgggcccgggggtatcaggtttagagggaggaggctgccccccgatgccacgtggccctcccccgaggggagtcaggcccgaggtaggacggtggccactccttcccagagactggatggaggaggctgtcctccaatgccacgtggctctcccccgagaagggtcgggcccgaggtagggcggcggccactccctggccgagactagagggagaaggccgccccaggtgccacgtggctcccccctgaggggggatcagacccgaggtcgggcggcggccgccccctcccgtgactaggggtcgggcacccccgaccccctctctaggtcaccacatatggtgggttaggtgtccgccttcaggtgtccacctacccgcatttatggcgtcccgagcggtcgcgccatgccgcatttaatgcagcgtgcagtgcactcaactggtctgtgatcggtcgaatgaccgatgggactggctagtgcgcctgtgcgctgctcgtgtgtcaggcggcgtgcagcctgacatgtcccatcaaatagtgatggtgagaggttctcatcctcttatcccagccggagtcggtcctgctgctctggtcaaagcaaggcttccgtttcccggtataataggagcagagaagtcttcacccattaaatggtgactgacagtggcaccccccgtgtcaggcggcaagatttacaggcctcatcatcaagacgacgtgtgcttggcttcccaagtcaagagacaagacatgcatttaatgcaaagattataatacttctccaccggagctaggttaggttgttgggcccatgtggtaaccccttgaggtataaatggaggtccaggcctagtggtggaggggggacttcggagcgaactggcgcttgggtctcacaaccccaagcacttgtgttctatattcaatcaatcacgcacaggagtagggtattacgcttctcagcggcccgaacctgtataaacctcttttgtttcatcgtcttgggagggtctaaccccctcaagatcacacagctccgctcaccaagccctcgaatctcacccgctgccccaggccgaactcacaaaggggggcctcacggttccctggtggaggagttctttctccgacatctggcgcgccaggtagggggcgcgttcgtgatttttgaggttctttcgagcgccggcatggtgagtgtcgcgccgccgctacgggggaaggcgcagcatcctcatgagtgtcgcgccaccccaggcagggggcaaggccccccacatctccaccaggtaagcttggctaccaggtctttgtggcgagtcttcggaatgtccgagggcccccaaagctccagccctgcctcaccgagaagtacgacgatggcgccgacccctccgagtccctccagatctgcacggtgatcatagaggcggcggggggtggcgaccgggtcatggcgaacgtcttccccatggccctcagtggccaagcgcgaggttggcccatgaacctgctgccgcctcagttcactcctgggaggactcttgcagttttgagctccgggtgtcgtcgaagcccgggaccacctgtgctggctcttctgtagcggctggctttggtcccgccggctggctacgatgcccggcccggctcaactgatcgtcctttcaagcttcaagtattttcaaattttcaattcattagcttgaaatcttatatttatttccccccattctattctcatggccctgaaacgcccgcgtattgcgcatttgtttgctccctcggtggtaagagcacaacctctctcccatctacatgaacgattctttgctaagtgtgggggctaaattttctagccttatcctagccttaagttgagccccgggtgccatcgacgcccgggaccccatgtgctggctcttccgtagcggctggctttggtcccaccggctggctacggtactcggcctggctcaactgtggacagggattgctggctctagagttttcggctctcacactcgtgcgaaagtaatcgtccatgtagaaggaaaagagattggaaggaggccactgaaaggaaagagcaaacagaatgtgtagcgtggggacacaggctcgtgggaacctgacctcgtttgctaagtggtcacatgtttcccaagatggttcggaacccatggtgggaggccctcttcgagctaaaggtttgtgtttgcttcattcatacatgcaattctttgctataagtgtgggggttatgattccaagctctatcctagccctgcgtcgagctctgggtaccgtcgacgcccggggccccctgtgctagctcttccgtagcggctggctttggccccgtcggctggttacgacgctcagcttcgcttgatcgcaggcgaagattgccggctatagaaagttcagtcctcacactcacgcgaagataatcgtttgcataaaattattattgcttatatttatctctcgcccatctcttcctcgcggtcctgcggtacctatgtgtcgcgcgccggcttgactcccttggtaacaaaaagtttgtattcgcttcatccattcaaacgattctttgcttaaagtgcgggggctacgattcctagctctatcctagccctgcgtcgagctctgggtaccgtcgacgcccggggccccctgtgctagctcttctgtagcggctggctttggccccgctggctggctacggcgcccagcttagcttgatcgcgggtgaagattgctggctatggaaagttcaatcctcacactcacgaaaataatcatttgagtagatgaagtagaacatgaacagaggttaacaaatggcaggggcaagcgaggtacgtggcgtaaggtcacgggcccgagagaatataacaacgtttgctaaatatatacagaaaataagttcatagcctaaggtacgggctagcgagtcgccctcaggctggggcgaaaaaggcgcatgggtcctagtgccagcaaagaaagaataagagatcgggcccacatatcatcagactaggaaagtggcgtcaaccctgaccacctggggaaggttttggtcagggctaacgccaggggctactgtcggtgatatgagcccgatagtatcaggtttagagggaggaggctgccccccgatgccacgtggccctcccccgagggcagtcaggcccgaggtaggacgacggccactccttcctagagactggatggaggaggctgtcctccaatgccacgtggccctcccccgagaggggtcgggcccgaggtagggcggcggccactccctagccaagactagagggagaaggccgccccaggcgccacatggctcccccccgaggggggatcgggcccgaggtcgggcggcggctgccccctcccgtgactaggggtcgggcacccccgaccccctctctaggtcaccacgtacggtgggttaggtgtccgcttccaggtgcccatctacccgcatttatggcgtcccgagcggtcgcgccacgctatgcggcgtgcagtacactcaaccggtctgtgaccggtcgaatgaccgatgggactggctagtgcgcctgtgcgctgctcgtgtgtcaggcggcgtgcagcctgacatgtcccatcaaatagtgatggtgagaggttctcatccttttatcccaaccggagtaggtcctcccgctctggtcaaagcaaggctcccgtttcccggtgtaataggagcccagaagtcttcacccattaaatggtgactgacaggggcaccccccgtgtcaagcggcaagatttgacaggccccatcatcaagatgacgtgtgcttggcttcccaagtcaagagacaagacatgaatttaatgcaaagattataatacttctccaccagagctaggttaggttgttgggcccatgtggtaaccccttgaggtataaaagaaggtctaggcctagtggtggaggggggacttcggagcgaactggcgcttgggtctcgcaaccccaagcacttgtgttctacattcaatcaatcatacacaggagtagggtattacgcttctcagcggcccgaacctgtataaacctcttttgtctcatcgtcttggtggggcctaacgcccttagatcacacagctccgctcaccaagccctcgaatctcacccgctgctcccggccgaactcacaaaggggggcctcacggttccttggtggaggagttcattctccgacactggcggtccacgtcaccacaccaccagcgaagatatggtatcttcgctgtcgtcaacttaagagggccgccagagaagatatcctatcttcgctggcggccggcttaagatgaccgctagcgaagatgtgtttccgctggcagcccgtgacccccacgattttttgtgctggcggtttttccacttagccgccataaaaactattttccaaacgccatgaaaaatcgtttttctagtagtgacatcttcaatttgtataatagtagagatttattaattcctaaattaataattaatgtatatctaattatcaaaatttaggtgaattttgacgtggcaacaccatctagaacaaatgactttttgatatagcacactattaaatataaatattcgatcacaataatatgatctatctaattacaatattgattggttaatgtgtcaactcgtaagaagtgttcgtatatacatatctatagtagtataaaagacactaaagatgctgatgcataatatcaaggacactctaataagcaaataaataacactagcatattttttaaagaacttgtttatgttatatattattgtgtattttattttgcccacaataaatcatgggtattttactagtaaatataaatatatagatagatagatttctgcgtgttctcatgcacagcaatttctacagcccgcacgaaatctactacaacggtcctttggcacgatttggcaccaacggcagcatacgctcgctccggcgagagctgggggtttttgtcgtctgtcgactgtcgctgaccacctcattaattccatctcttcgtccatggagtacatcggtataccgcggcacgtcactgcgagcgatcgagcacgaacacacaggaacgagctagaaatattacgtacgagctgcatatatcgcgatcgcagcgactagcataggatagatcgcactacacggcaatacggcacggcgcggctcggctcggctcggctggttccgtgtgcgtgcactcatcatcaccctctcacccatctctctcggtcgacctctctctctcccggccccctccgtatggccggtcgatggggaaaagctaaccgattccgatgccgttgcaaagccgaaacgtacgcatgctgaaaaagcaattaatctagtatctgctactgccttctcgctctcgccgagcgggcggttgcactccctactgtgctactgtgctggtgcgtagtgtagatcaacctgcagatgccggtgccagcctcgcgcgatctcgatcgagtgcatgtcatcttccggtccatggttgatttgatcattgaggtgcagcggcagtacagatcagtggccgcgggccagccagatgctcgctaattattaccctgcagctacgatcgacgaggccatgtaccggaacggaaaaacgtatttctttctacaggtagtttccaaccggcctagctagatagctacttgtcctgtcaaatgtaacgctagctgctagcggcatccagtacgagagcatataattaacgtgcttttgtataggtgtactttggtttgctgctgatcgatcgcgatcgatctcgtgccgagaactcgttgtcatgtgtgttggcgatcgatgctgcactactgcaccggctagctagatatgtatacgtactggcagtgtcatccgaaactgcgcgtgtattgcgatgccaataatttagccggaatatataccccgagaaaaagcagaggatatatatagtactgtttctttcatacatagggccgcatggtgtaggtgtattggttatttggtttggtgcatgttggaattaatagatggggtaaggcctatttaaagattaattctttggaaaatcacaaaagcctatctcatgagatggcatgcatgtcgagtttagtaccaccttacttattctagaagagggggacctccttaaaagggaggatgccctcctagccacttgaagcatgtgtggtggagagaagagggggaacacgcgctcgctcgctcactcgcctcgcctcgtctagcagggcaggtggcggcgcgcgtgcacgacgtacgcgtcgaatggtccgcaaaattggctcctcacccttgctgcagatgcagcctccttttgcagttttgttttgctgcaggaaaattcggatttgttttgttttggaaacattccgaaaaattcggtgcgtgaaaacgacatggagtccggataagttacgcgcgacttatccggttcggttacacggagtggagatcgtgcgggcgccctgattaagcgacctatctctatataaaccgagccgccgccttcacgcaaaacacacaaaatcaatctagggtttgcctcctcctctgtgctgcgccgtcgctcgtagactactccatcccgctcgtcggcgtgcacctgcgatcgggagagcaggtctccggaacctctgccttcgacgtcctacactgggagaaggcggcaataaggtttttgggaagcgcttcgcgcgactgctccctgttcatccgcgacggctcgccttcctctccgctcacgtgctgcgcgcctttgtcgctgctcgcaaccgcgagtagttcctgccgagcaaccggtctttccgtcacctcggtacgtgttcgacatgttgcgcatatttgatctgttcatgttttactgcttagtttacatgtgtagatctaatgatgcgttaatgctattatacatctgtaatgtcatgatttatttatggaatatattaaatcattatatgcctatattctcaacaatccaaaaaccttattataggcgctgtgattttactatggctggttttgccgatgcactgaggccggataaatttaccggtgtgcactttaagagatggcagatcaagatcactctgtggctgatagctatgaaatgcttctgggtgagtactggcaagcctatgggcgttcttaatgctgatcagcagaaagaattcgatgaggccactactctctttgtgggatgcattcttagcgtgcttggcgatcgtctggtcgaggtgtatatgcatatcaccgatgctaaggagttgtgggatgcactgaatactaaattcggtgctactgatgctagcaatgatctgtatatcatggagcagtttcatgactacaagatggctgacaaccgttctgtagtcgaacatgctcatgagatacaaaccatggctaaggaactcgaactccttaagtgtgtcttacccgataaatttgtggccgggtgcattattgcgaaactacctctatcttggagaggtttcggtactgcactcaaacacaagagacaggaatacgatccgttgaggggttgatagcgtctcttgatgttgaggagaaagctcgggaaaaagatgtcgcgtctaagggcgatggtgggcagtccactgccaatgttgtgcacaaggcccagaacaagagcaaggggaaatacaaagctcagcagaccaccaacttcaagaagaaaaacaacaacaacaattctaatcaggatgagaggacttgttttgtgtgtggtcaacctggccatctggccaggaagtgtccacaacgcaaggggatgaaggcacctgcagggcagacctctaagtctgctaatgtgaccattggcaacactggagatggaagcgggtatggtaatttacctactgttttttcagttaatcagtctactaattggtgggttaatacaggggccaatgtacatgtttgtgctgacatctcattgttttcttcttatcaggtcgcacggggttccaccgtactaatggggaatgggtcacatgcttctgttcatggtgttggcacggtagatctgaagtttacttcgggaaagatcgtgcagctgaagaacgtgcaacatgtcccttctatcgacaggaatcttgttagtggctcccgtctgactagagacggatttaagttggtttttgagtctaataaagtagtcgtgtctaaacatggatattttatttgtcaaggtcatgagtacagaggcctgttccgcttttccctttctgatttctgcaataagtctgtgaaccatatttttggcagtgtggatgatgaggctaatgtatgacactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggacaataacttggcacctctagaactcctacactcagatctctgtgaaatgaatggggtgttgacgaagggtggaaaatgatatttcatgacgttgattgacgatgctactagattttgctatgtgtacttgttgaaaacgaaagacgaggctctagactattttaaaatttataaggcagaagttgaaaatcaacttcacagaaagataaaaagacttaggtctaatcgtggtggagagtttttctcaaacgagtttgacttattctgtgaggaacatggcattatacatgagaggacgcctccctattctcccgagtctaatgggattgctgaaaggaagaaccgtacactgatcgacttggtgaatgccatgttggacaccgcgggattacctaaggcatggtggggggaggcattgttgacctcgaatcatgtgttaaacagagttcctaacagaaataaggacaaaacaccatatgagatatggattgggagaaaaccatcactttcttacttgcgcacatgggggtgcttggcgaaagtcaatgtaccaataacgaagaagtgcaaacttggacctaagactgtggactgtgtctttctgggatatgctcaccacagcattgcctatagatttttaatagttaatctgaggtacctgacatgcatgttggtacaattatggagtctcgtgatgctaccttctttgagagctttttcccaatgaaggatacacatagtagttctagtcgaccctctgaaataatacccagttcaatcacaccaccagaacaaactgaacatacacatgaacatgttacagaggaggatgacagtgaagctcctcgaaggagcaaaagacaaaggacggctaagtcttttggtgatgatttcactgtgtaccttgtggatgacactcctaagtcaatttcagaagcatacgcatctcctgatgcagactactggaaggaggctgtccgtagtgaaatggattccattatcgctaacgggacttgggaggtgaaaacctgtggggtgcaagtgggtgttcaagaagaagctctggcctgacggtactattgaaaagtacaaggctcggcttgttgctaagggctatactcagaaagaaggcgaagatttatttgacacttactcacctgttgctagattgaccacaattcatgtgctactttccctagcagcctcacatggtcttctcgtttatcaaatggacgttaagatagcttttcttaatggagagctggatgaggagatctatatggatcaacctgattggtttgtagttgaaggtcaagaaggcaaagtgtgcaaattgttgaagtctttgtatggtctgaaacaagctcctaagcaatggcatgagaaatttgacaaaacattgacatttgcaggctttgcagtcaatgagacaaataaatgtgtatactatcgccatggtgggggtgagggagttattctgtgcttatatgttgatgacatactgatatttgggacaaaccttgcgtgataaatgaggttaaatcattattgtctcaaaattttgatatgaaggatttgggagtagctaatgttatcttaaacattaagctaattagaggtgagaatgggattacactcttgcagtcccattatgtggagaagatcttgaatcgctttggctacattgatagtaagcttctccaacaccttatgatcctaacttgttgcttcgcaagaataagagaattactaggaatcaactagaatactcccaaatcattggctcgctgatatatctggctagtgcaactaggcctgatatctcctttgctgtgagcaagttgagccggtttacctctaatccgggagatgatcactgcgtgcgcttgagcgagtaatgcgctatctgaaaggtactatggaattggggcttcactattctgggtatcctgcggtattggagggatatagtgattctaactggatctctgatgtggatgagatcaaagccactagtggatatgtctttacactgggtggtggtgctgtttcgtggaggtcttgcaaacagactattttgacgaggtcaaccatggaagcagaactgacggcactggatactgctactgttgaggcagaatggctgcgtgatctattaatggatctgcctattgttgaaaaaccggtgccggctatccttatgaactgtgacaatcaaacggtaattgtcaaagtgaatagttctaagaataatatgaaatcgtctagacatgtgaaaagacgattgaagtctgtcaggaaactgagaaactctggagttataacgttggattaaatccaaacagttagaaacctggcagatcctttcacgaagggactatcacgaaatgtgatagataatgcatcgaaggagatgtgtttgagacccatgtgagttatactatggtggtaacccagtctatgtgatcggagattccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgctgtcctgcaaagcattcatgaaagaactcacctttgtaagcttgactgttggtcgcagtctatgaagattttgggtgaatcttctaggaagcttactaaagacctaggagtatgacttatatgctccacccgaggggtagtctacagacggtctagtaccagataagactttgagtgaaacttgcttgcacaagacatgcaattcaaggcgtagtccattgttcaagttgtgagtaagtgtagcttggagttctaggtggatgttcaaccttgatcagtctccatcgaaccgttggtatataaaagtacattggaaaaggcaaatctcagtgggattttgagatttggtgggggattgttggaattgatagatgggctaaggcccattcgaagattaattctttggaaaatcacaaaagcgcacctcatgggatggcatgcatgtggagtttagtaccaccttgcttattctagaagagggggatctccttaaaagggaggatgccctcctagccacttgaagcatgtgtggtggagagaagagggggaacacactcgctcgcctggcctggcctggcctggcagggcagg

SEQ ID NO: 40613 - DNA, 1871 bp, Oryza sativa
agatccgatcctggtgatcttcagccccggttggtgctaccaaccgggactaaagtcccacccctatagatatgtcttcttccttctccagctgcctgagcaagcttcaaaatttcttcaaaaaagaggggaggtcatgccaaaatttttattgaatttattttggtgattacatacaaatcggaggtgcctaaaaggtttgcaacttcatcgtccaatgttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattgtttaaaactttacaaatagtatttaagaattatttagtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactatttatttccacttgtttgagtcggggttcatgccaagctataattgttggacatcccacggagagcaaggtgttgaaatggaagaagatgaagtggaagacgacaatattccggactttgctcagtatgatggatttgaagaaaatcaaacgggcgaggaggaaatagctgctgatggtaacgacattgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgccaaggcatttggcgatttattgaaactcgtcaagaacattcttccggggggaaacaaattgcccgagacaacgtacgaggctaagatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgatgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacacccagccgatggttcgcagtggcgaaacatcgacagaaaatttaaagaatttggaaaggatgcacgaaacatacggtttggtttgagtacggatggcatgaatccttttggagagatgagtagcggccatagcacttggcccgttacgttgtgtatctacaacgtcccccctggctatgcatgaagaggaagtacataatgatgccgattattattcaaggccccaagcaacctggtaacgacatcgatgtgtacctaagaccactggtcgaagatcttaaacagttgtggaagaaggaaggtgtccccgtgtgggacgaggacaaacaggaggagttt

SEQ ID NO: 40614 - DNA, 1068 bp, Oryza sativa
tctcccaattaagcgcgaagcttccgtgctttactcacccaagatcgcgatcgagaggcgcggctcggctcgggtcgctatcggagatccatcgccgtcgacccccggatgccgtggcgcgaggctcgcccaagcgttttttttccgctcgagcgttcgagggttcgagctctagctgacacggcgtgagcgccataaattctcctgcgctatagctctcgccatcggcgtcacggagagaacagaggcagctggaagctgacacggcgcgggagcgcacgcacaggaagccgtttttttccgcgccacggacgcgagtgagcgctgcaggaaagcggcatgtagcagttgcttgaagggaacggaggatcagttcgagatgccatacggacgatcggacaggagtcacaggacaagcgagttacgtagggaagcgcacggctggcaggaagagaagataccgccagataatttgttgtagcgttaaaatctcgcctttttttatcgatcacgaaagacatacacgaaaacctgcgaccatataggcatcttcttcatgctacctcggtttgatcaactcacgctttttaaacagctaaataatatatttcgcggaaaatttttttatatatgtagaagttactgtaaaatattgaataaaactattcgttaagtttataacaattaaaactcaactaattatacgttaatggttttcttatttttggtgttctaacttctttatttttatcttaagtagaaacgaacattaccttatatttacataccaacgagcacatacattttaaggtgtacgtttaacatgcgtttaacagtaatatatcatccatatcctcgttgtgtatttatttattagtgtttatgcaactactataacgtaaaactgaaaaaattctcagctcagcaaatttaatttgtccattcctgtcatccacttgatagtactagttgatagtacaactgcgagagaggtttttcgctgatgaatgcagtgacatttggtcgtgcactcttgcaaccttgtgagttgtgacacagaatttgagg

SEQ ID NO: 40615 - DNA, 871 bp, Oryza sativa
ccccccccctcccaccccctaaaagaaaactgtttgtaacatcagaaacacatagtctatactagtatatagttaatcagctcttgccatttagtatttaaacatgatccttttcttatcttctcatcgtttagcttccataattataaattagattttaaaacttaatttttaagttgattgagtttcttttatcatacttcatttttcagcattgttttataaacctctaataaacataaatataaaagttttacccctaaactattttttattttttccactgcccaatgtatcgtgaggagttccgccggttcccaactcccttccttaattagaacgtgccaatagctgctttaggaaaaatccaagctactatcgattatactgtcatcacttcagaggttcgacttgaggaatttggagtgtgatgcccctgcaattgcaacgacctaaacctatttgtatggtccaccgtgatttttccaggatagttgtgtcttcattttgatggtacttgtcgttttaacaagaacataataaaaagtaatgtttgaccactattttctattataatacatataaaaatattaataaatatactattttattagagtaattttaaaaattaaactatacatatggatattttagaaataatttataattaaagattttaaaatttcacattagacttgttcaaaacgatcgataagtattacgaacatgaaaagagtattacattgcacatcctaattaaaaatttttagcactgtaccctccgtcccaaaagaaattaacttctatggataaattttttgccgagatacgtccagaagttgttcattttaagagccagtttaagtttaat

SEQ ID NO: 40616 - DNA, 2989 bp, Oryza sativa
tgttaaggttggtttgaagcagaaattctagatgcctatagtgatgtatgacaaaagtacaaaaccacaaccagaaaatagtatttctattatagaacatctaatgcaaatcaccttgaacataaccttaatctagtgcataacaaaattgaacacatgttagctcataccaacatgtgcataaaaatgctgatattgaattcaaaaggtttgctttagtgatatacaagacaagagtaaagcagcagcaatcactaaccttgttgttttggtaccttcctccatacccattaggtccatagttcacagcattattatacggcacctgtgggatcatatacccaacaggaacaccagggtaactagggaaaccaaggcctgaaaacaaaagaagaggaattcagataaaatgatcatgcagtaactgaatggacatagcatgtgaacgcattcaacatgatcactgaaacggaaagagaacaatcgtgcagtagctgaataaaaattcatgcagaaagctcatggctgccaaatggtacgagtgaccaagcatgttcatttgtgacctatacaatgcagtatatgaattccagaaaagaaatgcagtccgagaattaaggcaccccataataagaaaagtagccgtttgacaccaaatcaaatattgaaatttgtttacctgcatatggaaatggggaactcagattaggtgggtagtgaacgtcctccgataacttgcttaatatcaaatatattgcacgcatctgatggtccaagggtcctgtgacagtaacgagtctatcatgcaaaccaacaaaattgttatcctgtggtgaaatcttgattccagcatgtgagtcttcaatgaatgacctgatgagaaaacaagcatgtcaactcacattcaaagaaacataaaccaacacaaaacaatacaaatgaaacaacaaatactgcttgcgtacaattgacaagagagcatgcaataacttgggtgcagttaagtcaaagatgagtgcattaggaaaataaccatgcatttcctcattcggttcagacacgcttcatggtatacatacattataaccaactaagaaaatgaagaagcgcaatgggaataagaataaaaataagatttcagaaaccagaaacaaatttatcaatggtacatacttgattgttgaccctcctttaccaatgattccaccacaagaactgttaggaactacaagtctaactttaggtctagcttcagcttcattgctttcttccccctgggaaagtaaccatagaataccaatcatcaaataaagtaacatggccctatgatacaactatttgcggaataaaatagtttacctcagctaaaagcttctcgagaatcagctccatggcctttattacttcatcaaacagaccagaaaccatgataattctgtcatttgtaccagggaagaactcatggctacgcgatagctgaatacgagccccagactgggactgaaattcattaatggttgatccacccttgccaataatgcatcctgctgccgtgtttgataccagaaacctcagatgggttggcttctccttgtcatctgtggagaatgatcacttggaaattcagaattactagcaataaaggagagggccaaaaactgtgcatgccattatttgtttaggcacaaaattgttttttttaactcaagcaacaaaagtggtccatgatgcatagtaaaaacagctaatggtccaactggggcacttaactatacatgttctgtagaaccactactgactgaattttggtttccagtcagtgtagtttagaagtttggtatatacagttgtgtcatgtatgcttgttgggaacaataacaagagggtcattcacattatgaccgaattatattttggcatggtctatcatattctccttgaacatataacaagttaaaaaacatgaattagcaacaagcataatggtaggaatatgctacgaacagagtgaaagcagcaattgacaggactgagttaaatacctttccactcaaggtggatcaggagaactttatatttcttatattttgatgtaactaatgaaccattagaacaaccaacatataatgataacactttaaaggcaataagtgtgtcaaccaaagacccgaggaaaccataatggacaagattaatgattggcatatgccagaaaggtgagatgtgcttgctaaatagagtgtgcatgacttcgcatttcctgtaagcatcctcttgttccccaattgcaatttccccgaaaaaatatatttacaggccaacaaccaacaaagtgaaacaacatccaatatcagttatcacaatgttaagtaaatggctgggtgtgttcagactactgtgggatagacaatcaagatgtagggttgaattcctagaatacttattatatctacgtgtcggttccactgcgaaaagtagaaaaccctgaacatcaacagagtgacagacccaaccacggcatcatccagcaagtcatcgctagtaagagtacagatagcgatgcatatcggtatacgtctcatgtggtcaactcaactctacaattaaatgatggtactcatcaaattgcaactcttatgtgtaagctcattgtatatgatcacacatgcagctgttactaaccgcgcttggacatgttaataaacttgtgatgcatacacagaaacgcatcggatgaactcatcgtcaacatcaaccggtgccaaatcaccccagcggacaagatgaacatgaaatcaactaccactgaaacaactgatcgttgcatctcccctctccattgcacaagcgcacacaaacgcagaacacgcccaaatcagcagcggcctagtgttatccatgtgaccaccatatttgccgcccgtggttgcagatctcgatctcagagcggaacacggaggcctggatctcgcggatccagaccaaaccg

SEQ ID NO: 40617 - DNA, 14321 bp, Oryza sativa
aggcgtggaggggggagagaggcaaaaaaacactagtagatcgcgatgggcctacggcatggaaccaacaacaacgacaacaaatgcgcctctcgcttctttctccctcctcccctttttatgagtttttattatccttcgcttttctgtttttcgagtttccattggtcacgtcgcaactcgccactctttctcaatctcttttttttttgttgttgcttgactttgtattcacaacaaaatctaatctaatctggtcttggtttgagcaagtttgttttgtaagaatatctgacgatgcaatccatccagctgatctgcataagtatgggataatagaccaaaataaaataggagtacgacaccagctctaaatttcttcaaatccaatgtgtataatttctttttgtcccctaatttcttgaaatcctgtttcaaaatgggtggataataaccactctgaatgacaaaagagtgtgtgcaagtgcgacagaaagatcactctgaaagtcccaaaggttttggtcacaattcgggttttggtcacaattcgtcctttagctggtgcaacaacagagatgacagcaacgtcctagctatagagcttaagaggttgcacaccagatcattcatgctccaacaattatgaatcttgatgacaagagaaaaaaaaaacaagttcgaatactgtatcattcaaacctgtcgtttgcgttaactgttcaacagaaaatcagatgtcctatagaaatcccaccagaatcaatcacatgcgcatcagattcattgcctgaattttcttatccgttttcttatacttatatctacaagccaacccaagcaagcgatttcactcaggaaagtcaactctaccagcactaggctccagctctctcatggtcatggatacactcacagcatctatctaattcaagtaagattagcaagtgggcatttccaagacagcatctagacacaaaacttccatcctccaacatgtatttttctattcgattgccacgacgcgaaataaacaatgccaccacccttaagacccaattgacctcttctacagtttctatccatcacacaagggcagaaagtcataacagataataatacaacacggagaaaaagattaaagagaatgtactctggttcattaacttagtgatatctctaagctgccaacaaggtgccgtatctgatagcataacgcattctcaaaaagggaaaatgcaacaactaaccccagtaacccatgaacgtatgctttcctcaaaatgagaaccaacgaattcggtacagccattggtggcacttggcttcatcttgcactcgtgcttgtgctggaagccttctgttgtttggccttctcaaccaatggctttagctgcttcttttccgccagcatcttgagaaagttgaatagaaagggaatgtagttgtgcttcctcctgatgttctccgtcctccacttcttgaacttctcttcttccatgataatcttctcgctgacagtctcaatggctgatgtcacctctgcaagttcgctgtttaaggactctgctgctgaggactcattcatctcctgcaaaagctggtcccttctcttctccagctccttcagctcagcagtatatacatccttcctattcttaatgatggccataaggttaaacctaatctcgctctgggaatagcgttcaattcttttttgtataactggctgcaccatccttagccaatcaagatcatcaggcccaccagaacactgcccaaggcttatgggtccttccttcaatccatcaagctcatagaggactccttcaaaaggtaaatagcttatgaaatggtacacttcatcatccttacccgcagctctttgctcatctgagacaaatggctcaggcctggcaaaactgttatgggctgtgcgaatagaatcactgttgttaatagcaaggcccttcatgtcaggtgcaaaagctcctgtgaattccttcaagttggatagttctggacctatgtcaatttctgggcgattcatgaggattgacagaatagcttgagtagcacatgcattagggatgacctggcagtgattgatttagttagatcaaatgttaaatccaattctgaacagaggtagctaacggagcaaaatggaactaacctggctagcaaagaaaaggtttgggtttggatctttgacgacaggccgttcatccttttccccagccatccacttgaagagaaaaattagcccataaactggcctatgagaagtggacaacaatgtgttaaggccatccagagaacagagacgcatgacaacaaaaaattgaagagactcaccgcagttcactaatagagtccacatcaagagagtaaagttcttccacctgtttaaagatacaatagcaatgtaaaaggcagctaagagttatttaataaagtcataaactgaagctaaatgacggcctttttttctgacaatgccaggtccatggccatctgttgcaattttctagaatttcctaccactaactataaaaggacagggcaccaaaagtggaagtatattagatttgcaagtatatacaacgccaaaataaaggtcttttccttttgtagctgagctaacaatattaatagacatatcgcactgatctgtgatgtatattcgttaacccttactagttggccaccatattcccttcagaaattattactaccaaacaggtattgtcctactccatatccttcacaagggtattgtttattacattcaagcacacagctccatggtatatgcagcaatatgttttcccataagcgttgtttagcatacactctgctgatcatagagatatatagtgtggtagttacttaaagtgagttcaatcaggttaaggttagcttcacaacacaagcaaagcatatatcttcagaagatcagttaaacatgtattctagaaacagtagaatcaaccaatagagccaaccatccaatttacactgttttacaagtaataattaaaagcctaaggacatatcaagaacacttgatatagatttcgtttctaacaatttttcatggtaggaaagaaacaggccctggaagctaacctgaacaccttttacttgcatctcctggatcaattcggtgaaaacacctacaggtcatatactcaggtgaaacaacaggtatattttggaaaggcaatggtaagaacacttgaaacgtaaaaataagcactgcgataatctgtgatgtactcaggatagcatgatcaaagctttattttcactcaatcattcgcaatgaaatgtgtaaggtgagatcacagtattttggtacttcatccatgattatacacataccgaaggaccccaagtggatattagtcagatgaactaatggagtaaagactttacacatcaaaattactactagaaagtaaccctcggcttacagatactagtaacaaagtaaaaaaaaaaaactaggtaatatatattccccacagtgctcaatcgatggaaaaccaaaggcaacaaccatccttcctactaatgaataaacacaatacattggctagcatccagtaaacctcccatgaacaacatgcaactaatgatatagacaaagagatataaactaaaactcaccgggatcagactcaatcgtgcaccacgacatcctcgcgaaaaccctgaaagattacggtgacagccagggggcgcggatccaacctgggacagaaccacccccaaaacctttgggggcaaaaaacaaactgttacttatattaaaaggagattaaagctctgatgaaattaagagaaaaaagcttcttccagatctagaagagaagctagggttaacgcgagcaagcaaattcgagacaaaagtgtgggtgagactgggagggagagagagatgaatgagaatgagagagagaggatgcggatgctcaccgggatgaggatgcacaaggacggcggcggcggcggcgccccctcccctgctctgctcgccagatgcgcgacgagcggaaggcggcgggggagagaaactcgagtcgaggcgcaatgattttggaagctaagataagatttctttttttattacttatttatttaccgataaattggtccaactaaaggaggaatttaagtatttaattatttgtcactgataggtttggcgaactatttaaatacccctttttttagatttatttttacttttttattacacatgagaaaagatgatttattaactatttgccacttatgtcaacgtgacatgccaccatggcttgctaacgtggatggaagcgtgggcccaacaagtcagcctttcaatctcagtatagtttcaacctcacgacacgggtttgagatgcttgtggctatggctggggaaaagagcggtgaggtcgaccgcagcgaggcgtggcggagcctaggcgagcaattgtaattgtgcccggcaacaaagcggggagctagggtaaggacgagcttgtcctcgccactggggagcctcaggaggtggcgggcgaagccgtcgatgaggatgttggccggccactgacaccttcgtctcgatccaaagggttatcctcctcctcctaaaagcaaccgaaatccctcgcccgttctcttcttcaactacaatgtagcaagcaacacttttcttaaaaccccatcgtttgtcccgtattacaagaaacgtctaggagtcttccgcctaactttacgaggtggttgtcggagatatgggcctgggggtgtcagggttacgggttaggcataccctttacccttcgatatacgttacatatcgatatggcatacccacgcgcatgcggatatttcctgtatattctaaggaaacctttcacggaatctacagatgggaagaatcctactcgggcaggactgggtcgttggcgtatcgtataaggtctgatacctccgagttctatgaggagacctccacatctgcgatataaaaggggccccccggggagggtttaggcatcgaatctcagagctaacacaacctccacagcctacgaagccggagcttataaggagccaagtcatcgagagctagtcgaatcaactcgactacaatctcgccggatccgacaagttcccttgttctctttgtaacctgtgttttctatcatataatctcacatcaactggattagggctattacctatcaaggggcctgaaccagtataattcttatcttttgtttgcttgatgtcgtactacgtagatccttgttccaacgtaccccaataccctctatatccagtctacgggtatcacccgtcgacagggggtatatgaagtagaggggaattactttccctccggccacgtgactctgcaggctggccccactcacgcgtcacacgagtcgtggaagcggccggggggggctcggggcatgacgtcaccccctcgggctctcccacggcttcgccccgaggccctcacccggctgccacgcggcggagggagagagcgagaagggagcacaggctgaacagccataaatgtgcgacgccccaactgtccctcaccgcatttaatgcggtaagggcagacgtgcggcgcgcctagctaacctctgtccaacggatatgaccggtctgtgaccgtcatatccgatggatagggcaaccatgtcctcacgtcgcccttgtacccggcggagtgggggtgggtatgacccgtcacatccgagcgtcactcgaggaagggctatcgcaagtcatcgttcatttatgaggaaatgacagggctgtcccccgtgtcaggcggggggcggcgccgggttccactcgagaaccggttattgcttagcttccgggagaaggcacggtttgaagcccaaagtggagtgggatccccctccgatagagggtaggtagaggcggtgcatgtggtatccccttgagctataaaaggaggaccctgcccactgagataaggggacgatgcccagaaaacctgaactccagaagagagaaagtgagcgcgctttttagagtgaagaaacctttgtaaaactcatccataatcgcaaacacaggagtagggtgttacgctccatagcggcccgaacctgtataatccgattgcgtgcaagcttgccggtaatcttagggacgagcgagtgatttccgagagacgagcctccgcccccggccgaactcacaaatggggggtctcacgactccccgctattgaggatcttccctcgacagtggtgtactagtcagtttgggttcatgggttcgaaatctcagacattctatttatttgatactacctctgcctcaaaatgtagcaacctaagataggacgagacccatcctagaacaatgtatctagacatatctcatgtccaaatacattgtcttaggatagaatgtcatgtccagatacattgtcctaggatgagagttgttatattctgtgacgttgggagtattaggtttttctctaatatttgcatttgttccatattattgtttaccccaataggaaattagaccgctgcgattgatagaaaatactccctccatcccaaactataagcatttttggctttactggctgttcgatggaacactaacggtccaacggtccgggtcggatcgcagaggagaggaacgtatcaatctttcagatccttgaatgaaatgcaaatacgagcatcttatttggaaaaaaaaaaagatgaaatgtgtatgagaattttggatggagggagtaaatcgcaataagacacattagctgcatcgataggggcatgcatttcattgattttctcttctcctgcctatacaaattattcgacttcaaaaaatatatatggattacaagtagaatgctgaacaaaaatatacatttcccttttatgatccttgctactgcaacatatacatcttctccccccaatatgaactaacaaatgtacagctcaaaaagcctccaagcaccatgatatccgtgcttaattccgaggcaaagatagacatttttcttttatcccacaattgaatctttgcagaaatacaatcgacctgacctgaaaattcacattctttttgtacatgtcctgatatccatgtcttcttcatatatatgttctgtaccatttttcagttgcttctgatgagcagtaggccaatcccggtgacgatgagcgtcgccgggaagccgaactggaggtggctgaagaaggagagggtgtatccgtactgctccgacctgcgagcttgctcgcaaacgatcaagttcgcggcggagccaaggagggagaggttgccggccaccgtgctgacccaggccaggatgagccaggcattggtctctgctgcaggggagatggccgctgctgacgctgccacccgagcaccaagcaggagaactgcaatgagatttgtcaggtatatacatgaatcaggaaatcaaaagaaagaatgcccaactgatttttgtacgatttttttctggtcactggaagaaactaggacagagcaatctttaactgataagaacttcatggttatcagctatgacattcacactttgtttagaaccagccccaaattcagactccaaaatgaacctattgttctttgatatcttgttctattaactatcatgagtaggtgagtgaacctagtggagattttctggttttttttggaagcgagaattgcgcaaagtgcaggatgacagataaacttttcctctcatatgttgcttcattgctagacaaccatggcacatatggcattgtgagcttccattaaaaaaagaagcagctttcctttctactcttgacaagcatagcatggaaagtgcgaagcacatgtatcgttaagtctacgctgcttccttgacttagttattgtttaaaatctggatggattagtaacaacaaggatgaaaatttctacatgtgccatgtgaaattattgaccatgaacagagggcagaactaaccagttggaacatttgacgccacatttgagaggagaagaataaccagggcgaggattactatcccggtcggtgtatcgatccgtgcatagggctccatgaattcccagaatgcgctaggaatgcccgtcttgttgaatccatccacagtgatgaacatcccacagaagaagagtagaagtggataggaaacctgaaatttcattcagcaaaactacagttaacaactcaagttaacatcagttaggtatccaaaaccaacactaaatacaacagcagagccattggtgcacacaattacttcaatttagcaacaacacagggatgtgacagaaccaaatgttatcgaaaatcaagaccaaagtactatcatcaaggtgacaaggaacttgacaaagtaatcagtgtagttcgatatgtttggattatcaagtaaagactcttgtttcaaaatgaatggcaatctactgctatgtgaaaaaaacagaagtaataagaacatagtgctacatgattggattgtatactgaaaacaaatttagtgtagttcagtatgattggattatcaaataccaaagtaatgacttctgtttcgcagagaataccaatcgaagtgattggattgcctgtaaacaaattcacccaaggaaaaaaaaggtgccaaaatttcttttttcatacaacctgcgtcaattcagctccagaattcagagcgagtgagagcgacaacacattggtttccaaaataagagcaagaatgaacatactagtagcagtccataaacaactgaaaatgtaccgaaatttcgtttttcacatcaattcagcatcagaattcagagaaatttcgtttttcacatcaattcagcatcagaattcagtgaaatttcgtttttgacatcaattcagcatcaggaattcagaattaccttctcgaggcaggggcgggcatccttgaagtcgaggacgatgagggcgagtgcggcggtgatggcgctccatgacatgttgagacccaacagcagcgccaccagcatgctcaatgtgatgacgtacacacccgtcttccacaccgtgctcttccattgctccatggcctcctccttctcctccacccaccggaacgcatgttcctccttcatcctcacgccgccgccgacgccgcgcgcctctggtggatcccgacgacgacggcggcgtcggcggcgtccggcttgttgttggagtcgccattgctggtgacagggacgggcttcactggctcgaacacctcgcagtcaggcgacgacagcgagctgccaggctgctggtggtggtggtggtgggaggaggaacgggggtgtgacatggtcgccggcgagaagcggtgggaggtgacgtcctcctcttcgacgacgtcggtggggaccggggcgacgacctcgacgcacttctcgtcggagaggtggcgccagtagaggcagagcaggatggcggcgttgacgacggcgccgacgagggtggccgggaggatgccgaacacgaactggccgaaggagatgccgctctggacggcgatgaccaggttctgcgggttgccgatgggcgtcgcggcggagccgatgttggcgctggacgcgagcgccaggaggaacggcttgggcgggaggttgttctgccgcgcgatcttgaggatgaactcggtgagcacgacgcagcaggtgtcgttggtgaagagcgccgacgcgagcgccgccacgacgcaggtgcggacgagcaggtccttgccgccctggctccgccatgacagcagcctcccgaggtgcttgaacatgtcggcgcgctccaggtagacgctcaccaccatggtgccgaacaggaggccgaggatggggaggtccacggcggcgtacgcctcgtcggcggacatcacgccgaacagcaccatcagcatcgcgcccagcagcgaccccgccgtcctcccgatcggcaggaatggcaccgccgggaacaccgccagcacccagaagatcccgaacgccgccgtccccagcgccaccttcaccgtcggctccatcgccattgccgccaatcaagaacagcacacagatgggtggatggatatacctctttttcccaagataagattcacaaggcctcttcttctctacacactacactggagaaagtatggatctagctaggaattttcaccaagaaatctgaacaagaaatgggattgtattgtatctacaataaatctggcaagaagaagatctaccactctcttgctcccaaagctagcccaatctgcaacatggctcacatggacagaccagctccaactccaagaacacaagagaagctaactagaagaatggtcaactaattgtacatggagtctctgaacaagcaaccagagtggaatgagcaaaataataattcagcaaagaaacaagcccaattcagagagaaatggggttgggggaatcactgccagtgaggaggaggaggaggataggattgttgagcagatgagccaatgtttgagagcagataattctgtggatttctagcttgggattctttccaagaaggtaaatgctcacacttggcgagctccacatggcctctccatgatcgattttttttggctctctactaccctctactcttctctctactcattgatgaggatgatgtgtacacccaaagaaaaaagaaaaaaacattcttgtattttcatgtgcagaaaaatggttggcgcatgtgagctcactcgctgcggtctgctcacctcatttgtttacatgaacatgattactacagacatgtctctattggatcctagctgcacaaggaataaaatgtttgatttctgggtttatatttgagaatttctcctggaaacttgacaatacgatcatgttattaccacagagttttttttacttggtaacgatgattcaccgccacatgtaagaatgttgctttcatatcagctgatttttgtatactattattgtcactaattgacaggcaaagagatgcatgggtggaacgtttctcaccctctgctgagtcttaaaatatcactaactactactagtaacatattcagatgaattattacctcatgcctcttcatcagcttgttcaccaatataacaaactcagctaaattgtctacgtgaatattatatcactaaattcacacttaggggcattttatttatactctaatataaaggcattatactttctctgttaataaataattgacggatctcaacacaagtattgtacttcctatgtccatttataatatatataaatatgatttattttgatatgacttgttttatctttaaataaactttaagtataacttatatcttaacatatctatattattccgttcgtttcatattgtaagtcgttttaacttttttttagtcaactttatttgagtttgaccgagtatatagaaaattataatagcatattatcaaaatatattcaatgctagattaaataaaaccaattcggtattttagattttccaaaaatttagtcaaacttaaacgagtttgactaggaaaaagccaaaacgacttacaatataaaatgaaaggagtaaatttttaaataatgcgaatgatcaaacattatttcaaaagttaataacgttatgtattaaaaaaacaaatatagtagatgaatttcaacagttgcttctaagtgatatcaaagcgaatatatttaaatgtaagatagtactagtaaactatttctggttacaaatctaatggcataattttaatgctaaatagttaaattattaaaaaaaatattgttcgaagtagaacaactcaaagtcaaaactagcatttatctataaccagatgggtcgataatgattatatacgattgcatctcatataggttatagagaaataaaagatatggtgctatggtagtataacctgtgacgacagttcctgttactgattggttaccacaagtttggaagttgatcacttctgcttcgccctctcacaatttaattagtgagcatgtttgatatgggcaggcaatgattgatcagggagaatattaaccacgcagcggggcccattgacagggacagaggccgggcaatcgtggtcagcttaagctcaccggcggtgagacggcggcggcgaagagaggcctaaattattgatttgtgaggtgagagaaaggggccacaagggggtttggtgatagatcaacgttatcctcaccattgtggcattgtctctctctctctctctctctctctctccctcagctatggcctcaaatctttctgttccattaatcacccatgcttaattaagtttatctccgtgcttaatgcggattttgactcaagctgcatttttcttgtttccatttttaataggaacagtactatgatatttgctgttttgtgtttcgttttcatcggtttcaattggacgtagattgattttgacccaaacaaaaacaaatatcaggaacaccctctgttctgtttagttcaagctctcctggattgacattatttcatccaagctatataattccaatcgtactgatagttttatttcgtggataattatgagaagcaacacaagattgatagatacgcatatgctcatctcttgcgagaatgcatgggaaaatattttcgttagcgatgcgtctcttgacaagcattggggtcattaaatcttgacatatcagtgataattattgctcgtcgggtttctctatgtgcacgatcaacgtctcgtgatcttgatgtaatctctggcgggccatcaatgaatttcgtccagagttctagccagcacaacgtaagagctctgattgattttttttccagctcttttgttcctatccaggctcagcaactacaacagaacaatcctcatacaccattaattatgaaaaaaatgacgtgattaagttaagggtagaataattctcatttcagaatgaccatgggtaatcaaacattcaaatataaacagtcagcacttggcccaatttaatatacagagcacaacaaaatagtgttgcttacagaatttgtgataagagatgtgacatcacatatgccaagacagaattgaaattcttgccgaactggtaagcacgacagaacaatattttcaagtttcttctgctaaagccaaagcacaactaattgaagaggggatcagagtcatttgcttgctccactctgacaatacactgctgctaggaagagttctactcttttcgctagtttattatgtacataaacagcatcagtatcagaacagccagtcagttaaggaggatacaacagacgctacaccatggaagtattatggttttataacaacaggttccagaatctgcatcacctttagtatcttatgatgatattagctggacactgagttactaactaactccaacttaccgctaaaactggaatattttgcataagtttgcatctcctgcagttatgatgatggtatctggggaactgagaaacagcaggagcaaaaatgacagaagcttatttcttcatcttgtaagattatggtcagtgcaactgttagctgacccctggctgtgccactgggaagaaggaccagcttttccttggctctgatgtgatcccagcaactttctcgtttgcccaccagtctgatccaacgctcggctccacactaggagcatcaacattgttgaacttgaattctttagccttacgaagggacaaggagcgccgtgctttctcaggcagatcatggtatgtttcatcaacacatagccctgctcttgtatcattcgattctctgggatgaatgtgatctccgttaccggtgggcacaaggcgaaaagaagctgcagcagactccccattaatgttggttttcttctcaagacagcgagctacatcttctactgttaactcaaatgaaacccgatgatccatagcatgatcattattttgaagtcgggcagagaagtctacgactggtacagcagcagaaatatgtccatccaagagagaaccgccattgcgcatatggcgaggtatcaacttctgtgttgcaattccctcgccatccagtatctttggaggctcacgaactgggaatgaggggaatgtggaacgtgaggaagtctgcacctcagggtcaggaaatggagagcaagtccctgaacaagctgagcttggagatatcagacgtcctattgggctctcagg

SEQ ID NO: 40618 - DNA, 5893 bp, Oryza sativa
atgtgacttaagaagattactattgtagcataaatatttggcacataaacagcataagcacagtcgagtacagtagcctgcacctagcttttgtcagacatgcattctatagcgattgtattgcagagttaggatgaccaataacgtgaacatgtaaacaggttggcaatagaaatatagcatcatcgagctattaggctccatgtaaccgtaacgaaaaactagaaatgaaattccacaaatcatcaaaattacgtcatagatcccccattagccaggtaatgactttccagttcaaaataaaagcattaagaaggtttcataaatgatcatagccacgagataacccgaactaaatagcctggagagtggctatcatgaatgagcaccatagtgctgcatttccctatgagaggtaatctcagagggaaattaataatatacaaagatgaaagcccaaacagcaggccatgtaataaaaaaaacaagaatgaccaaggcctcagcaagttaaaataaaataatggctggttgcatacttgcatatggccagcacaggaagaatcttttggtcccatctattcctctgaagagttcaaactgacagtttcaacaattcccctcctttgttctcacagtatttataatggtaatttatccatgcatattttcaatgttttaaggtgatacataggtttcattcaaggtcaaacatggtaatatataccggggataaatgaatcatagattgcaatagctagaaaaatatacagcaggaactaatcctggcagcatttatgttatattttcgatttgaagtgctaaaaatttctgatatattgtaaaagttaaagacggtggacaagaaattagttgcaagtcaacaagtgatgaataagcaaagaaaatttgcactcatagatccacttacgcagtttctccctaaaaatgcaagtttactgtccaatacatcaacactctagcgtaaaaccacatctaagactacaaaacgtaccttgcctatcagttcttcaattttgcctactaaatacagcaaccttaactaaaaaacaaccgagtaatgctcccaccaccaagcaaccaagaacgccgtcacaacaatatcatcgaagtaagctacctaaatgacccagctgaatcacgcaacgaagatatcatacatgaaaaaaaaaatcatggaagcagggagtgaggcacgaaccggctctgcctgaggttgcgtgcggctctcggctgtaacaatggcaacagcagccgcgttcaccgtgtcgacactgttgtgcacgggtctcatctcgctcccactctgcatctcgcagaggagctatcccacgaccacgagcaaacgattgttcccactccagagattgaatcgagcctccgagatccaaacttttatacccaaagaagaagcatgactccgtctgcttaatcgatggagcgctccaaccaacgagtcaaatcaacctgcaagattaataaacgttttaatcgagaaaaaaatcatccagtaatgaatggatcatcaaaaaaagaaaattccaagccacgtaacgtgaggcacggggattccctcttttcttttcttttttcttcttcgaaaaaaaaacaaactgctattacaactccactaccactacgcatgaacaaatcccgaataaacgatggtttaatggaaggaaaaaaaataaatcaatcaatcaatcgaccaaacaaacaccgatggattcccaatccacgccacgcccgctcatcaagccacacgcggtggaggaggtgcctctacgagaaggaatgatacctccaattcgattcgattcgaggcggcgccgtacgtggctctccccaaaccagttcgtcgccggcggcggccgagctttactcgcagaccaagaagaggaagcaccggacgggatcgggaaggagaggattcctccgccgcgcctcctcgccggcgacgacctcccgctctcgctgcagatcggagcaaaccaaagcggaggagaggagaggagaggagtagagagtagtatgctactacttcgatggacgcgctgccggggaagagagaagcacaagacacggaaggggattagggcatgggcatattagtcatttcgtattttaccgaaattaatattggtttttttctccgtgtgtcaccgctgtgaaacgagaatataatgggaggaaaatggatttggttgttgacctcaggtggcagtatcgtaaaatggaaggagttcgcgagggcattttggtcagggagagggcccggtggcactatcccacgtgtgcgtgtggaggcagccgataataataatcgcacgcaccccacatcgtacgcgctatccgtgcgctcgggcggttcccgggcccacctgtcattcgcactacggcgaggcgggtagggcttctgaggtagccggcgactgcacgccccctcgtgcagctggagatgggtggggcccacctacctttttttcccattggaaaaacaaacaaaaacatttttctctctcttttttttttcttcaacttttgctcgtgaaatcatcacgcacagcttccattccgttgctttctttattgaccaaactccaccgtataaccattcgtacgcgacgcatacggagaaattattattgtattctactgtaataatcttttcaacgccaaacttcaaaattcaaaatctggaattccgtaaaaattccattcaagtcgtacgaatgtgaaattcgtatatttgtgtttgcagagttccgtgaaggttttctcacgcgtgcgtaactcaagtctttaagtcaactgtttgacgagttcaaacaaattttggtagatacaaacaaaagcgattgcttttcatggggggagtcagatgagagagagttttagtggagtggtcttctcgtatttttttggttctgttctaacgacgtacacgacgggctctccttttgtttatctgtatttttttgtctcttttttttgagagagagagggctcgttttgtttgttgttattggaggagaaaaaaataattaaaaatgatggcctggttgcttaacgataggactgggtactgatgaagtgattagccagattccaatgcaagcggctgtttaatgaaatactagttggtttatttaagaactgtgtatctgtctaatctacttgatagtaacatttttttctctttaatttatgtatttcccttattactgtgaataagttgattgccactgcattgtatttcagcatagaagtccatttgtttcaacgtagacttggtcatcgcactggaaaagaacataacatcgttgatgcatacttcttgtctactgaaaaaaaaggataggaaaaaaggatgataagtaatagtatgtccaagaaaaagtaggtgctgattgcagtcactgtgagtgaccactgtaatttgttgttctagaaacacacacacacacacaaaaagaagaagatgagatgctgtgttgcaggtgtaacaaccatgcagtgataattggaagatgagaaaaatccagctaatgctttagggtgacaccttggttgctgtcagttgttagcatcataatccttttttcttgcaaggtttggggtttggttggttgtccccatcagaatcatctggggatgacaccaacacccacatgtgctggggctatctccaaactctggtttttggctacttctaaagtgttaagtgtggtgttaatcaaggtgtctcactctcctcctaagtattatatatataattgccatcattttgtactattattatcctctaaagaagcctgcaagcttggtcagtttaacactgcaaaaacgcgtccatgtggttaggataggaacatgattgaaacaatcttcttaaatccattgcagcaattcttatttcggccagccagccaccacgattggggcaagattattctatgctaatactaacagacaaggaataatttccatactgtcagccaatgggtacccaacacattcctcaaatggagttgttttgtcttcttcaatgtaaaagtggggtaattatgtatttattcatgatatgctagtaatacaaaatggaatatagcacagttttaaaaagagacccagtagtggcttcagacaatactacaatatgtgatgtaatcaaagctttggtatctgaaagcctgactcatcgagttacagcttctgctaaactgttcttgggaaatcaaacgtaagtgttgacaatataagcaggatcacacaacacagacagaccaaaaacatcatcaacctaaatgatcatatatatatatatatatacaagttttctgcagcaacctgaaagggcactgcaattgacaaaccaggagcagtactctcaaaagaggaagaagatgaatcacactaaacacataaatacaaatccaagggggggtttgaatcaattacataacttcaacgcataaacacccagacgattttcagtattgagtagatgatgccccagtgcattcattcttcactgatgatgatgactcaagtgggtacatattcaggagatgtctcataaactgagcatgttggcgggacttggtgagcataatcagctcaatcgagcatgtccatggatagctggagctgggtgattgttggcaacaaggatgtccttgatgcgattcaacggtcctacagcttggttaattttctgaaaagccaacagaagcctgcgttaattagaactcagctgatagcaaccacttcataaccagtaaaatcagaattgccgcaacaagcatcaaacatgctggatttcagcaaaccatggaggccaaaataaacaatcttatcttatatcctgtattcctatataattagcaccaaatgctcaaaatgcattgagccacatcacctaaaaaacataggccactggatctctctttgagtttaatctcaaccatcattcatgccttcagttacttgctcccttcaaatgtaatatactatgaagactttctggcttacgctgcaatgcgaggggaatcctctagttacttgaaaaaaggtgtccctcaccatgtgtttctcacttagcattacaacctaagatacttatcagaacagcatttgtttggatgggcctcaaatacaggatccacatgtgttgaccatgatttcggcctacccaaacaagcccttaaggtgtaaagggatattacagtatgtgctataagacatccttgtgataatagaaaccttcatattggtcggggggaaaaccacagcatacttcccgatcaaatatctaggcctgcccctgtcctgcaagaggatgcatatggtttgattctaactaaagatgtctgctactggtcaagtccgtccttacattcctaccgacctacttgttgaccataggaaaatccctcacgttttgtaaaagaaaaaaaggaaaggcattttttttcttaaaaacaaagatgttcattcacaattacctcattgctgctgggatacaatttgaccggctgatgctgcaacttgcccttctgccagcgcctccaaaaacatgtgactcccaccaaagcagtagcaacaacgatgggccagaatttgttgcttttcctcacattcttgtacagtgataagagttgcttcttccatgaagcttcgtgtggaaattcagaatcatcaggtttgttttgttcactagatgcaacaaccttggatgaatcaatgacacggttcacattttgcacagttggctcctcagttttcttctcattgttagcatcaattggattgtaacgagatgatgagaacccaagtggttcctcaccaaccaaacccatcccttggaatg

SEQ ID NO: 40619 - DNA, 1049 bp, Oryza sativa
cataaaaccaaaccagcccaacatggcaggtgtactcgaatagttccgagatgggcatacagtatgtgaattcaagcaactaaaacaatacagaattaatcgctacttatatttccaaactgtgaggtgtataatatacagaagagactaggcagcaaacaagccatcgatgtaggtaaacaagcaactcatataatggaaagtgtttacaattcgacaaagaagctagcaactgttaaccagaatttcactagccatactaacgacagagccacttatacctagagacacagggataaaactgttggggtgatcgaagcccgactgaagtatatacaccaactgaagcaagcctatattacaccacagtagatgtaataatacgagtcttgccaagtctaagtacttgctactagcctactagtagagagcaactaatcaaacttgactgatgaagaaatcgctacccgaataacagcacggtgaattaagaaatcgcaaccacaacaacaatcacatagggattaagaactgatcgtcccaactcccaaaaagctagtcgccagcggttgccgagaaacgcgaggagaaacccggaatcgcagatcggcagaggggagaggaagatcggccttaccggcgacgaggagggggggagtcgcgatcgcgagtgaggaaagcaggcgagaatgggaactgaactactctctctctctctctctctctctctctctctctcgcgagaagaaggggaaggaaggattggcgttgcgtgcggagatttttctactctctctctctctctctgcgcttctgaaaccgcctctttctctctcctctccactgcgtccgcgagcggttttccctttggtccaatgggccgcctagcctctctctttcttttcggcccaacagagttccacgtgcaccattttcctatatattactcaaaatatactcctggattattccttgatgattcctctttttatcactctcccttaaaccacttacagcagcaggttttgctgctactttaatccatttat

SEQ ID NO: 40620 - DNA, 6548 bp, Oryza sativa
  unsure (1)..(6548): unsure at all n locations
actcgagcagcaaccttatagaaactactgcaagtatgtttattcagtacagaaatatgaaccgtaaacttttatctccacagtattcattactccttacaaagcaaaaacataacaatctggtcctaactagcactatcaaagaggcataaaacataataacaataggagagaacgctataccaggaaacctataaattcctaccacagctgatgtagtcaagaaaataaacaagatcatgccaaggaaatgaatatggacaaaaacatgactattggccaccaataaggcacgcatcaacttcgatactgaaggttttacaactaacgagagaataaaacaggcataaggcaaattgctagcacagtcaaaatattttattcagaatacccataaacgcaaaggaaagaaacaatgaaggcacggcgcattggaaactcgaatttgcatcatccaatttgatgtcctgaaggggaatccgagtaagttcctcatttgctaaagcccctatcaaaacattaaataatgacggacaaggtaaatagtgatggcactaacatgcaaatctgcagatgcgtaacacagccagacaaagcaacacaagtgtacaaattaatagaagacattgaggccaccaaatgctccaaaagaaatccataaccatggtgaaggtgaacacttcaaaaccaatttcaaaaggatgggtacaaaaaatatgtcaaataaaagaagtggttcgatagaaagaatgaagtggttcgatagaaagaatgcagcttcctgtcacaatatactctattatactacagaagaatacgggattactactcaacatgtttgaatcacattgagatggaaattaaacacaaaatggaattcgaacagctaagagatatgaaaactgcaaatattgagatggaattataaagaaggttgcatgcagcaatgcatgctgacaacaaagatggttaaagaaagcagcacataaagaacaggtgataatgggcgttagcgcatcaggaactcgaatttgcatcatccaatttgatgtcctgaaggggaatccgagtaagctcatcatttgcagcccagaagaagccaaagaatgcaagtaatgcaaacggttaattaaatacaggtaatcatataataaatctggcaatctcatggtactgaaatcatagtgtgagaaaggtatacctgatctggctgggcaacatcagagaagataacatcaaccatgccaaccaacatccggtaccttgctgggtgcctagcatcctcaatgatggggatcacattagtcctctttttggccatgttaacaagatccctaccactcctgtgcgagaactcaacagcgtagaccaaaccagtctgcaaaatgacacaattagcaaaggcaaattgcatatgttgcctgaataagaaatgaggatagcaaatgacatctcaccggtccaacaatatcggacacatgagacactgttgttcctgaggcagcaccgagatataacacacgagtaccaggagcctaaatcatgaaacaacgattaacacgtgatgctcttctaaactaaagatctgacaaccatactgatgcattagcacttcggcctaagctactgcgcacagtgattcaacaacaaaaaaaaacttacaatccagatgttgtcgacaccaccaagcacagcagcagccagcttagaacggaaggggttccacaccctgtattcaaccttagttccatcctcattctgttcacgcagaaacatcagcaataagcataacttgcagggtacactacaatgcaacaaaacatacagacttctacagaacattatcttacagattcctacatatacaagatagcttatagtagctcagtagagaatggtgcacaaaagagaatttctacatgtaacactatagcttatatctcgaatgatgcacaaaagaggaacaaaaaaatgagaggaggagaaggtaacagcaatggacctggactgagatacgcttctctccgtagacggactcgccggggaccatgttcttggtgcagagcgcgtcctccttggccttggcgatgaagacgccgttgtgcttgtgcggcaccacgaccaccttgctcccgcccttcatgccacccctcccgccaccgcggccgccgccacggccccttggcgtcctgccacctcccctcccacggcctcctctccctccgctgtccccgcccctcccgaatcccctcccaccgccgccactgcggccgccgccatcgcctctccctcccctcccgaatcccctccctgaaaccaaagcatatatcacgtaagattcaaaacgagccgagagagcgcaagaccaacacggggagtaatcctagggtttcggatgcttacctcgcggtggcctcatggcgtcgactcgacgatgttgctctccgccgccgccgcagccgccgcaggtgagggggtgggtgtagggttttggagggggattagggtttggaagagggaacgaggaagggaatgatttgtagagggggaggctagggttgatgttcgatcatggccgttgatgcgagtgacgggtaatggacggtcagatcgtgaatactcccacattttaaatggattaataagctaaaaaagttagaacgacaggacggtcaggatggccgagtggtctaaggcgccagactcaagttctggtcctctaacgagggcgtgggttcaaatcccacttctgacattatattttttcttcatgtctgacattattaacaatttatttttcttttttttcttcatgtctgacattattaataaattatttttcttcattccattttattcaatttatttttcttttttttcttcatgtctgacattattaataaattatttttcttcattccattttattcattcttagggtgtgtttagttggggaaaaggaaatttttgggtgtcacatcaaacgtttgactggatgtcggaaggggtttttggacacaaatggaaggggtttcagacacaaatgaaaaaactaatttcagaactcgcctggaaactgcaagacgaatcttttgagactaattaagccatcattagcacatgtgggttactgtagcacttatggctaatcacggattaattaggcttaaaagatttgtctcacgatttcctctataactgtgcaattagtttttctttttatctatatttaatactttatgtatgtgtacaaagattcgatgtgatgttttggggaaaataatttggggaactaaacgggcccttattgtttcaacatttcagcttggttcatttatccatctccatttcatttgatttcgtggggaatccacggccgtgctgcatgagcgagcctggagtatgatgctagcaccgatggcatcaacgcccatggcatgcattcccagcaccgatggcgttcttattggtcagacgttagaaaatcaatctgcacatcatcgaactgctactttcaggtcgaaccgtccagtgcaaagaatgagcaatcggtacagaatttgtcacaagtgtatgactagtaacggactaattaacagtgtacaagaaaccatactgatcgagcctaatgattaattagttaaccatcttagttgcggcctatcactaatcctacacatatgcgcagtgtgactgcaagctagccgattcacaaaagcctaaaaaaaatctcactcctcaatccccttctcttccatggatactctcacctatgaactaacctcctagctaattaaacagcaacagcggtagcaaaaaaaaatgaaatgaaaaattggaggcatgtctatctagatgatcgtctcctccggctctgacgtcggaagcttctcgtgctccggctgccctccccataatctaaccctctccaacgcttgcactgactgcaggaagtaaaaccagcataaacatggcaattatgatgagtttattatctactacgagtaagaatataacgtgaataaaaatgctgctgtgattaacacctctgcttcccagtcagttttgcagaccatgtacatgaggatggccgtctgcattgccgtcccacacaacatgccagcccaaatgccctgcaagttccgtagaattttcgaaaacgaaaattaaatatatatgctcgactgcatgattcatttatgtagtagtagtgagacgattttgaactgaactgaattttaccttcacaccccatctgaagaggtagccaaatatgaagccgagagggaggccgaagccgtagtaacacgccagattaatgtacgccaccactccctgccatccgccgccgaccgccacacctaaaaagaagtagacaatgaattcttccaaggatcagttcatcggaatttagttagtcaattatatacttcctccgtttcaaaatgtttgacaccattgactttttagcacatgtttaatcgttcgtcttattaacaaattttaaatagttattaattcttttcctatcatttgattcattgttaaatatatttttatgtaggcatataattttacatatttaacaaaattttttgaataaaacaaacggtcaaacatgtacttaaaaagttaactgcgttaaacatttcgaaatggaggtagtatatgatgaagtgctgagatgtgaatggttgcctgagatgacgggctggatgctgttgagcaccatggtgacggcgagcatgtaggcgatgttggccaccgccttctgcaggtgcctgtctccggtgaagatgacggcgaagtggttgcgcgtggcgaggatgagcaccatcgccagcagcccgaacgccagcgactgcaccagcaccaccaccaccgcgtgcatcgtcgccctcggcctccccgacccgagctcgttcgacacccgcacgctgatcgccgcgttcagccctatgaacagcatcccctcccatccatttatattcatactgcatcaaacatatgtatatttatcattcatatcgatcgcaacataatcattgatggtagtgttttatactaccttcattccaaaatgtttgacgccgttgactttttttaaaatattgttcgtcttattcaaaaaatttaagtaattgttaattctttttctatcatttgatttattgttaaatatacttttatgtatacatattgttttacacatatcacaaaagtttttaaataaaacgaacggtcaaacattttttaaaaagttaacagtgttaaatatctagggaaggagggagtaccatatagatatggagtcgacggcgatctcggcgtcgtcgaggtgaccggtgaggacgacgagcaccatcatgtaccatatctcgaggcagagcatgacggcggaggcgagggagagcttgacgaaggcccagagctcgttgaacgccttgcgggacaggcccgtccagccgtcgcggcaccagccgacgacgtaggccacctgcgccagcgcggtgagccaggaggagacgtcgtacgcggcggcggcgccggcgatgccccagccgagcgcggagacgaagagggcgaggaggccgacgtgggcgaggagcgccgcgaagccgatccaggccagcaccgtcaccttgctctgcgcctggaggaacttctgcgtggggaagttgatggcgagcgcgaacatctgcgggatgatccgcaccgtgaactcccccgcggcggcggcgatgctctcctcctgccccagcagccgcaggatgggccccgcgaagacgtagagcggcgagagcagcgcggcggaggcggcgaggatgatccacgagcgctgcatgtagatgcccagcatggccacctgccccgccccgaacgcctgcccgcacagcgtctccagcgcgctccccatgccgagctgccattgccattgcccaaattacaatctctcaatcccatcgatggatgcgcatggaggatttggagggaggactcacgaggaagccgaaggagaagttggagacgacggagaggccgatggcaacggcggagagctcgcggttgccgatgtggccgacgaagatctgcgtggtggagttggtgccgtagaggcagatgacgttgaaggcgatgggcgcgccgatcgcccacagccgccgcgactccgccgcgaacacctcccacgccccgcgcgcggttcgaaccacgggcgcgtcgtcctcgtcctcgtcctcctccccggcgacagcgtcgtcgtcgtcgtcatcctcatcgcccttgccaacagcggcgacgagcgcgccggtctcgtcgtcctgcacggcgacaaccatacgaccgtcagcggcggcggcggcggcgtggcgggagcggaggaggtggtggcgcggggaggtttgggtggtgtggcgcgcggagaggaggaggggctcggtgtaggccatggcgatggaaggggtttggttgctggattgccgcacttcaatcccggcctcgatttgccgttcttggcgttgcctaccttgcctcccctnccacccccc

SEQ ID NO: 40621 - DNA, 22305 bp, Oryza sativa
  unsure (1)..(22305): unsure at all n locations
ttacttttcaccatcagaacaagctcttaaagcatattgagcaccaccgaccttcatatgatatgcttgtacagcaggcctgaatccccaaattttactgactggtgcaggaaagtgacgataactggaacatcagaagctattcaggcagcagagtctatgataatgcagagggtgacagccagttccgagaggtgataaaatctcatgaagacgaggggcatcatctgatggaaaagaagcctgatgccaagttaggaggaggggttggagattgtcttttctagttttagcactatccgcaaaaaaagcttgagagaaaatttaagataatctattgttccttattgagtctgattgtgttagtaactggagtagtcagtcaatcagctgttctatttatttcttatttttgttgggaataggattatatttcacaacatgtttggctgttgtcataactcaacaacgctggtgtgctaccctagttttgataattgtgatccttaggttacccttgaccccttgtctttgcctgtttgtttgtctcctcaaaagtcgaaatgactcgttttgctgaaagacaaagttgcttcctagtgagaggctgcatcttctgtccaatttgttgcatttccatgatgttgcctccaaaatcttgcaagtccaaagccaggaaaaaaaagcgaggctgcctactcttgtggggcgtggaaagtcacaagcatctacctttgcctgcgtggatgcaaccaatgccaagtaaaaaaaagcaaaggctgggcttttctttttctttttaaatgttacagcgagttttagctcccatttggaattcctatgaatatatcctatttgaaagcatttgaaattctttcaaatttggtgggcgagcaaactagtacgagcagaaaaaaagtcgaaattttctcaagatatatgtcgtgaatgaaataataatactggagtatcatggaggattaaatctgttttaccaaacgacgttttccctcaaaagtttgactagtatacaacataaatacattctgtggcatccactgtattgtctatcttcagctcactacgtttggagaatttacggagtagaatcaaatcttagaaattgcataatactccctccgtttcaaaatgtttgacaccgttgattttttaaacacatgtttaatcgtttgtcttattaaaaaaaattatgaaatatgtaaaactatatgtgtacataaaagtatatttaataatgaatcaaatgatatgaaaagaataaataatcacttaaattttttaataagacaaatggtcaaatacgtactaaaaaaatcaacggtgccaaacattttgaaacggagggagtacatctcaaaaatctctgaataaaatttatccgtagtagtatatccttccatatataaacgtaaattattaaataaaaaggtatattcgtaaaaagttttcggacagacgagagggcaggagtcttctacaagacggctaccgaggagtatgatatttcctctattattattttctttctcatcacgcggctgcgtccgtatcgcgacttttatcctctcctccccaactaactcggcgttcgccatctcgtgtcgacttcctcctcaaaaccctaattccatccaccgctcgatccaatctaccctctctctcgattctcaattctcaattctccctgcaaaattcccaatcctccgtgcagaattagaattatgcgggattgatcccctcccacgggatctccaatatcatatccatccagaaattgaaattcccctcgccgccgatgagccaatcgccgccggactcctcctccgcggcggcggtgcccctggcgccggggtttcgcttccaccccaccgacgaggagctcgtctcctactacctccgccgccgcatcctcggccgccgcctccggatcgacgccatcgccgaggtcgacctctaccgcctcgagccgtgggacctcccctccctctcccgcatccggagccgcgacgcgcagtggtacttcttcgcccgcctcgaccgcaaggtcaccggcgccggggccggcggccgcggcggccccgggaacaggaccaaccgcgccacgccgcgcggctactggaagaccaccgggaaggaccgcgatgtccaccaccgcggcaagctcgtcgggatgaagaagacgctcgtcttccactccggtagggcgcccaagggccagaggaccaactgggtcatgcacgagtaccgcctcctcgacgccgacggcacccaggtacctgtgaaatcatttgatccatctcaaatttcgcaggatctaccgtaccacgagatcacgagattagcggtagcaccaaaaaaattctgttcttttagcttgtctcctgctaggcttgtgtgagcggtaggtgggaactggtcctattctactttcaacactcgttacttgctgctgcttagatatgttatctagtgcgaccctgtcccgggcctagaatggttacaacattctcatgtttgttcacttgatacctatatatggtaggtaaaaacctttccttacaacatcaatgacttgctttgagaaaaaccaatatgagcatgagcttatcttttgtcaataaaagaagaaaaaagtgcgagatgcactggtagaagtgatagagcacgtctggaaatgtatgaagcaagggggcttttaactgggctatttaagcattggaaatcttatcctcactctgaattgaggagtctgaattgcggaggaccaatggtttttaacctgtatagaatattgatgtagcatccttttctgatagctgatgttagtttcctgttgagtgcgcaggatctgcatgtggtgtgtagaatcttccagaaaaatggatctgggccacaaaatggtgcacagtacggtgcgccatacttggaggaagattgggaagaggaggatgatgcaattgagaacatgcctgccagtggcgctttcgctgaaatggctgcagtcacagatactgcagatgagtcgactgaggaagatgggaatttctcccttaaaactaatgatgagantaaaccccccccccccccccctcttttagcgcggatggctctacttttccacgtccctctcactctcaactgatttatgtttgttactccatccgtatcagcttataaaacgttaaatttaaagtttaaagtttaactaagtttatagacaagtataataatatttatattattaaattagtttcatctaaccaataattaaatatattttcataataaatttatcttagattagagttgttattattttttctataaatttaatcaaatttaaagtagtagtcaaaatatcttataaactgaaaatggagggagtacttctcttagttttcttaggcaaaaaataaaaaaaaatggagatctttggcgagaagccgcagtggcagtgaggctgcagagccttcacaattccctatcgccggcgacgaccacggagaccgttgtggcccgtttactattcgtcgtcggttttgttgcgctaaacccgagggccgcaagggagtcgcggcccacgtgaggcccgtatgtttgggccggtttttcatgggccgttcgcactctttccacgccaccgtccctcccgccgacgctggcaatgcggttcgagcgttcgaccggcggtccgccgtgattctgaacgaaatggctacagatttttttttcgagagagaaaggtaggagtattatttatctgacgtgtacattcaattggatatatacagttatttaaattaaaacttagccttataaataacccaatctaaaattcgctcctactatgaaatgactactttttgcaccctgagaatgaacataggttcactgcgttcggagctagaaagctgaaattatagatatagtagtagatgttatatagtatgggatgtttattttattgtcaagattaaccctaccaaaattttgctgtatcaaaatggtagtaataacaatcaaaacattgctaaaaattacttgcactggtaatcctagaatttcacaaaaaaaaagaacgtggcaaaggtacggaacataacttatactacacgtttaccttcctaaatattgacagtatcaaattttggaaaggttttattgaaatttggcgctatgtgtgtgtttgttttgtccaattctggttcagcgtctgtcctgtctaaatcgccagcgagtcattcatcatcagacgtatacaaaaatgatttgcccggtctaagatgtctgaaccagtgtgttcaatcttgtccgggtcaattgtttccgccttcagaacatttctctgaactcgtcctctttctccccttttagtttcctccttaatctgcttctctttgaagtttgaatggtactccctccgtttcgttttatttgacaccgttgactttttagcacatgtttgaccgctcgtcttattcaaaaaaattaaataattattaattcttttcctatcatttgattcgttgttaaatatacttttatgcatacgtatagttttacatatttcacaaaaatttttgaataagacgaacggtcaaacatgtgataaaaagtcaacggcgtcaaataaaacgaaacggagggagtaataatctagttgttgaagccggtgacacagttacctgctgcatgcttaagtgccagctggagacatggtttagctgacgctgtgacgcatgttgctttcgttgacaaatagagtgagctctcaggatacgcgtgactaaattagctgcaaaagggctataaaaactttacggacttgttgcgtgcgtgtgtgcccatggatttgaactttgaacataggttatggattataaaaaaaaaatgcgatttgaaagttgctgcgaacatacgtgatgacgcgactaaagcttatatacgctgaagagggagatgttaatgattcaattagtgtagttggccgatcaagatcagtaccttaacatttgctatcacactcttgtctgcagcaacaagccaagtctgaagaagaagaactagtcatcgcttgccaggtccacctcaaacgccgcgtctcactggcaagtgggccccaggacatcaccggccccacagacagtgacactgatgtttaactggtcgggtcccaccggctcgcgctcgccggcgttggacatggtcgcgccccttgacttggccgagcttagctatatgtccacgccgcgcgtacgcgccccctggtggccggcgcgttgggagctctgagcggaggcgggcggctgcgcggccatggagggacgcgagcgccgccgcagcatgtcgtcctcgtcgtccgggaggcgcacgccggagctggagagggagcgatgggcgccgtggagccccgcccccacgtggtcgcggccgctctccgtcgggggcggcggcagtagggcggcgtcgctcaagtcgctcttcaggacgatcgggttgtggttcagctcgctctccacctcctcctcctcctcgtcgtcggcggcggccacctccgcctccggcagcaacgctaagaggaggagcagaagagagcccaatgacttgatcaagaagccgccatgtaaattgtttctctcgatcatttcttctccatctatttcatccttgtccttaattacctcgatttgaattgctcaagcaaacaggatataatccgaattatttgcccaattgatgcaactgttcctgaactgttcaagaaatcagtcaattatcacagtccagttgccggctgcaactactctgaattggaaacagtcaattatcacagtccaattgccgcaactactctgaattctttactttctggagcagaattgctagtgcaaagcttacagaatcatatttataaaatctgaatcacagaagacttcaaacatttttttcaaaattcagagcagcaattaagcagttgggaattaattcttgatagatgaatctgtttgatgattccagtgccggggcctggcagtgatcaggggaaggcgtcgatgcgcgggctgtacaacagcagcaggggaagaggcatcgcgacgcagttccagagctcggtgttctccatggaggagatcctgcgcgccaccaacaacttctcgccggcgctcaaggtcggccagggcggcttcggcgccgtctacaggggcgtcctccccgacggcacgctcgtcgccgtcaagcgcgccaagctccgggaccagaacccgcacgtggacgtggagttccggagcgaggtgaaggccatggcgcgcatcgagcaccagagcctcgtccgcttctacggctacctcgagtgcggccaggagagggtcatcgtcgtcgagttcgtccccaacggcacgctccgcgagcacctcgacagtgcgtgtgatccgccattgcagctcgagctcgagctcgatcggattggttactaatggaggttcttgggcgcagggtgcaacgggaggttcttggacatgggcgcgcggctggagatcgccatcgacgtcgcgcacgcggtgacgtacctgcacatgtacgccgatcaccccatcatccaccgcgacatcaagtcgtcgaacgtgctgctcaccccgtcgctgcgcgccaaggtgggcgacttcgggttcgcgcggctgggcgtcggcgaggccggcgccgccgacggcgtgacgcacgtgacgacgcaggtgaagggcacggcggggtacctcgacccggagtacctcaagacgtgccagctcaccgaccggagcgacgtctactccttcggcgtgctgctgctggagatcgcctccgggcggcgacccatcgaggcgaggcgggagatgcgggagcggctgacggcgcggtgggcgatgcgcaagctcgccgagggcgcggcggcggacgtgctggacccgcacctgccgcggacgccggcgacggcgcgcgccgcggagatggtgatggagctggcgttccggtgcctcgcccccgtgaggcaggagaggccgagcatgggcgagtgctgcagggcgctgtgggcggtcaggaagacgtacagggacatggtggtggccgccgccggcgacgagacgccgctctcgtccatctccgaccgggccagctcgtcgtccgccggcaccggcggcgaccggagcggcgagctctggaggaattaatcaacgttttgctgtaaatatgcaaaagcgaaagtattcgttaaaattctgctcatgtgttgatgttgtttgtgaattgtgatcgagctaatcgctgacacgatacggttggaatgtgattttgccttcgttacttgtccatctggttttgttcatcacgttctggatttactattagattaaaaaaattttgggggccatttgttattaccgatgttttgttttgaaccaccttttaaccaatgttttcacttttaatcgggtaaatcttacatttgttgcactttgaaccacctcaactctcttctcatgcatagaatgaccttaagtacaagtgtatggcggctcatacttgtcaataaactccatcaaccattagattgcttctttgacatatgacaaactgaatgtagaacgataaaagatttgaggggtggcccaaagtgtcacagaggtaaaattacctggtctaaagtgaaagcattggttaaagggtgattcaaaacgaaacatcagtaataaaaggtgtcttaaagtaaaatttaaggcatgtttagattgtagccaaaataaaccttaccaaattttggcattgccaaaaatttggcaggatttcttttgtatttagcaaatttggcaataaattaaacgtagtcattttttagcaactttactagaaaatggtatggttgaaaatggtatcaaagtgaacatgcccttactcttgtcattattttggatgggccaaaaaccacatgtatgggccagtctattcgcgtgccacgagcttctgggataggccttgatgggccgtagcggcacgcaaggaagtgagaattcatggcctcataccgcttcatgcaacactagtggttaaaaactgaatctatcttctcttcttctgctttttttctttttgggtaaactacatgatgacatgacttgttatcaataaaaaagaaaatgatgatgtggaataatgatatatatagtcaataatataggatagtactatgtataagaaaaggttgaacatgtcatatagcgtaacacaatatattactcctataaagactcaacaacaaacgcttccaagcacaagcttacaaaagcacactgcaggtagctaagccaccaccctcgataaactagaggccaagaaccagtcaggtcgttgcaaatgaaggccggccatagctgaacaactcagattaattagttaattaatcaatcagctaattaatcaaatcaaatcaaaatcaaataacacggagacaaaaacaactgttgcggccggcagaatgagcaaaaaagaaacataaaacaaggctaacatccaaatcagcgagaggtaatctctaacacaatggtcatgggagctgcataaaaacttcattgattattgtgcacttgcatttctctatctcgcttgactgtacatttcattttcacaatcggctagcttagattcgatcccaataagcagctaagctcactgaatctcatcaacaaaccagtaaaccagtaaaccctagctctctctctctctctctctctctctctctctacctagcttagcagaagcagatgagtcaaaaaaccagcaaggacgaggtgatcggtggaaggtcgccgagcggcgacggagacaaggcggaggaggagctccgcgaggcccgcagcggcgacgacgacgacgacgacgaggccggcacgaggcagccgtacaactgcaccttctgcaggaggggcttcccgacggcgcaggcgctcggcgggcacatgaacgtccaccggaaggacagggttggaagagcgacgccgtcctcctcgtcgtcgacgacggcggcggcggcaaggcgaagcgtcagctacgatacgctcgtgaggttgtttcgtccgccggcgagcggaggaagcgaggatgcggcggcgtccacggcggccggcggcggcgcgagcctgaggtcccgtaccgccgagccggcgccgcaagagctaaggctgtttgggcgcggcgccggccgtcgggaagaaggtggtggtagagatcgacgagatcgctacggctgctgctccaaggatggggatggcaatggtggccatgatcatggggaggaggaggaattggatttggagctgagacttggtggttcaggctctgcaggctcatgatcgaatcaatacttaaatgtgtgtcaattacgtattctttttcatcataattgagttgatttgaaggagtatttggttcaatttagatctctagcttaggtagctttctatgtacttcacattttacccccacagaatatatctgaaacaatatacttcttgttgcttttattatggtaaaatttcaatggtgaagaatgcaaatttcctcagagctgtcattgaacatatattgccatggatttttttctatgttgcagtcatccaataacaaaatgtatgtactatttgcttttcatttagtttaaatttacactttgtaagagataaaatatactccctccgttttgaaatgtttgacatcattgactttttatcacatgtttgaccgttcgtcttattcaatttttttttgtgaaatatgtaaaattatatgtctacataaaaatatatttaacaatgaatcaaatgatagaaaaaaattaataattacttatattttttgaataagacgaacggtcaaatatgtgctaaaaagttaaaaagtcaacgacgtcaaacatttcgaaacggagggagtatattttacagtgaagacatatatatgtgacaacaatctatatgcactgatgattggttaattagctacggagacagacactagtaatacgttcccattgtacattggcaccaaataagatctagaaggaatttgtactctggttctcaggtaagtacgaaatccaaaggcatacaactatcggttatagcagcagatgttttgagcacactgaatttgatcccctgtttgttcacttgttgttacgaagaaataatcatgtccagctactacttcacttttgtttttccctgaatacattaaggtacagaaagttggtttcagaatataccagtctctggaaccaattcagacatggatcagctcatcaacaagtggtagtatacatagaccttgacacgactagttagttcaacagaacatactatccctgatatgtatatgctgacaagtgtgtgattttagtagctaaaatcacaagtatttgggaacatattctcgccatatgttgtgtggatgaaaaagatagttgtactgaattttgttctggtactcgagaatcgtgatgccatcctaattgttttggagaagttgttgtacctacttcatttgataatagggacgaagccaggaaaaatagtcaccggggtcaccactaactgactatagcttataataatcttaagataatcctagaataaaactatcgaccatataatatgataaaataaagttttttttaagtaaagtggttatgttttacatgttacaaacttctcatgtgtacaattacgatccttcatcttgtgaaaacgaacaaccacgtcatcatcatttggaactgtagctatattttaaaacgcaaggagtaatccatatatttattaccgatacgattgcgtgcagtattgtctacacaacttttattaccgagaaggttatctccactgataaaggagaattagtaccacatgaactagtaagtgggtatttttcttctcaagaatcacactccattatactttgcttgcctattaatttattaaaaaatagaatgattattatgtaaaacaaaatacccacgctgctgtagatgatcaaaatcactaatttcttaccttccacttttctagaaagaataaatttatgtttatgtaacagaaattgggagaaacttcatatttcagaaccctaacttcctaaaattttggacttgagaaaccagcctacaaccaatttgtgatgataataattaagaaattgtgatggggttagtgggttacccttgccaatcggcgacgattgggcgaagcgcttcgagccagactgcactgcagcaggaatacagagcagcacaacaaggcaatttgtggacttgtttagcaggaatacaaagccttctgggctcaaatctcatacgtatatcgggctgtcgtataataagtgcttgctaattttctatttactacttgttagtattgtttagttgctaattgagcttgaacagaacaatatcaccggaccaccggggtttgactggggtcgtagctgataaattagtgctggtacaagatgtttgcaaaaaaatcgtcggggtctactgaccctgataagtgactctagcgtcgtccctgtttgataatatatctagtggaagaaagagctttttatctatggaatttgacggagcgttcgtcgccggcggcaatcagattcagacggaacgcttcgtcttgttgaggcggcgccggagttggaggagacgatcgagggaattaaatttgaaaatatattgttcatttaatttttttaaagaatattcaggatgtaatttttttatagaaatataccgtcgatctcgtacaaccgatgagcgaaaatgacgtaaaggtaacgtcgaggatggtatcgcacagcgaatgcacgagaccgtgtgccgtgtggtctctcgcaccgaccgcgcgctgtcgcgggaaggacgagcaaactccatttgcttagtgactaatgacgtaattatctatttaactaataataattagtcattaatcataataattaatcactaattcaccattttgaaatacggtatcgctgattggttcagcgagattgcacggtctcgctctttcatttcgcgcgaccgcacggtctcacgcttcccccgcgcgataccgcccgcgacgtcacgccacttcactttcgcgtaatggttgtgcgagatcaacggtatatttttgcaaaaagctttgaatcctgaatatttctaaaaataaaatgaatggaacagtatattttcgaatttaattcggtgatgaggcggctggtcagttggtcttgtgttttgggctttttcggcccgtctagtagcccatgggctatggcggattatttgctcggcccaataaagcccattaaaagcggagctaacctagggtttgtgagcaaggacgaacaggtataaaagcgagcctccgcgccgccgtcgcaccgttccgcaggccgcagccaccaccacgccaccggagcacagcgacgcgccgccgcggcttcatcgtctccggtgagttcgacacccctcgcgcttgtattctctgccgaaatcttaaaatctgctgtttccactgtaagacctattgcttggtagatttgatcgctgcctcttgcggttaaattctcggtgaccggtcgattttgtcgtgaaattctcagtgatactattatgcttttcggtcagttgtttggctgcaataactgtaaacttagttttagtttgagtaattcggtgcacgcgggttgtttagcttgttagatcgcctcgctatgctccaatctgcgcatcatccgtgttctctagatctgatagctgatagggctagccatttcgatcaatatgatgttggatgagagattttagggcagatgccatttgtgatcgacaccattgctgccagcgttgtgtaatgtttttgcgtgttaatggtcacttagtggtctgatggtcatttgctatggtgtaatggtcgatctgtttggtgatgtagctacagcgaaatggcgacggttccggagcctttgttctgggagattgtgaagaagaacaactgcttcctcgtgaagcagtttggaaacagcaatgccaaggtgcagttcaccaaggagcccaacaacctgtacaatgttcactcctacaagcactctggtcagtagttgcttctcgcaacgtcacaggctttagatgcaaattatgcctttgattcagcctttgcaatgtcctgacatagtgttgttgtgttctgtaaggcttggcgaacaagaagaccgtgacgatccagccatcaggtggaaaggacgcggctgtggtcctctccacgaccaagaccaagaagcagaatgccccagctaagctctaccacaagtctgtgatgcgcaaggagttccgcaagatggctaaggctgtcaagaaccaggtatttggaagataaatgcttagtttcatgtcattattttgccttgtgatgctctatgctttagatgcactgttgtgatgagccttaatatctcgtattggcttcattattcttttctattcactgctgtgataagccccaacatggaagaaggctcagagattgctcctgtttttctgtgaaatactcctgttacagcaattggtataacttgatctgaaaattagtaaattgccaattaatcacaagctagtctgtaaggaatgttttgtttttatcaatactcgaatcaaatttttttcccatgtttgaggttacaatgtgtgatgctgctgtgatgagccgtaacacataagaaggccaacctatcaattggttcttcgatgacaaatacttgttacgcttggcttctgagcagaatcaagctgctactgttctctctacagcagctttcctgtatgtaccttcctgaagaaatctttgatagcttgtgctcttaacagctgtttcttttctgcgcaggttagtgacaactactacaggccagatctgaccaaaccggctcttgcaaggcttagctcagtgtaccgcagcctccaggttgccaagtctggtgtgaagaagaagaacaggcagccagccaagctgtaaatcgcttgaagctgcgcgtttttgtcatggcacctcttgatgctcatgtttccagctacctctgttctaaaagtgtccagacttgaaatgagggatctctgttagaattggatcaaccttgtcacagatctgccgtgtagtttgtattctagacagtttatctgctcggtgtccttacaaattgtttgctttgcacttattatagtagctaatgtcatcaaattgtgggcccctgttgctactatgtggatttacaatctgcacgttagtagtagcaaatctagctatctccttgatctcctggacaagttgatagaaagcctatgaacgtaagcactccctccgttttgaaatgtttgttttgaaatgtttgttgatcattcgtcttatttaaatttttttgaaatgtttgttgaccattcgttttattcaaaaaatttaagtaattattaattcattgttaaatatatttttatgtaggcatataattttacatgtttcacagaagtttttgaataagacgaacagtcaaatatatgctaaaaagtcaacggtgtaggagtatgtcgtaatttccatcaacataaatcggcctgacgcatgtcgaaatttccagtcggtaggtaaaatcggctgcatgtaactcacaattccgttattgggccacaagaaaggtctcggctgacggcccaactagcatggaagcacgtaatttcgtcccggcccaacaaaattgggccgcacgtacacgtaatatccaattctgttcttgggcctcacgagatcgccacccgctcctgtggcggtcggcgctcgccgtcgccggcgtgcagcgccgccccttctgccgcggcggtccgcgctcgccctcgagttcggcgtctcctaccccgaccgcttcggcaaaccgccctccctctactcctcctggacgctatccgtactttgctcgtcgagctcatggctgcggtttcaggcgaaccaaccggatctatagggggcagcggcggcggcggaggcggaggcggcgctcatggagttgctcgccgggaagggatcagccctcctacgacgtggcgcctgctcctgcgaatgcgcgatctgctgccgatccggtacggactgatccttccctgcaaatctcaatccgatcctcctccccgtgatacacctcccacacatcccacgttctactttttttttttaagataatggaatcccacgttctacctctcctcgcctcaagatcaatgtcccatctctctctactcgattttagcaagtcaaacccatttcgattctcaatttcatcaattcctccccgtacgcggcgtcacgtgcaagctgcagtgcaactgaaagtgttttgagatatcatctcattgattccaatctcatgatttgctttgacagagagagtcaagtacgaattcccttgacttcacccgagtgtacatctcgatcattagaaaattacacgacttgtattcccactcaaactcatattacaaaatttgtgcgaagaagatttctcggggacgccattgctgccaagattccatgtgttcttgccatccatcagggcaccctttctttcgttagagatgttccccgttttcgccgcgaagatcttttgagttcttcattctgcaatgctggatgacgagattgtacactgatcacagaattcttctgagttcttcattcttcaatgctggatgacgaggttgtacactgatcacaggattcacagcttttaccgattcagacttcagagctcttagacaaacagacctccagcaaacatcagcatcatgtgctctgaagaattcgcgccagctcgtctttcaactcctgcagaatcaccggcttcttgaggatgccattgatcccggattgagcgcacttctcccaggccttctggtcggaagccatggccatgacgattggccatcggccgctcctgtactggctgatcctcgtcgcgacatcaagggcttttactctcttcatttcgaggttcaccatgacaagctggaaggctgctgctgaggagccaacagagctgagaaatcctgatcctgaaggcggcgaggagaccacgcagccgagcttctccaatagcttccgagcaaccacaaggttgatgtcgtcatcgtcgtcgataagcagaaccttcaggcctgcaatctggcacgacggcgacgagtgcttctgctcgaatgatcctccaaggcttgatgatgtcagtggcgattgcagctgaaacctgagcaccagagtcatgctctccggtagcccttggggatcaagaatcgcccagatgttcccttgcatcatctgtcagtaggatcaacaggacatcagcatcagtggtaatatgctctcttgagattggactgctaatttcatgttcagatgattcagatgcaatgcagtgatccaggcaataacactacctgcacaagctttctgcacatgctgaagctaagtctgagatcaatgcccttcccactcggcctccgcgacagcggcgagccggcatcgccgttctgctgccgcttgacaccaatgacaaacttcaccgaggagtagccagtggagtaggacggccaccatggatcccacctctggccgagcctgtcgtccagcacgtcgtcgtcggcggcgcgcacccggagcgtgacatgcccgggctcggtgcggccaatcaggttgccgaccatgtggagcaggacatggaaaatcctccgctcgtcgccgacgacgaggtccggcagcgcgttctcgacgtgcacggcgaagccgaaccccctgaagtcgcagaggcaccgggcgacgcaggcggcgtccctgatcatggcgtgcaggtggaacggccgcgtctcgagcgggaagcgctcgcggctgtcggccgacatctccatgacgtcgttgacgagcgtggagacgacggtggcggtgcgcgccatggtgtcgacgacgagcctctgctccggcgccagggcctcctcctgcaccatggacacgaggccgaggatggagtggatcgggcggcgcatcccctggctcatcacgccctggaacgcctgcctcgcctcgttcgccatgagcgcgtcgcgccgcgcctgcagcagctcgcggttctgctccgccagccggtcccgcatcgcccggactcctccagcagcgtcgcgtgcgacagcgcgacggcgacctggccggcgaccacctcgacgatctccatctcgtgccgcccccagctcttgccggcggggggcaccagcaccagcacggcgtagctcgtctggatcacctccggcgtgccgcccttgaagtcggacaccttcagcatcggcatccggatcgccgccaccgcgccggtgccctcctccttgccgccgctcgccgcggcgagcaccgagtccggcccgagcagcttgacgccgtcgctcccccgcacctcgacgacgtccgcgtcgtcgacgccgacgacgccatcctcgccgccgccgtctcgccggagctcgtgcgtcaagcacatctcgccggcggcgggcatccagacggcgcagttggtgaggccgagcaccctggagagctcgatgagggtggtgtagagcacggtgtggcggtcgagcgacttgcggatctcgtgggtgagcatccggacatgccagctcgcctcctcctgccgcttcatgaggacgacctcgcggtcgagctccctggccttgagccacagcaagctctccctcaccttgacccggagcagctgcgggatgagggtgagcagcgtgatggcggtgaggaaggagacgagcgccgtcaagaacttggccgtggtgaggaggagcaccaccatgaacgggtgcggctcgtaggtgaaggcggtgaggaggtgggtgaggccgcacagcacgatgaaggcgccgaactggacgagcacccaccggaacgggaggagatgccggagcccggcgacgaagtagaggatctccagcgggatggagaagtaggccgccgcgatcagcaggtcgctcaccttctgccacctgaagatgctgtccatgctccacaaccccccgccgccgccgccgccgccgccgtcgcagtggcaatggtggtactccacctcgcgggcggcggcggcggccggcgaaagggcgagcagcagcggcaggaggtaatcttggcatctgaatcttggaggcatcatccagtggactagctgctgctgctgcgccaatgggaggaaaatggaggagcttttgtcagaaataggcggcgaatccgtagcgcaacttggcaaggttaagtaaaaaagaaaataaaaaggccgcagctttggcataaattcgagataataccatgtgattagagatcttaacaagattttattgccctggaagcatcctggcgtccaagtggagagcaacatcccggaatggcatcatctgtaatctgtatgtgcaagcaaagcaggcaaaggaattaggacaagaaaaccagcatcagcttcatctttttttctcctttgccttcgtgaattaccagaaagatcaaagcttcagcagagcagaattggatccacggatcgattcatcgaactgggcggccgtcctgaatcaatcaatcaatcaacacaaagtgaatacaggacgaattagtgaatccctgtagcactttggatcccaaaacaggacagaggtggagcaaatccaacaaattctgaagctttgtggtactacctcaaagttgagcagaaccagtttgttgtctgcaacagtgaagctatcgatattgggttccagggaaagatgccatccaattgatctgcaaaagagaccaatgaacaaagaaatacggaagagaagatagcaatcgatggatggatgggagaatttgtcacctggagaggagaggagaggagatgagagaccgagagaggcaccaagaagaggaagaggaaggtaaagacgccagctatgcaggagggcttacgccatgggaggcagcaagtggttagggtgttgataggcattggctgttgttgggtttcagtgtccgcgggagaaagaaaccgagcaagaagaggagcatcagcagtggtcggtagtgagagcaagtgggggagacagcagtgatcacggagcatcagatgatcagatgggggatcttcccctgatttactagtaccgattaacataactgatgaacaatgctttggccaatcagacgctccaaatcgctgcaactggcagtctgctaccgaacaacaggtttaagaaaccgcacgattatcacgcatgataatcttttttaatttttaaaatcatagtaatcctcatggtaactatatggttactatgataaccgttttacgaggtaacccaaatttagtttggccgaacacagggggtgtttgggaactagggactaaatttagtccctcttacaaaattataagtccctatagtagagacttatatttttgtgagagggactaaagtttagctccactttagtccctccaaccaaacaccaccacaatactatagaggaggaggaggagatggtaggtagcagtatcgagggaaagaaagatacggagatccataacgaaatgtaaccgtgtctcaccgattgagtcgagaaatgtccctctgctgatgacgagcatggatggatatttgtggtgacgccgttgcagacagcagaggtagcttggcagccaggcgcccaaccgactgaagaagcagtccaagtccaacttgtgaaactttgaagcggtctctacagtattatattggtaccaataaatatctctctcaatcatagtacatgccacattgagtgcttcgcaggatacaagattcatgatctatcctcttatccaggtactccctcactctctatatttagacaatgcaccgttaactttatgccatcattttgaaacttaactctccctatttagattgaaaggtggttttttttctttatgagtactttaacaatattataattttactacatattattgtgatattctagttgtgggaaaaaataataaaacgtcaaataacaatgcctatatattaccggtgggaagcaagatattattgtaacggaagaatattttctgacttaacttaactgtatgtgtagttaagccacttatatgtgggtgatcccttcccattataatagtgaccatacttttgttggttgtgggttgagtgtcattggatgactcaatcgtttgttgttcttttcagctctaaagatgacaacttcttgattttccgttagcgcttctcgaacatgtgtgttttgtgaaaaagaaaatatttatacaagttttttttaaatcaaataaatatatattttcaaacttataatagttaatatataattaattacgcactaatgacacttctcattttccgaaccgcgaacagcttcaccgaactgcacgttaaaactggccttaatatcctagattagagaaacttttccattatttctctgcgcaacatgttctgctattttgtataaaaatgaattgctctgaatcttattaacttgtagcatattgtttcccattattctagggagaggagcactacatgtgtttgtgattaagatattactactagattctatctcgtttattagcatgcttatcaaacggctaaacgatacgtttcgtatgaaaactttttatataaaatttattttaaatatcaacaaatttatttttaagtttaaaataattaaaacttaattaatcgtgcactagtaactttcttatgtcggaaagtgtaaaacgcacgcatgtggctgagggcaaggacttaaggacagtagctggttggtgccaataggcgggtacagtagctctatgtagcaaataagaaggtttatgcatgacttatgtttttaatttttttaaaaaatttttaaataagacggacaattaaagttaggcacagaaaattataactgcacttgaaataaaacggagggattaggattcgttgcatcccgtactagattagcagggagtgattactaaccgtagtgtctcagtaaacgtatgaaagaaaaaacaaagaggaaaagtgttttgcgttgttagcaaaaacgtttgccgcagaagaaaatgaaaataataataatgaagtagtaccagtaatatgtggtggcatctgacatctgggcgggcactagcagacaaggcgacgtgtgaccagcagaggagacttttcatcaatatgagaggatgaccaggtgaggagcacctgggcgatggattttatacttttataaacgccaaaaaggagaaaggacaagcaaatcccccattaataaattgaatgctaccgctcctactatcctaatggcgaattaaatgttgaaaactactaccactactactgttcacgtttttcttaatgcctttttgccttttcggttgcaactatatacccctaatcactacgtatttttttaaaaaaatataagaacttaaataggtttaaacataaattagaataatgaatttgataaaactttcactagatttatggtggtgtttgaaactgataaagatcaagataaagttgacgtacgtaaaacgagaaaatcattagcacatagtaattaattaagttttagttattataaacttgatagatgaatatatttattattttaaagcaacttctatatataaagtattcgcacgaaacacatcgtttactaacgttcagtactttaaaaagcatgctaatggaaacgtaaattgtgaggaataaagaatcacgtcactgcggatggagatgacgacatcatcaggtaggtgaaggctactagtgaagtactgatgaccgaaatgagatggtccacgggcttggcctggaaagaattaagattaccacccccaactggtccatgggcaacgcaactgacgaactgtactcaattgggccgaatcccgcactattgttggcccaataaaccttgttgatttgggctacattatctccctctctcccccgttcgcattaattttcaactacgctaaagcacttaaaaacatgaatgaatatattgaagcctatttgtacgtataaactgaaaatattttggtcatatattagttaagctaaacattctgaatatttcaatatgtgtg

SEQ ID NO: 40622 - DNA, 1279 bp, Oryza sativa
cgagtagctctatccgtgtcactgcaggcattatccaactcggtggtatcacttttactggtagcaccgagcacctgcagaagaatggagatttcaatttgctcctctctttcactgtcgagggcgacgtctcaaccaaatccattggttttgaaccggatacgcagatgagcaccacgccaatggtgttgcgcagcggcatgtatcttttcttcgtatcggcgatgattctcatgttgagctacaaagttgggctgtgtatctacagcaggtaagttatagtagtttttgttgccccaggctgtttattaaattgaaggagtcatacagagtccactcgacgtagagggaactgcctgcgatttggacagtttggttctttacattgttatagttggtataccgttctgacagttgaaagatacatagcaataaactctggaattggagaaactagagttacacgaatttggtgctgaaacttttgttggtggcatgtactgtataatttactctatttatttatttcacccaattctgggaggctgtaagcgttccccgatcgatgtaagctgatctgaaacctgaatacgcgctcttcatttttcatacccaaagggccgagaggcacagtttgcagttactgttgatcaattttcggatggaaggaattttgcgttggtgtgattatgtgcttgtttgtggtgttgtcagaaataaaccatgaccttgtgcgtgcttcatagttcaacgtgttgcgctttggagattggcaattgcatatgggaacagacgcactgcatgacgtacatatatgtaagaaacgcatagcatgatgtacacattggctatattacgtgccaatgttcgtttatcttcatcgaaaaaaaaatattatcacaaaaacgtgaaaaatctttcatacaacattaagaccaaggtggcaattcactgtaatcctatacaactaacagtatactctggaatggaaaatatatttctggcacatatgagtgcactgcgcttttgcttctgatttgttgtgttgtgcccaaacaagagaggctcacaagcacatggcaccgacggtagtacattgccctagacatgtgcggttgtgccttccttccatcaagagaaagacgtcaaattctctcccatctccagttctccatgaccgcctttcgcacatttcagtttcagcaccttcataactaaagaataaattcgcgtgctttccctgccatcccgcagtgccatatcgtttcaaggaggatgc

SEQ ID NO: 40623 - DNA, 2095 bp, Oryza sativa
cgcaagaaatgggattggagctaaagaagtgtagataaatccgttaccttttgaccactagaaggcttcaccctgtggaggccaaaaaacttagttatgagggtgttctcataagtacggacatgatggtaatattttggaagcattcgtaaaagaacctgcaaggatcatatagagtcatgaaatgtttttaacttccgcttgctaagtaggtggtgttacttataatgtataatttatcgaagaatctaccattaaagaattttctagcacgcttatatgatctctgaaaatttaagcataaaacagaacctggacttcagatttccgaagagtcttgatcatgaatcgatcatcttgtgataggaaaaagacacttccactctttcctggagaagataactccctaagtgcagaatttccacatatagagatcatataatctgcagcatcaatcttgaacatctccctcaaatttctacaaaaaataaaataagaacaatggccattttaggtgtgtgacagaaagaagagaactataagctagaaataagaataaaaagaaaagaaaaaaggtacatagctacgttcagattaagtgatgataactacgttaggtgagtatgccaattctaaagatcatgtaaatctgcagaataagtgtatgggcatatcttagagatgtacattgggatgaaagctaaataagtgcaatgaacctgaaaaccatgggacaatagtccttccatttgaagtcttctgcaggatgtgaaggagtaagtcgtgatccttctttggggaaggtcatccagaaacttgctcgtggaccaaaatctgaagcacggacttcacgtttctgaatgggcgtaatctttcctaccgtgtacctaaacacaataatgcattgatcattataggatataattattactgatgtatcaccatcatattgtcctactaactaggaaaactctcattttaacttaatagatgatgcaatattttgcacgaaagttcttaagagcaataaaaagtgctgctagaaatactccctgcttaggccaggtgctgtatcttagaatccaaaaaaactactaccagctagcaaataaaaaaccttgcatctaacttttcaaaaggtaaatgttaccgtggacactattacgcagcacaagcattagacaactagagggacctgaaatagttctgttatagttttaggatatgttgtcaagagaactagagaagactatctataaatgaaaacgatcaacagaagagagtaggtcaggacagtattagtgggaccaaagaaattaacgaacagatgtcattcaaatcttgcaactacgatgccgaactcagagggattacctgattccaagctgtagactgagcataagatcatagcttctgtgacccttaattattgtctctcctggcttttttgtctccctaacaattttcttctggcgccgttttgccttcttggacgaatccgaaaaactcctgtcaagtactacctcgctgattagaacaccttgcatatattcccgttccagcataggcagatcagaatcattaatgctttcagatctttctaggccagagcttccagttgcgtcatggccaatgaatttttcaatggccacctcaaggctccaccgtctttccaaggatacatttttcgaatgaggttgctcacttgagttccttctagatgaaggacctgaagattcccgagttaagccaaccttcatgttccccatgtcaaccgaagaagagtgaaggatgcgtgagccgtgattctgccttctaatgtcaggcagcacacctcggttcttagattattgatgtagagctcatcattaacaggaactctgcaaccttttggatagaatgtgcctttcccatccttcagtcccttggtccaagtaccaacataatacccacactcattccatgtatagattccatacccgtgcatcatgccatctaaccagtttccttcatatgaatccccatttttccaagtaagagttcccttcccagacatcttgccattcttcatattgccaacgtaagtgtttccatt

SEQ ID NO: 40624 - DNA, 1057 bp, Oryza sativa
tgagggattcaattcaaactgcagcaggaggaggaggcgtggttggtggtacgtacccagggggagaggaggaggcgattgcgagacgaactcgacgacggcgacgacgaggcggagcagcagcagcgaatcgaatggcgatctggagggaatccctccggtggatgcggttgtgatttggttggttggttggagcggaagcctcgccgtcgccgtcgccgtcgtcctcctccggccggcgtgcgtcgccgacgagaggcccctctccgctgctgcttcgtctcgtgtggtggtgtatgcggcgctagatcttttactactactagtactagtagtggcctgcctgccccctgcccgcgacgccgctcgatcacttgacttattaacaacaacaaaaccaatcaacttatactaacaaacttgagtagtattagtactagtacggagtatattaccttttcttttttatctttcctttttgcgattcctatagtattcttcttttccgttgatgacgatggtcgatacgaactaatttctctctctctctctctgccttttttttttcaaaatgcccttcttttctcttaataacaagtttaatattatacctaactagactttaaatcatctatattcaatttaatagccggttcatacaatataaacatatactacataatttataactggttcaacctgtcatacatacatgtatcttagagtccgtattgcaactagctacaaatctatggcacgttgtttttctctctcctattttatcttctcgaaatatatttatatctagcttataatctgctattgtacttgctacggaaaacaaagtgcgcgattatagtgagattaattaagtattagctaaaaacttaaaaaatggattaatataattttttaaagtaactttatatataaaacttttataaaaaaatataccgtttagcggtttgaaaaacgtgccgcgaaaaatgaaggaagtgagttgagaaagaggggaaaagaacatagcttgatggttttcactgtctctagtcccgat

SEQ ID NO: 40625 - DNA, 1516 bp, Oryza sativa
tagcacgcaacacaccacagtactcgtagtagtagtgcttcatcattaggttaatttatttactcctgcatcgttagattagatctcgggtgaagtacgttattaagtagtactaattacttatctgcggatcgattagattacagctatctagtgctggtccagtgatccagtctcgattgcgagcaacatgaacgctttaattccacaatccacacttacatccatcttgcatgtaaatatacaaccgcaacttgcacaacagaagcaataaccttaagatctactgtacgtactatacctctgttttcaaatatacttcaaacgtgtgtttacatttacaactttacaactgattattcttttatatggtagagagtgtgcgcgtgttttatacgagcatctgcgtttataatttgttttaaaaaattaacaacatcatatactactttactttttttaagtatatgatgttattgacattttaataaatatttgatcattcatattatttaattttttatacataaataaattttaagtcacactaaaagaatatttgatgatgaattaaatcatgataattaaatgataattatatattttttaataagataaatgctcaaatatatcttgaaaaaatcaacagcgttatatattaaaaaattaaaaaaaacagatagagtatttatttagggggtaacatagaggggatatttacattcgtttgagcaagtgacagtaaagaaacaaaaagaaggaacaaaccaacaaggtcattttcgataggctacgcaggccggccggccggccgaaacaaatgggtcacaattaagcacgaatttaattggggaaacgccatcatgtcattcactggatcgaatctgcaagatttaattaagccgtactccgttccgttccaatccatacaacgatttttttggttgctcggttcggtcggttgttcatgtgtcccaatatctcctctccttttcttcttttttttcccttcttcttttaacgatgcagtagtgtactgcccacatcacaaattataaatgttttgacgtctctgcctcaatatacttgtccattgacaaatttggaagtatgtttagttagttcaacattcccgttccatacctccacttgcagtattttatatacgtcatttcttttctatatatacatgtcatttcatatatagacatctgtactccttattaggaggttatgttggtgacagtgaatctaataccctatttactctatgaacttcataatagaaaacaatcaaatctaaataaatagtcatatataaaatcatatttagatgaatatcccctaaattaaaaatatacataacgcattttatgaacaaaagtatattgctatttattttaggtaatattattacattatattttctttttttgagtaaagtatgggtatttagctagtacgtgaaaaacaaggaaaaaaaactggggttttttaaggcagaagtgagtccgat

SEQ ID NO: 40626 - DNA, 17575 bp, Oryza sativa
gcagaccatcttgtatagctctgcaagtggaagcaggagtgcaggacacatgttaaccacatttatgagtgctcacctatattgacaaacatgtggggactggtgcaatacatgtgtccaactttgaaaaaaatctgataacacagtcaaaagtaagtatctaacttatcaaacaatatgaagtgatgaaccactgcaactaaatttgggtgtgatgcatagacattgacctttcaatgataaaacaacctaggaagtatcttgagcacgcacgcacattaactatttgcacccatggcaagaatatatgttgatctgcctatgtagggtaaagagactaatggttgtaatcttacaatagatagtaaatgatcttttaacaaaggtaagacacagaagagatttcaggtaggatggcaatggtaaatagaaggtttatagtggtccaccatgcatatgcatagtaaaatggtaagggagaatattatgctattcgactatttcaacatcttgatctactaactaatcagctgctgaacgcaggtataaagcaaaggacattatatgtatgaatttacaaataatttcacaaataaggcataccatggacatgattgatgattataatagcagaagccccagcagcttcagcattcttagcttttttagtgaacttacagtttcccctttgcactaacaaaacatctccagcaacctagataaaggaataatcagtcactgggtaggaatgtaggacaccatcgagaaatcacaaactattaatttgtcatttccagtaagctaaccttctgtgtggggggatcacaacagtcaataggatctgctaacaatagtcctgtccgattggcatgcttttcctttgactctatagtggggccaaaacgagcaccaacaccaacaaactcaccatcctctctgttattgacccaggtttgcacttttacctgataacacggtgatggaaaacaacatagttaaaagaatggtcacatgatgggtaggaatacttgttatcaataaagtagcactgtaaggtgttaggtataaaataacaaatttgaagctatgaagctaatgcccctgtgttgtgaccctgcctcctactttgcaaccaaacaggcacctggagagggcccgaggcaggttgcaacaacaggggttagccagtgagtcaggtaatgcaaggaccatatctccctgcatcgaaacttgataattctaaaactcgccattttgaaacctacactgacaatcaccatatagaagagactacaaaataccatatgctatactgaccatctaaaaacttagtttaacaactataaacactaattgaatagcactaataactagttgttcaacagttcaagtaaactagtaactaacgacaggtcctcagcttacaaccgaagcctccaaagcagatcgttaattgtaggctatagcccgctccaacgattgactgatgagcttcagaattcaaaccaaatcgggcaggctaatttagtcgagactctaagcaaagccgcgagtccgtgtccccaagttatcaatcacctgttctgagcagcaaacaacatcggtgaagtctacaattgacaaaatcggacaggctctataccgtccccctgatctgatactgtaaagtcacaaatcaatagctcgaaaccctagcttcacctacgactgaaattgaaccgaacactcccgtcccgtgcagctcggaaccgaaaattcgggtcgcatcgtactaagggcaagcgaagaaaccgcgcaagcgagatggtagaaagtctgggaaggggcgtacgaggacgaagtcgttggagcagccggggatcttgggcgcctcgtcgtcctggtggacgatgtcgccgccggccgcgaccccggccagagccgccatgaccagcaagagcgcggccgccatctccggcgagctggtgcccatggccaccggacctctcctcctccacgctgctctccgccgcgagggatggatggggatggggatggggatggagatggacttcttcctcctcttcttctccgcttctgttgtgagttgtgacgcggaggaagttggaatggactcgggggggaggtgggcgggtccacctgccagtgagccagccagagtagtacacgagaagatgggcaacgtggactggtcgcgatcagcgggaggagtatcgtgctcgtacccgatggacttatccccattctctctctctcttcgggaggtaggggctttacctgggcctaggcctgctatgaaaatgttcatgggccaggttgacggcgaagtaatcttttttttcactctttttgagtaaattgccatttggtccaccttttattacccaaattttaatttggaccacccttaaacctattttttcaatttggaccgggtaaatttaccattgttgcggtttggactaccatgacaacttttctcgtcatgtttaatttccctttcggcaaacatatgaaccatatatagaggagatcggccgtatactagagctgatgtgtttaaggtcgttgattgcatgagaaaaaaaatcattcgtggtggtccaaatcgcaacaatggcaaatttatccggtccaaagtgaaaagatatgtttaagggtggtccaaagtgaaatataggtaataaaatgtggcccaaagcgtaattcactcttttttatcaaaatatttacaaaaattagggaccggattgcaaagttctactctatctaaaaaacaagagctgacatattctagtataacagagtcaaggagggagtaggtcgctagccatgagcaacgatctgattaaggtggatccatcatgagggcgtgcggggttttgagccgccactactagcgtaaagaacttgagagcctctacaaaggtcccgctaaatttttggagagtcatagatgggaggggggattgtagatttatctagtttgttcagattcctctgatatttttctttctgaatttttcactgaaataattaattaattagggacttggatgcaaaaatgttggaccattacgcctactgggggagaacggtccaaaatatggatcgaaatggaaaatgccgggggttacaatcggaaatacgggccgtggactgtaaaaaagtttaaaaaaacccactaaaaacgtgggccttacaagtgctaagggcctagtagtagtagctatctaatccagtagtaaagttggttcgcatggcgcggcggaggcgccagtggtggatggcgtcgcggaggggatggttggggacgagctcgcggcggggcagcttcaggttcgtcatcggcgacgtgtcgcgcccgctgcgcagccactccctgatcgcctccgcctcgtacgagaacccgtctccggcgatctgcgggtcccgcatcacctccttcaagatcgggcacacgaagtaggacggcgccccgccctcaccgccgtccgacgacgacgacaccgacgaccacgacctccccggcgccgcgctcatcgccgcctccagcacgccgcatgcctcctccagaagttcgccgggacggcgagctcccgctggctcctcctccacgtcgcagcatttcagcccgacgagcgccacctccctggcgacctccaacggccagcctccagagctcgcgtcgaacacctcgtgccacgccttgctgccgcccgcggcctcccgcgcctcctgcttcgccatcaacggcggcttcccggtgacgagccggaggaggaccacgcccagcgcgtacacgtcgcgttccggggtcatctcccccgtcgccaggtgccgcgggtccacgtagcccaccgccggccttgacagcgccacgccgccggagctccgcaccagcctgcacatgccgaggccggcaagcttgctcgagcagcactcctcgcccaggaggatgttcgccggccggacgtcgccgtgcaccgtcgcccgtggctgcgtcgagtggaggaacgccagcgcggagcatgcccggtgcgccacgccgcacagctcgtgccacggcagcgccggcgcggcgccggcgaggcggtcctccaagctcccgcccggcacgaactcgtgcaccacggcgcgggcctccgggcacgcgcccacgagcgtgacgaggttcgggtgcctcgccctgccgacggcttccacctcgcggcagaaaccgacctcgtcgacggcgacgtcacggccgatcatcttgacggcgaccgccatgctgcgcaggtcgcccctgtacacgctgccacggctgccgtcgccgcctccgatcctgacagattcgtcgaaatggttggtcgcctcctccagctccggcaagccgagccgcaagaaggtcagtctctggtcaccagcctcgcttcccgccattgcttccgccggcacatcgtcgcgccggcgctctcgccggagctggtggaggaggtcgtacgattccgacagcttggcctcgaggtctctcatcatccgctcggagctcgtgatctggagctcgagctcggcggcgcgggcgtccacctcgcgtgtctgctcgagtatgtcgtcgagctctcgcctgtcctgctccatggccgcgcgctccctcgccagcctctcctccacctccttccgatgcctcgcctccctctgctgcgagctctccgcttcgttcgcctgcatcgatcacatcatccatccatggtgaattttttcacgaacacgtaaaagaattgcacgtcaatatatcagaagaaaagaatgtttgtttatacaacgtaatccgccagaccggcttatgccaagagaagagagaaaagacaaaacaagaaaaactaaagaagaaaaaggaagagactactacgacgagtaaacgcaacttcaatcagcgggaagcatccatggtgaattcgacatgaacaatgggatcgaaccaacgatgcaatgcagcttggattcatttcctctacttacaattcttgtcgcgtcggcgaggtcgcgctcgaccttttgacgccggcgagtctcctcgtatgcctcatgcctgaggttctcggcttctatcacagcatccttgaacttgtcgtacgcatcgctcacatcaccagcatcctcctgtcaaaacggaatgcaccgtttattgtttaaatgtttactatctgaaacacatataatgtgtattacactgatgctgtatattctggtgcagatcagttggccaaaatcttcgacttatgaaacatgtgctgttcaaattatgtttctgtagtggagacaaaaacaagtcatttcgacaattttagtaccattttcagcagtccaagatcaaacaatctaggagtaggaaaataaacagatgtctagcacttgatgtaactgaacaagtaaacagatgtcatgtaatgtggaattcagatagtttttttctacatgttgggatttgttcattttttctttaaaaattctttcaactttttttcccttgaaactagtattatactgtatgatttatgaaacgtatagcacataccgaaccatgccctgaaggagttggtgagtcctcttcaatttcttgcagagactgcacaacagcagcagctgatctctgtacagcctctacattttcagacactgggactgttgatgaactagcaacagcaactgcttcatgattaaaaccctcagtgccacggtccatggcattgtcctccctgataggagtctgatcaactgatgatgtcgtcggttcggctggatcctgcataccgaattgctcgctgcttaggctgtgcactcgtggcgaggatctcgacctcgagtaatcagaagtgctcgacctcggagttgtgctagttgtcgatgatcctgttctattgagtccttcgttcacctccctataacggatcagacaaatggaattaaaggaaatatgtaaatcttataatatttttccaggaaaaatagaatatccttatgttagaacagctagaaagctaatagaagaatgccaaaagttcagaataatatgtcacaaactaggatgttcaggcaatctcagtgcttccacaggtactatttttgttcaaggtttgttattttgttagtcatttgtcataaacattatcatattatcagtatatcagattattctttgtctggcctaattcttttttgagcaggatgtctggcctaattcagtctgtgatcattgtcttaatgtgagaacagctaaaatggtcatagaagaacggtaaattcccagacaactatgtcgggaaatgttgccgacgcaaccacagtttctatcatgtttatctcgagaaaaaaaaagtttctatcatgttccttacaatgatagaagaataaccacgagttaaacggtgtgctacttcaattcagtcttcagtctttgtcatcagtgctatcatagaaatctacaaatacctgtcccattttgagcaagacagggagaagaaaaaccaaaggcttttgcaagttgcatcgttggcattaagacttttttgagtcatgcatgcatacctagtgcagataaggtttcctttgcagacaaaccagatcttgcaagaggggctcgccttcagttgcaccttccgagctttcttagatctcggcgcccgcattttcctaacatcacattgcatccagaattccagatcatttgcctttgaattcagcaatccactggcaccaagctggaccagccagttcttggaccgatcgattgataacaacagcagcgacagcgagagctggatttgtatgtattaatttccaagaacaagacagccataccttgaataggccttgtcagatgctgctcccatgacaagatcagtgatcccatgatcatcgacgagctggaggaggcctctcgcgatgtcgtcgcaggagaagatgatcttgctcgcattgacctgcgagtttttttcagcaactttgttagcaacccaggctgcatatggagaagagggagactgtcataataagaacacagccagaggctgctggtgagttgagactagcaatctgatattgacagcaagcaagatggatcaaatgtaaaacaatgaactctttatcatggtttcaaccttttgacttttgcaaatgtccaagagatcatctaagactttgctgatcctctcctcctccagctgcctgtatgcattcacctcctcctctgcaagctgacttactgggacccatgcccccactgcaaatccacaggtagtacccaaaaaaaaatgtcacaaaagatccaacattttttggaacacaaaagtgtaatgtaaaaggtattgtaaaggtaggaacataacaaaaggcacctactttcaggttgacagatttggtgggaaaagcaaagagaacataaacagccagctggtgtcattttacaagaaaatattggtagccaagtctaacattttgatttcatcaaaataatagccagataaaaggggaaatgttttacaacctgattaaggtcagagctagcattgcaattcttaattagactgaaaatacaaacagtgaatatgcttttagctgaagacggatatgcttagcagaaactatagtactgttccacttggcagagatgtatttgtataagattattctgagcaatagtttaagttgtccgagatgttgatttctacgcattttttttccttgataatgcacgtccacgacaagtcagaaaacaaattgaggcctcaaatgggaaaataaaaggaatgtaagcagtgcacgtagaacagccgcagcatcaaaaaaccccagtttccatggaggagacagcagctagcttgaaatgggttgttatttgccaaaaagaaatggaatgatctttctagaaaaattagatttgtcgcatttagggaaggtggtttgaattattttctgttatttgcaagagcggatttgaaaagatcaggtatttgccgataacgggagatgaattttatatatataaaaagtttgcaatggttggaatactgagattgcaatggtgccatttcgaaggagtgcaatcaaatgccaagaaacagaaaaaaaaagccatttctgaaccggattaattacaagcaagaacagatgcatgggggcaattgagaacccgtaaaattaaacagaaaaaaaaaacaataagaagcataaacaaccaaaacctctgcaaacaacaagaagaccgcaagaattagcgaactgcaacaagaagaacgcacgcaatgaagaacgggagttaattggaaataaactggaatagtatttggaatgaaatagctagcgatggagcatactcatattgacccgggaaggcgggcggtggacgtggatgaggacgatgcggctcctcctcctcctccaggggaaggcggcgagcacccacatgaggttcgccttccattccttcaccgcctccttccccacggcgcagtacaccgcctccgcctccgcctcctcctctagccactgctcgccgccgtcctcctcctccgccgccgcctcgcgaccactacctccaatggctcctcctgcccctgccgcagcttccatgtgttggggttggttcttggttgtgcacaggatcacgctgcccttctgctcatccaaagctaggctaactaatacggagtactaaagccaagattagctgctaactaactactctggaattaaaaaggacaagacggcgacgcacgcatgcagcagcagcagcagcgttgaggaatgaaggaagctaggaggaatcgaccatggccatggagagcctgctgatatacagacgcatgcagatttaagcggtactattactaagctgaatctctttgcctccaatccaatggcagtggaaaaggaaggagggatgatcttcaaaagggaggaggaggccgtggcaaatggcaggaggggataggagaggctgacaggtgggcccatggagtcggatattccccgtaccttttctttcatgggatcccgtgtggccatccacaacgacgtgctcgccgtggcacccagctgcacacttgcagtttcagactagctagttgtcgagttcctccatcaatcacgatcactactgtacgtgcatgtgtagccgccttgtgtgactcccggtcacaaactgtcagtgtacttcaattgtcgttcatgcatgcatgggaccaaatactacaccaaaacctctctctgatctctccttctccatggattcaatgctactccagctagtacacgtagtagatggtcaagacatcttcctgtttaattctaatttctgaattaatgtccctctttgcatgtgcacttgaattctgaaacttcgctctgatttccagccctgcaacctgcatatgcctttcgctgcctatacgaacccaaccttaaattggattggtcggtgaggatgatgcggctctcgatcgattcattgcatgccatgttcctcctaaccctgctagctagttagttaccaaacgcatcaactaggttgttcagttattaacaagctagactctgaatctctgagtagtaagtactaggacgcaaattaatttaaaaccgcggataattgattaattagttgcgagcgagaagaggtcgccaacatgaatcacgtacgggagacatgccgtatttatacacaccgttgactaaaatggatgcttctatactaggaatatcccatgaacatagatggatatgccttgaccctgcaaaataaagcccactaccgtaatgtttcttaaacagagctgtctacatacccattaatgatgtttatagtataatagcatatgaacatgtcttaatacaccaccaagctagcttacctagttgtatttttcaaattaatggcacccttaaatgctcaaagatggttaattagtagcaccagcattaagaaaacatacctgtaggttaaaacttaattggttatcagggccacgaacatcggagataaataatcatctgggggagacttgaccaacaagttcatctgatgtcagtgatgatgagtcctcttaatgacacatggtggggaaggatgagcaatctatagtatatgttatgttttggtttatctaccttaattctcagcatttatgcgatccgaatataatgctgatctttggtttttctggtcattttgtagtctgaattttcagatcagacaacagaactgaataaggttatgaatctgtgcttacattcttagctacttaattttttcatagttaaacaagtttgttataaatgaaaatgcgagctgctatcagaagattgacatattggcggtgaagcatgcatcatgtatggaagatggaacaagaggtagttgggaaaaaagcaaacttaccaacccctaactgttctaaccttttatctccaacatttctcaatttgttcctcgttggaaaataagcacgctacacgcgtggggttcaatcagcagtactatcttttctgatttcatgacaaaaacatgtcattgtttaccttattcagaaacaagaacctgaacatatacacaccaacaaatactactattccatttaacagcgggagaacttttgctgatgtatcaagaattctcagagcacacgcatcatctacatcactgcatgcgtatcaaccgtaccaaaaattaatccgttagcttaaccaaactcatctggttatgacaaaaaaaaatgctattgttctggtagctatctggacaccattcttcagttgtctgcctgtcggtgttagctaaatagttcagtcgctttctatgattcgagatatggctagctaaacacaattccaaaaggcccagaattctaagattcacactactttcagctctttcgtagtattaggttaatgattctaactggacacctaatcaggattttaaaaatattatagagaagagagagtgaggatgccttgtcaacctcagctcattcctagggaaggtgtatcgatcgcattacgtctccgagttgtcgcataaggcacacgataagtttgtttgcgcattttatatagcactccgtatcacttttgtacttctttgatctttgttagttttgatctgatcaagcagtagtaaactttaactattagtaaagtggttatgattacaaactaatgatacaattttgatactataatcagattattttataaaaatacagttggtgagagattggtaattcaaagtaaaaaccgacatttgtttctgaacggaggtaatactaactacgtacgcacgcacatttgagtaaatttgtacttcctccgtactcgtttaggacaatgtttaagtcaaaccttagaaatataaatcatgaataactctcaagttgttgagtttgaaaatgtaaaaattatatgaatagatttgtcttgaaaaatactttcatatgagtatgcatatattattttttaataaatatttttatagaaagaagaagttaaagttgtgttttggagaccgtgtcgctgtccaaaacgacttcctttacgagtacgtagggaatacgttaataaaagaaatacagtttacagtaaaaaaatccaataatatgcacaacaatagacaattcaataattaatctacactttccttccgcacctatagtacttggaccaaagtacatgttgaatgccaacgtctcatcagcgcattcaccttcaaaagatgtacaggccaccatttacgtcaatcgtaagccaacgcgtattcacgagaatacgttttctgtacgtgagaacacattccagtgtatacgccttcgcgctccatttacgatttcataacagggaggcgtatttcatagcgaacgtgacacgcagaaaccaacgaggagtccactccagtgatccgcgctcgcttggaaatccgagccgcggcctcagatccaattttccgagtcaaaattctgggaggaatccatccaatccgcggaggaagcttccaccgcgcagatccccaaaccccggcccatccccgtcctccaatccacatcgatcccctgcagattcgaggcggaaatgggggaggggatcaacggcgacgccggcgacctcgcggcggcgccgtacgaccagtggctcccattcagccccgccgggggatccccgcgcccatccgcgcgttacaaggtgcgcccaattccatttctacctccgattactcacggccttgtcgtctgatttttaatttttattgttgtagcagtagttttcgtaattttgtccgtattgatcagttggagtagtagatgttgtcgtatcaattctcagggaacgcacgttaagaacaaacgaatgcgagtagtagatgctgtcgtatcaattctcagggaacgcacgttaagaacaaacgaatgcgaaaatgtgacaaaccgcgtgcctaatcctgtggctttggagatgccatctctgcgtatagtgggacaatgccgagggattggcattaggactgaaatggccgacagaagtagtcttgagagaattttggtttcagatacgcgggtgtggccacattttggtaatttccctactgtcctgttttcatggttatctgattaaagccaaagagtttatgcaaggcggcatactgaaaccgttgttgtagtgtgctccatttgttagactgtgaaacccattaaaccttaagatagtatatgataaggataacttgaaaatctttgggttgcagcgttgcctagtcccctaggagatcttcttggtgcttagtcactactctttctccttttctcctctccttgttgttctcaggagtatggtttctaccctagttaatctagcgtgccctccctctcccctgtaaacccccatgatctgcgtcagcactcagcaggtcgcagttgtaaaatctctcttttcctgctaacatatcgatgcgcaaggcttttgcgagttcgccgaaaagaaaagataacttgaatagcgtgatgttctttggttattccatatgttgtctatcatattttattgaagtgctaatacatgacagcatgctgcggaagtggttcgtgaaaaactctatgtggttggtgggagtcgtaatggccgctatctatcagatatccaggtttttcagtctgcactaatgcactctaacaaatcatgtttctcatgccatttctccttctatatcataacaagggaaaacttcacaggtctttgattttaggacactcaagtggtcagcattaagtgctgctagagattcaagtcagttgaatatcgaaaataataccacagacccttcattccctgcactagcaggccacagtctggtaaacttactatcttttctctttcacttgtatggcaacttagcaatatttttatcatacaatccaacattggtatgtttcctatgctaacatagtgtcaccacttaggtcaactggaaaaaatatattgtggttgtagctgggaacaccagaacatcaacatcaaacaaggtttcaggtactcattcaaaagctctacaattatttgatagatatcgtcacactgaaacatagagcacagaatcttcctatcatagatcttcttagacatatatattgctaaataatccacttatgactttattgctttgccacaccaccaattaccatgatcctttatgaccttacatattgtatagatgcaatatttgaagcggctatatgtacattacatctttatatggacctatttatcgcttaagatagataatctccaataggggaactgaagcaatctgtacgttagttcagaaccctttcctggttttctttgcctctacctgtaaaatggtaccgactattccttgctccatgtcatttcatatgtcctggcaaaaaaatgagatgcaaatgaaatgctgactaagataattactcgatgtagtttcatgtgtttaaaggctgttcggattaactttgatattgttttaagtgatgatttttacatttccttatgttatgcacttgtacacagtgtactgaactttctatttaatcatatatgcttcataattagcttcactttcaaggtgccccaaacagtctatagtacttgctaacatgtaatatcatccttgcagttttttaattatgttctattaaaatttcaagaccggtatttatcttaaatgatagtgctgactatctgcatgcagtttggcttattaatgtggaaacaaatagctggtcttctgttgatacatatggaaaagttccagtaagaatcatttccttttgtatttgaaacaaaaagtaattcttttgaagtgatagaactgaatgtgctggcatatattttctgcagaattttctgaatactgaacttctctgcttttctcaaccagatatctcgtggtggtcaatctgtatccctggttggttctcgactgataatgtttggtggagaggataacaagaggcgacttctgaacgaccttcatatacttgacctggagacaatgatgtgggaagaagttaaaacagggtaagaatttatttattgattgtgcaaggttccatttacgtattgttattgcataattcattattatctttgtgtgaaataggaaaggtggtccagctcctaggtatgatcattcagctgctgtttatgctgatcagtatcttttgatctttggcggttcctctcactctacatgctttagtgatatctaccttcttgacttgcaaactgtaagtgttatatactctccatgtatcttgccatacagatggatttgtgcattgagtcacataccataagtttcaaaggcaaaaagttactcagttgtcttgatatttattcattgattgcctattgaagatctccaaaccccccgcactggtagttctaggttctagtaggcctttcaagtttcaaactgtatccagttaatggaaactaaggttgaatttctgggtggttgtatgcaatgactaagatccaacttcagtctgttatggcgaaaacttaacagcaactaccgtatatcataagctggcaataggtacataaaacaaatcatgttgtgcttctgaatgaaggagaattttatttcctccccttatatcaacccaagttatgatttgactaatactcctatgaacattgttttctattcattcttgattaagtgaagcttaatgcttacagatggagtggtctcaacctgacactcaaggcgcgcacataaatcctaggagtggtcatgctggtaccatgattgatgaaaattggtacatagttggtggcggagataacgcaagtggtattcctgaacacatgatgctcatattttcattttatttgcaccacctgtgctgctgaagtagctagaaaatacaacgatgcaggttctactgactacaattatgatgaatgcttccaagttcgtttggtctgtagtcaccagtgtgccagcccgagatccgcttgcttgtgaggtaaacaattgtgctacctagttctgtgataaattttgctcatataaatttctatcgcacaactgtgagaacaaacacatttgaataggaagttccttcctctatacttacgtaaaacaaatcatgttaatagtaaactagccgaatttcctgcacagttctgtggcgattgctgaaaatgaaatcgtatttcttatacagctttaacaactcctatatatttctgatcaatctacatcatcataatctgtacccaccacaatttatggtatagataattttctttttcctcaaacttcagcagtaatttcaagtccctgacagcaaatgtggatgcttctctttctactgttttaagaacataatggattttgctttgctgacaacttttctttaatattatatttcttttttttaaaaaaaaaacttttcagggtctcactctttgctcaaccacagttgatggcgaaaagtttctggttgcctttggtggttacaatggacaatacaataatgaggtattgaatttaaaagagtgacttagttctatgcatagtacttcaattcagctttgaaatgatccatctgtagattttttacttttaggtgtcacatgtcttgtgccttcaatgcttgacacactcaggatgaatttgcatcttttttctcttttcatcttcccttcctttttggtgcacatttttccatttgcaatttcttcacaagtggacactgctgcagatatttgttatgaaacttaagccaaggaatttagtgcaacctcgtctgctccaatcaccagctgctgccgccgcagctgcttctgtgacagctgcctatgctgtaataactgatgagaaaaccagagacattgttgcaacggatgatttagatgtgaagagagttcagccttcaggttcttccaaacaaattactactgaacttgatgcacttaatggagagaaaggcaagctagagtccagactggcagaagttcgtgatgaaaactcaaaactaaaggatagactagatatggtaaagttatcgcatggtgaattgacaaaggtacatgtttattttccattttgtaaaatggaattctcaattcatctctaataaatcctcactatttttctttcttatgaaggagcttaaatcagttcaacatcagttagcagcagagggttctaggtgccagaaactggaggttctgtcttaatgcactacaatgaattctaagcatgagcatgccatcttcttttgtttgatccttttacatgcttctgaacgctaacctatttccttattctcgttaattcagtcccaaattgctgctgctcataaaagactggaatctactgattctttggagaatgaactagaagtgttgcggcaacaaatatctcaggtggagcaaaccatgacaactgctcaaagacagaaatctgggggtgtttggaagtgggtggcaggaagtgcagagatctctgatgatgaatagtaagtgctacttgcaacatcctggagtggaacttctggtgtacttgtgctttaagtaattgtcaaagcgcttttgttttgcaccactttactactggaactttattttaagaatgatgagatttgtgagctgccaattttaactcattttggtattgctattgtaacattgatataaaatggtaatatataacgatcggcaacacgaacatttcaagagttattgttttatagtatttcttcctatgtagtggttgtgtgagtcggccgataaaaaagttggtatttgtgaaatgaacccaataacagatcatctggggtagaaccttttcttggtcaaaatgtcatatcatatatataatcatatgcaagtcgtatttgctaaaatgtagatctcctgcgtgttcgagacaaagatatttgctaaaatgctgtgataccaaatacatgtagtcacgtacccacagaggttatttgaatttagacctgcatttcttctgtactccaaatacaaattcacacacagagttgtc

SEQ ID NO: 40627 - DNA, 2327 bp, Oryza sativa
ccacctcctcagccgtggagcccgggtcggcggcgaccaccacgccaccggcggccagaacgccaagaactatgggcgggagcaggagcgagttgggcgagagcaccagaacggcgtcgccacggcggaggccgagcccgaaccggagccccgaggcgagggagagcgcggcacggcggagggcgacgaacgagagcgtcgtcgttcgtccgccgccggcgccggcgacgtcgacgacgaaggcggcagcggcggaggccgtggtgtcggggtggggcaagcgggagagcacgaaggacgccgcgtcgccggcggcggcggcggccgagtactcggattccaagatttcctccatggtattggtatctcgatctttgggtgtaacgatcgatggagaattggattggagatgaagcgaaggtggaagagggtgtgaggatttttaaagttttggcgcgctagctagcttagctagcttcgtggagtccgcttgtttggtttctccgatggcgggaaggacgaagtcatggacggctgcatgacatgacgacgacgatgacatatactcgattatatacccctcttctcttcggttttctcatctcgttgagcagtagacatactaattcaataagatatataatcgccattctttttaagaacgatttgctaggtttttttttaatttttgttcctttcgagaaacaggtcaccagctggagatctttgtcagaaaaagtacaacaagatgatactggagtatgatatacgaggatgatattttgatgatactcgttgataattaaacaatgatacttgattatactctttgatattattcatgaagatacggagtatttgctaatactcgttcttgcacattgatacttgatgatactcgttgatatttgcttatactattaatacacgtttatacgtaatggtagctagtgatgtatcgttgagtttcaagatagcaccaaaatagtgttataataatatatttctcgatttatgttataacatgaatattagtgaaggacctaatatcaaataattagaaggggtgaggttacgaatccaggtcatttaggctatcaccttgtggagctagccggaagacccctgagtgtttctcttaatgtatgttataacatcttggcatcacatgtactatctatctatcttagtaatatcgtcgaggtatcacgtacatatatatctcctacctttctctatacgttgagtggaagggggttacaatttggtggattattattacgacttgtttggtatgaaaccatgccaaaatattggcaatgccaaatcttgagtaaattttggtattactaaatttttgttattgtctatttggcttcaccttattgatttagcaaaatttgactctaattcaaatagttacgtgttaactattcaaagttaccaaataatttatttttgacctttaagttatcaaagaattagtaaggcaagaaggagcgccaaaccaaaatgacccttaatcttcaagcccatgacaaccccgaagaaaacctttgatactgggccgatttgaaaggcccaaagcagcgcaaagcccaagagagagggcaccaaatccgttggggaagtggataagagagcagcagccgcagttccttcccttcccccgcaatccatccccaacgccatggcctccacgctcgcctggagctccgccgcctcctcctccgccccctcctcccgcctcccgccgcgccgctccccgtcgctggtcgtcgtcgcccagggcaaggtcaagaagtatcgccaggtttggcttccacttgtattttctctccacagttgcagcatgtatgtatgtatgtatttaattgcgattcgttcgagctaagcagtactagtactgactgattgaacaagctgttgctggtgatgcttttgttttgcctcttttagaactagccatacccaatgtactgtctgtcaccaccctgtccactaatcagtacagtagattacaaagcgcatgcgactgcattccatcgatcgaaaaattcgaaatgcagcagctgtaagcttaagattactgtgtgcattcacacatctgagtataggaaaagatacattgccatggacgcatgctctgatgcagtacatggaaatggaagaaactatcgtcatgtttttaattaggtgcctcttagcattgcaactcagatgcaaaagtcatctctaatatgattctgtatatgccccggaacgccggaattgttggtttggccatgctgtttgtttgtagggaaagttgcaactaaaaggcatct

SEQ ID NO: 40628 - DNA, 2176 bp, Oryza sativa
ctattattctatttgtggactcagtaagaattgatatagttgaaacttattcctatttgttcctgtctgtctaaaaactactgtggtagttataccctactaatccttgttctccagggtacgtagttgtggtttagcttattttgtaaaaagtctaaagcatgatttgttcctaccaatatcattttccataagagtataagaactttcatccagtgttagcataatcttaccctgttgagcatttgtgcttgagtaggtaaaagaagaggcacagcaacttgcccgtgtttttgaaactattggggcattcaaagtgccacgtaaaggtgggaaaggaaaacagatatttgggaggcaagtttttatcgagtagatagttctttatgtatcgtcttattttacttgcacttaataacaagtttttcttctattctacagcgtcacagcacaagatcttgttgacatcataaagtcacaacttaataggtatgcccttctaagtgcactgacaatcactaccttttaaggaaggattgcgatgctctatttgctgctgttgctttgcttaccggaaactatttcatgtagggatgtcgacaagcgtctcgtgacagtgccagaaattcgtgaaattggggaatacattgcagagattaagcttcaccctgaagtcacagctcaagtaaggctgaccgtatatgcgaaataagccctgaagctgcttgattgaatctttagtggatggtgggctttggatgaattctgatttcaccaggtaagctcatctgcaaggcattccattgttccttaccttttgctccgttcttaagctgtcatatacatttcgtcaattgtgttagcagctgaattcatgcaatgatttacttgcagagatttttgctgaaactccaaggtgcagtgtcacatcacggggcttggtctttacacattgccactgtccatcctacctgtaaagtcagtttcttgcacctttttttttttgacaaatttatttgtgttaatgttatggggttaaatgggcatgatgtaaacaacaaagggttcagagtctagagcaactgatacttgtcttgtaatcttgtttaaaggtgcacgttctttatagtcatatagtttgatagagctactacaatatttgggttgggtgggccaaaatggcacgtaggcagtctggtggtcgtaggttgggccgcttggtcgctgtattattaggcccaaacatagggatttcaacacattttttaatgaaaactttcatctgaaaaaaccttcgtttggaaacttccatccagaaacttttcatctgaaactttgacacggactttatatgccaaaagtgtgtgccgcgggcaaagctgagctaattagtcatcctgttagtacataaactatttgggttagatttgtttgtgggtgagggtggaaaaagttagggaagtggtttggaaattggaatgcagatggtggagcactggagcgttggatgatgaagcgtgtagttgaggatcagtccggctgattcgattagatcacatatatagacagctcaaagggagaaaaaaaaagagctcaatatcagagagatattttgattagacttaaataattaaatcaagtataagtaggtgagtgcaaggattaggaggatgagatcagtgttagacgaaacggtcaatagataattatagaatctgcaggcgcaagctaaggtaagtactccagagtaagagcggcgccgtccgataaaccaaacccacacaatatttttttgtcttttggtttgtgtcatgttttagacggacgtagggccgcattcatgcatccatgaccttaattcgatctccatggtgggtgacgccgatagttcatacagcaacaggctacctatctatatctaatctattggaatcgaatgagttggaaaattactgctgcttgattaagaaaacagaacaggggcaacgacgatgcacattaaatcagatcaaatcaaatcgatcaccagttaattgattgagtcctctcagccagctgcctctagggatagggaagaacagaacagtagtagtacacggatcaggatcctctgctctgcggttaatgtactatgcctttgtcaatgacatatggacctgatatgtcgtcgagtcca

SEQ ID NO: 40629 - DNA, 2340 bp, Oryza sativa
tgctaatagctagtgcttgaaaagatatatctatcaacgaactttaagacaaacaaaatgtaaatgcacaatattacctcatctcttcatgcattttttttttgcaaaatggataagaaatcgcaacattctttgaaacatgaggttgagaaaatgaatagaaaaaaacacatgatttttactttgacaggaatgcaagtgcaaaatagatgatcacaagacacaggaaaatagaaataatcgtttgaatatatagatcccaagaaaaatgcaagaatcgaagacaaaaggaatttttttttcaataggttgaagctctaattttcctccaaaatctacatgtatcgagacattccttagcaatgtcacataattttgaaagcgtactccaatccttcgtcttaaagggaaaaattgaaaagattcctataggatttgaatcctacaaaattcctccacaaatcctataaatggggcctaaaatgtgtattcttcttcaaggagttgcacgtgtagaaaactggccatatcaagtttcattttgggactaagcaatttgcacacacaagtctgaactgaaattcaaattaacttcaattatataatttttagctgggtatttgatcaatgtagctatatatgcattaatttggttatacaacagacattgatcaacatttataagaaccattgtgttcggaaaaatgttttccacattaataacatgcatgctacacttaattaattgagctgttatacatggccggctatgcatacacaaaaatctttcttttttttttagaaaaaagtacatttaacattgagtttcatgcatttgaaatcatagtagtatctacaggtcccccatttcagagctctaaatggcatgaaactagcttatataatagtgcatcaatatctccccaattagaagtaagtgtataagcttcagttctcatacacagaagcttattcagtattcatgcaatcatgtttaccctttgatttcattcagtatgcagatgcagctagctccttatattaattccctaaacgatcctaggattccaagctcatctttttactgaaaaatttgattgaaagttgaaatcatggagtgctgcacgtgaaagttgatctgaagcactgcacgccttcacattcagtagtactgaagtttactgaaaactcttgttagtttggtaaaaaaactcaagttctagcgctagagctagttacatctggaaacacagtaaacatttgcacgcacgcgtgcatgcttacattgaaacattcaaattaacaaagttgagatcacgcttgctagattatctaattttgcatcagattttgaagatgggatcgagaaggcagagaagagagtattaataaatttgctcaaagcagtgctagatttgggaccaacagatactatagcttacatactatatatgcaaatactggtagaacatgcatagtagttaagatctatgggagaaatgatcgtttctcctgaaactcatatattaagtatgagaagcacatgttgcacagatcaaattccaaggaaagaagctagaaaaggccacaagttgcaacaatgtcagacaaattacctctaaattaaaccgaaaaacatcgattagaaacacttgaaacatcgcatgcatcatcatccgagctagatttagctagatagctagctcaattaagtacaaattaattaaaccacaagcatcaccttaccttaattatttcaccacaacaaattaagtagcagcagcatagtagcagtagtagctaattaatctcaccacttcatcatatgtactaacctaattaatggcgccactgatcttgcatcacatcgatcatcatgtcctccaatggaacagtaaccatgcagctagctagagcttgctagaagagaaggccatcgccgccgccgccgctgccggtggcggcgagctagccgccatgaatcttccatgctattgccatcgatcagtacggtgggcgggggtgcgccgcccatgggaaaccgtcgccgccgccgccgagcccgttgctcggcggcaggttgaacattggcagcgccgaagggtcggcgatgccgtggccgccggccatgaggggctcggcgccgccgggcatgggcgggcctgagccctcctcttcttcctccaatggcaggcgctcgtaggtggcgttggcgaacgtggacgcgatcaccatgaccgggcccgcggcgatgagcgaccccacgacgctgccgccgacaacctggccctggccgccggcgacgtagacggtgagccccgtggagcccggaggcgccgg

SEQ ID NO: 40630 - DNA, 2016 bp, Oryza sativa
ccctcccgcggctcgccgccgccggattcgttgttctcgtcggcgtggtccgccgccgcgccccccgtcgggctcgcctccggctccttggccaccgggagctccgccttggggcccgacgagccggacggctgctccggcaagcccatggggcccgaccaccacgacctgttcgccagcttgaccctgctccaggagaagcacaattaatgcactgcatgcttaatctctcaactaattgcttctctgctgctgcagagacacatgtcagctgcctgctaataatacaacataatcaatctacctctaatagtatattagtgtatgcaattgcagtagaacacaagaaatcaacaagagatcaacttaaatcaagaaaaggagattgctgcatgcataaatttgaggagatctgaattcacacacatatatctgcataccttgatgtatctctcttctaacttgtcttaggtagagtgattcagaggtagaagctcactctgtgtgaaaccctcttcctctcaagcttagctaggcaagctaggtttgaacctagctgcttgtatgtgaagtggaggtttagtaggtgtagctagcttggacagctcaagaagaagaggaggaagaagaagagtagcttctgcttaattagaaactgagaagaggagggcaagtggggtataagaaaggaagagaggggagggagaaaggtggacatgtaagcatgaagacttgatggagaggagagagagagagagagagagagagagagagagactttgggtgccactataaactaagcaaaaacttaattaattaggtggcctttcttcccaaggagcacacccctcttcttacccccatcctcccctgcatgctcctccccggggttatttgcggttttattttgactttgggtccccgtttgccatgtgaattcaaatgttggaaatatagtttatcatgtacgttgcaggttagcatattaacttgtttcggtgaaggcttcatttatttgtttattttctatttaagatcacaagcttagactggtccccctattgagctagtggtgctctgtttggtgtgctgatgactggtgtaaaaaaataatcgctctctttagtcgtggatgagaactggtacccgcattttgttaatatttatcgaacgcgactagtaagaatctaacatgtcgatctacagcagtgacaacctcatctgaaatgaccattttacacacgatacctactttttaagaagagacatatacggcgtcctactgttccactacttttaacttattggtgtgatgttggtcctaaattaggatggtgatgagagtgggtggatgtagttttgttgtggatgataattaggattaggcccgatggaaatgtactactgtctccagtgaaaagattagggtttttgtgtgtgtgggactgtgtgcagatggcaggtagccgggtgcatgcatgtccttttctcaaaactccgacatcccaactaaacaaaaccagccctagccttgaatttttatttcagctacttgcagccaatgagaaagcactccccctcttacttttctgtccatcaagaacagtatttttcacatgaactagtatatatatgtgtctccatcttaagtggaacacaattatatttttaacaaataagaaaaaaaaggactatccagttccttttacaatgttgtcaatatatatgaaggaatgtttgtttctgaaaaaaaaaggaacagattattactcagtactgtaatgtgcagtacaaatataattgtattatgctatatgatgtaatatgcatgcagccttgaaaatcttagtagatatatatcgtacttattggcatgaagcaggttgatcaattttaagtacactcatgtttctgtccgtagtccgtaccaagatcattattaattgtttcgttttgcttgcaaattgcaattggttgtcagctaaccactaacaaagaacacatgcatgtgttgta

SEQ ID NO: 40631 - DNA, 6506 bp, Oryza sativa
  unsure (1)..(6506): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgctcaccgacttgccctgcttccgctgatctgctgctacttgatcgagttccacagcttcgtgatggcgtccctctgctgcgtcgtgaaccggttacaattggttttggtacggtagggcgatgcttcgcaaagatgtcaatggcggtctgtgtcctgataacataaaaaaggagaattagaacacaaaattgttgaatatgtgttgataacataaaaaaaaggagaatttagaataggaaattgtagtgtatgtgccgctaacagcataaccacatgatgttctatctcaagagaactcaccacggaatcctatagcgccgagcagctatttctagacatttcaggagggcttctcgttgtgacttcagaaatctctttgattcatcctcatctgctttcctatttagagcggcgaccgtcttctctcgagccttttcagacttctttgacttgtgctcaagtagaccatccaaaccaaaaggatcagaggattcctcacttgagttggaggctgcagcatgagtgctatcatctggcaacgagttggatgccgcagcttgcgggttatcatctgtgttattactttcaacagctgctagagctgctgcttcatcattgtcatcatccactgttgtgattggcagggctgagatggcatctttgatcttccctacagcctttgagaactacaaaacagtatcaagtacgttagtcaagcactcaaatcacaagctgtgtcatagacatgagcccagaaacaataataatgcatttttcacatttgatagagaaaataagcagcgcaggcaccaccacaatacactcaccacaaaactgtcatccgtaaaaagatcatttgccaccactgcatgcagcacccatatatcaaactgatttttctgttgttggttgaaacactgcaaatccaccacaagttataagtacaagatacaatggtataatggaactgcataaaacagagaacactaagacttaataaaaatcttcacctctgttacaccctgggctgcattaaacaaagcctggtaatcagcacgtacagaaggctcattacaagctcctggtgaagacattgcagcctctaatatagcaaagaagtgactgattgtccctggcttgacactcccagcctcaataagctgtagagctagttttgatgccttgctgaattttgaaggattccgtatgtgtgaagttatcttgtgcatagcatcaatgacttgcgtttctgaggcatcaacagtagttctaaacctaagtcgcttctcaggagctacaagaaaaaaataatgaatattagaagtttagaacatgagcatgaagcaagtaaaatatctctgctgttgttataggaatatagcgagactgtaaaagtcgctcgcaattaaaaaaaatcatgtggaaaataattggatgataaaaaaccttcagatataaggagtcattacaactttcaatcacccataaatcttgtcagcaggactagatattcagtgctagcacactaacgaaactaacgaaactagagttagtagtaaaacatgatggcattttgcagatggaagagttgtcatataagccaaacttataagagatgtcaccagattctgttaacgttccaacttccaatcaacacataacatagcgaaacattaatctttgcaagacacaatctcgcaaacaaagcacaaaaaatcccagtgaattacctggtggtgataatatcaacaatactcactatattcccaattgagttactccaagggaccaaggcagcagtaaaccctggcactaagatttttttaaaaaagggcaagcaaagcttatctgaaccagatcaaatgtgtataatcttcataactgaactaatttaacatcttctgttttaagttatgtcacaccttacatactcggagcttattttgagttcatattggtgaacaatgttaagccaaacatatgtaagagaagaggttgttatcctaaaaggaaacattaacacttgatttgacagggagtctcagggctaagagcttcaactatttataccttagttctgcaaaagacacaagtaatttgcacagctaacatattctggctgatgcagtcattgatctcaagccacacagaccaaacattaacaattggaacatccctgcatctgtatgctatggttaatctccttgtgagatgtggcaaatgagaactgggaaaccctaataccgatctagaaaatattcctatgaacaaagttcgcatcaggatatcaccacacaaaattcataaattaagccatgaatttctagccagatgaaaaacctttcaatttctcagctcctaggcgatgaaaaatcagcaactaatcgttgacaaaatgtacaacaaagaacacaagctagtcgtactcgtacgaacaggagtgcatccgaattcccaaagccgaccacgcagagcaggggacgcagcggcagtagcagtaagcatctatctaatttcgcacggagtacaagagcgcgagaggagagctcaccacgtccttcggctgcggcatccgtggcggcggcggcagcgggtgaggaagcggcagcatctgaggaagagagcttgtcccgcttgagagcgctcttcagcgcgggcagtctcggaggcggaggcggcgatggtgaaggcgcgcgctctcctccggcggccggcgcggcggcggcggcgggaggtggtaggccctcgaagaggtcgtcggaagccatggccggtgtcttggtctcctcctgcttctgtctgctcgagatgtcctaaattaatgggcctcaaactaatgggcctagttggtctgctatccaaattgagatggcccatagcccataggggagaactatttatgaaaatactcttggagttggactgaaattacgcgcctgccatgcagcaaaacctccaacgccccacactgcgtgcacttctcgatcattcgatcgcttccccaaatcgctctcctctcctctcctctccaccgccgccgatctcctcctcctccggcgccgtcgccgcgtcgcctcccggagctccggtgctgccaccagcctacgcagcgccgcctcctcctcctcctccggcatccgccaatcgccgccgcctggttcgtcggggagccccgcgccctaacgttttctagaggcgccgcggatccagcgcgaatcgatcgagaggtaaagggtaaggactcgactccagatcatctctcgatttgtcgttttcttcccctccatttttagtccattatttttttttgttttgtttttttatggctgggtggcgtctttgttctgatcagcgcggcgttgtctctcttgcagggaagttgatttgagtcggcggccgaagaaggaagccatgaactcgagaaggcaagtactgcacactaacttttcgatgtgttttcgattttgatgctatgggtgaatggagttaccgggttagggttgatgagcacggatgatttggtaggactgactgactagctggttgagctatttgtatatttgcattagggttctatatctactataactgtgtgctgaaattctctcaggaaaaaaaactataatgtgaaattatcgtgtgattacagcaattctgatgtatgctaggaaggtcaatactccttcgtgggattttatctgttagttgtgagattgcatcctttgatgtaagacatttgccaggggaaagctcccatgattccgtagttagcaacttattgatatgaatcaccggaaacaattacttatttttgctggccagctctagctttgcatcctttataacatgtttgaacattgatgtgcttccaccaaagattgatgaaatgttgtgcaaggcaatttggttcaacctgaaagaatgcctcatgcttttcaattgccattagtcactatccaaaagtttgatttcggaaggcatgtgctatgctgctgtatatttactttgctcatatgtgattatgtgtatactaccattaaatgagctttaggtctgtgactttttactcttaaaagcaactagttatatgccatttcatcctgctgccagttgatacttatagtagcgagaatcttgtggcctaagaagtcgacttcctgcattgtgtcagtttaataaaacaaagaagaaaactcaaataataactttttgtgtaaatgaatagaaggagaacaaaacacctggtagattgaccaactcatgatcattggatcacatttctatttttatcactcctgctctgtcccaagctctctatcttagttttgtaaacagtggaagtgtataaggaatcaaagaaaagggaaggccctaacaaggatctgtacagtgggatagcttgttctaaacttctactacttgatattgacattttgacatttggttgcagatggagtttatgtccagctgcaagcctttgtctgctctaaaagcttgttactcactatgcacagtttccagtttaggaatggcctgtgatcatctacctgctaacactaagaacttactaactcacacatgctgtttatccaagtcaaaagtacacagtattagctttgtcagtcaaatatatttgataacaagtattaaccttttcatgatattcataactataaattcgagttgaacattattaagatgaatagaacttgttagtattgtggaaggtatctatagaaatcagtagtatgtacctgtttatttatggcttgagattgttttggctcatagtttttcttcagttaatttgttgaatgcatattctctttctgtttttaattctttgatacatgtgtcaaaagctattgtttttgtgaacttgggagattttagtaatgtcgtcccttcatacttgacatatataaatgcattcatgaattatgattgctcagtgtatatccatgtagactaccacggtaaatgtttctatgtaacagattgaatatttatttatatggtttgcttagtttgcatgtgtctttgcattttatttccatcatatgctttgcgcacgctgattatttcatggaaattttagcaactaccgcagcaccagaacttctctttttgatggcattgaggagggcagaatccgtgcaacatcctattcttcacatgagatagatgagaatgagaatgatcaagctattgatggattgcaggatcgagtcagcattctcaagcgggtaagttgctgcgttattattggacgtctgatttgccctaagttttgccagtaaacttgtgaagaattactgttttgattttttgacataatcactcgtattagtatatttgtattaagccgtgctgcacagatggatcattaaagcaactactacatttgtaatagcgaaaacgaaagattttgttgattgtgacttcattcgtggccacctattagataactgtgaaccatgtgcttcttggaccattttcatttgaagtgttggaaagtgctacagcgcagcttttgatcatgagatttatgcttaaatatggccaagaaggaatctgagtaatctaatgggccttgtgataacttttggaagcagctccaatgccaatgattttattaatctttttggtattcatctgatccatgtttctaacatgcgactgatttacctctaaaggttttagtgctagaaattagctaatgaatggactatagaagattttgtttcaactgcaagtagccagcaaaacagaagattttaataaatctttggatagaggacacgatgtaattcttatgtaactgtgggcctcttcacacctaatcaattttctttgtagtcttaccaagacatttcaaaggtctgagccttgaattaacgaatgaaatgagtaataatatcttcagtagtttatggtgttttgctcctgcttatggatcaacagactgctggactgctggtcccgttccagtgtttggttgtgtctagtttttatagctatgcgaatcttctaccctgtcatttctttggagagatctacagacaatcatatatggatggttactgaggttattttacgtacttgcagttgtctggtgatatccatgaagaggtggaaactcataaccgtatgctagaccgaatggtattttatatttatccttttaacttttgcttccttgaaaaatatccttctagagttctattatgttgacatcttgcctgatccagggcaatgatatggattcgtcaaggggttttctgtctggaacagtggacaagttcaagatggtaaacactcacacagtacaatcttccttccatcataccatccgtatattctgctgagaccgcaattgatgtctacgatataggtttttg

SEQ ID NO: 40632 - DNA, 1086 bp, Oryza sativa
cgcggttgattttgagataatatctcccaagacagtcttctgaatcttcttaagtagtggcacctggtagaaattttccataggcaagttagacattcaatagtaagagcataacatcatacaaatataccgaatcatttgtatcacattctagaaataattgattagttattaattttgtgttcgtcatggcatacttttctgtagtcggtgttacagaagtagaaagtgttcattggtttcggcgaggggatgaatacattgtttatatacctcaaacttgcaaatatactattcagatataaatttggttcagttgtcactatatgcatgtctcaattctgtgtgtatctcattcataaaccccgagaaggacatcgttccttgccaatgtttgttctagtacatatgttttcatgcatgatttttctagtgatgttgagtcgagaattttaccgaagaagttggttcacttgtcactgatattgaatgggcctttccgctgttttgcctgcaagaattttgacatgtaaagaaggtgaaatgtgccattttttcgtaagtgtcaaatattgactgatacatagaatcttcagtaagggcgcacttactgtgctatcaccgcggcgcttgcagcgtcaggcgccacctgcacttgctccgaagctgacgccatcatcttctccggcgagccggacatctccgtcagctcgacccacggcagccaccgccggaacgcctgccgcgcctccgtcgtcgcgagagcaggcaccaccgtcaccctcctcagcgaggagagcatcgtcaggggagccgcgagcgccgccgcgacgtcaggcgtcgccacgacgtcggtggcgccgtgcgcggccgccgcctccatggccgccgttggatcggaagacggcgaggcggcgagcagcaccgtggtcactccggcggctgggagcgcgagggcgagcagcggcaagccgtggacgctgcagatggggagagacgccaagcaaacacggccctcctccggcaagcttgcgccggagacggcggcgatgaggtcggcgtgcgtcatggtcgccgccgtcttgg

SEQ ID NO: 40633 - DNA, 18317 bp, Oryza sativa
  unsure (1)..(18317): unsure at all n locations
aagtgatttgcccaagtaaaagatctccctgatgactccaattctctaagattcaaagtgtcaattactgcattgaacagaaatggccatctatcgttaaaggtatcattatttttctcctgtgggttacgaagtatattaaagtcaccacctacaactgtaggtatggtttctttagagcaaactcgtactaattcagagagaaaatgaccttttaaatcagactgtgctggaccatatacagaaatcaaattaaatttaaaatcatctgctctctgtcttaatttaaagcgaatgaaaaaatctccttcctcaatttctccaatgtcaagaaacagcaaattaacacctagaatcataccaccagagcgccccctaggggccatgcagtgccagatgaaatctctgccagcacaaatattatttaatgttgactgaggaaaagaggctctgcccgtctctgataaagcaataaagtctagattttgctccttagttagatcagacaaaaatttatattttttcgggtctgcaaacccattacaattccaaaaaatacccttcatgttttactacgttcgcttttatttttattctgcttacccttaggctgcctcctctttatttgtgataagggggtatgtagacacagcgggtcatagcccccatcaccaaggctttccgcaatttccgaacagatagtatttaaagcatcaatatcaacattatcctccgaacaaactgatgagttttcctcgcagctacgtttctcctctttactagatgagcaaaagtcgttaaatctttgtaactcaatttgttttaaagaatgtacagaatctagaaccgaactaacatcgtcccccaaattaattcctaaagagtcagttgtagccagtataacagaatcatctaaattatgaaaagaggaggggaggggtttgttaccttttgcagcagtggaatccaagtttttgcgagctttcagtttggtggccttttccatggagtcctgctccagggaggacacattgcgcttgctggacctcagaggagatacagtctctcccttgtgcaccaccggtttgctagaagagccatggttacccaacatgtttgcctgccactgaatggaaccctccagagagatcccctgagatagtacagccacgggccttttattttttcccggatcagacttagccactgttttctccttcagcttgcctgtctcagcacccgcgccatgcttgggtagctggtctgcaggggcattttcaggggcagcatcctttggtaagtcatcaggggtgccattatttttgttggcatcctcctccattgggtcctcgcctttcccatcattgtcaccatcattgtctgtggtagagtccatgtcaatgactgaaggctctccaacaggcatatctatctccatgcggaactgcagctcataaacgaagtcaccaatgaccacatcaacgtaatctgggatcctgttcgggtctagaacagccaccttcagtctggacctgccaaacgtcttggtaaagcgcatatccaccgctttagagacccctaatatggaccctatagcccatataataggaaattctctgagctcgctaggtagaccccgaaactgaacccaaactttgtcaatctcatatctgttcacatcattctcgacacctttctcgaagcggatctttcccttaattgtcttggtgtccattggaccccaattcaccgcatattctcggagctcggatggaaaattagtaatgatgaaggcatcagaccccttcaaaccaatctcccaagtgattttagctggcagtagtctatcaagttccactgtcagttgatcaacagtaaaggaaccgtctaagacacgtaccaagaccgtgtgctcctccacattactctttgggttgtcattcatagggatatagtaaaagcccatgccctctactgcataaccacatggagccgcaatcgcatttgttttcttcacatttgggcaattctttagaacatgattttcaaagcacaaatcacagcaaagcaagacagtgcaatcatctaaagtgtgcccctttgtatagcagcggaaacagtagggtttacccttgctcttctgctttccggcttgtgcaggttcgggcttggttgccatgaagccttccagatgtgtcgccgcgggatcctgtgccgatcctccaatgatggcccctcttgtggagccagctggagcagccgccggtgctgcttggctggaggccagcagcgccgacgtcccgacctgagacgtaccgaggccgccaccgttggccggtgcagccacctgggccttctggctttggctgacctgctggaagagcacagccccagcctccctggtctggttgccagccgcagccggctgggtaggctgctggccagccagaggtgcctggaagggcgcctgggcgggctgttggtcagccagccccgctgtctggaagccagccggctggaactgaccagcagcggcctgctgctgcagttggccgaccaccgcctggccaccggcctggtgtccaggaacgccacctccggcgtggaactgaccggccgcgtggccagcagccggcgcgaagcggcgcccaccctgccaaccgcggcggttccggttgcctccgtatccaccgtgactgttaccaccatagcctccgccgccatatccgcctccgtaccctcctccgaatccgccaccgttgtggccatgtgggcgaccgcgctgatcacggccacggccgcggccgccgtcgaagccagggtggaaaccttgcgcgaagccccagcctctccctcccccttgaccgccaaaccctctgcctccgtgtgccgccatggcttttcctctccgtacgaccgcagcgtacgagatcgtcgcagtggggcgtgatggcggctgcagttttcgcgatctaggtttgagtccagagcgagcaaagagggagatcaatcctttggtgggccgaaaccacttcccgggccccaaacgaatccgatccgactgagatgcagatggcgccggccttcgtacctcccctcctgcgctggcaatcgcggtagagaccgacgagtgcgcaccgcagagaggagggaaatcaggccgtgaaccctgccgtagtaattgatcggagtcgtttgaaacgcccaacgatttcggaattacgaattttgaaccaaccgtcccggcctccggcgatgacgatgaacgaggaacgccgcaccgtcgaccatcgcgccgcctacgccgcggacaccgagatgccgacgccaggcagtcgcccagcgttctcggcggagaaacgcgttccgctggtaaagggccacgccatggcggacccaccagcttccgccgtagcagcgtggacaagattacctccggcaaccgttggtcgctgttcttacctgcttggagttgctgctccgccatgacgagctgtgcacgtgagaatcccgctgcgcttgcctcgttgacgaattcctccgtcgacggagaagatgtcgccgatgagcctgtgaacgggggcggtgtcggtgcctcatcatcatcctccgagtcatcgtcgtccggcgttgcccaaaactttgagcggatcggcgatgctggcgaaggggtcacagcatgcaccggcttggggcggccggtcatggccgctgcccacgccacctccttggacaattgacgccgtgccctttgctcacacagcgctccaccgctctcctctgaaacgccacccacagccgcgcgctgaccaccgacaccacggccggcatctgcgccgctctgacctcggcttctagcgagaccaccggccagaggagcgatagtgaggagcctcccccgcctagcgctcatacgagcgtggctccggcagccgccggccaccggcggtggccaggcgtgatccgcttttgtcggatcgccctgcctacctcagccgtaccagctacggaaccctcagtccattggcacttttacatagcacaactgaagctactatcccaatataagtaacgaaatgtatatgctatggctctttgcatgttatacccatgtgtgatcaaatacttctatcatagtatttcacaatcgcattccttaccatgagcggtaacaagagtgttccttagctaaatcagttcttaaataatcattacttgcgttctctttttagtatgtagtgtttctgaaagactatatataacttacaacttccttgcaaatatactaatcacttaaagttatttacaataataaacaaacatgcattacaaatatcccgtcgcaacgcgcggggtatcatctagtaatactatgcatctagtacctcataggaaaattcttttatctacaagaatatacaaattaccaaatagacaactataattgccttttttttccgtcgttgtggtgatcggaatatctgatcatagagctaaccaatatggaaatattgtcttcagacacttgttttggctccgctttaatcggagtcccagtgtatgggacaactgcttcgttcacggagacgctatatgcgggacttcagttattcttaaacacaatttatcagggggcatgctaacgggcgaagccgcgaagtgatcgatccccatcctccccttagacacactcctctcccccttcctcctccccttcttaccttcctactataccataaattttttaaaaaataagaaaaaacaagagttagaaaaatttatatatagaaatactataaataaaaaaaatatttgaattcaaattcaaattcaaatttaaattggtatgtaaacttttgacctataaactttaggtctataaactttaggtgtataaactttaaatgtatagaaataatatattaaaaaatatttgaattcaaatttaaatttgaattagatataagtcaaattcaaatttgaatcgggtatataaacttttgacttataaactttgggtctataaattttaggtgtataaactttagatgtatagaaatactatatataaaaaatatttgaattcaaattcaaatttgaattggatatataaacctttgatttataaactttggatctctaaactttagatgtgtaaactataggtgcataaatttactaaaacagaaaagtaatacggtgccaaaaaagaaaactaagtggtggaggagaggggaacgatcgcccgcccactaggagtttcgatttatcagtgctttagaatttgattgtagggttttctttgtcattttcgtttacaactctatcccataattgctaggaagaattttttttatatatataaaaactacttagaatcattcttttaggcattcaaaaaaaaagaatcattcttttaaaaaatcgaacttttttactcaaaaatcactttaagattgtttgccttcaggtcgaactccttggccgttgttggctgaactcaaaccatctccaaaatgtaaatgtaactgaatatgtacaggcaagagaaaacagagtctgactgttcaggagaagcagagtccgtctgtaacgaaagacaaacaacatcaacgagataacatctttacagttaactgccacggcgggcagtcgttccagatcacattaccaacacaggacaggaagaaacaacaagtggactggagggatgcagattgatccatcaaacaaattctgaagaactggcccagacccataccaggatgttttaaagtcccacacaagcacggctgaagattgatactgtcattctgtcagcgtaatctagaccagacattgatgaaaccaattgcaagtttcgaactgaataccacaacaaaagattcatcgacatcacgtaattacaggatggtcagaccttgattactattgcaatcaagtaattacaggaaggtgatacctcaattttttgactactactaacaagaactagaatcacaagacggcttcttgatcaccactaactagcaagattgttgcaagaaaccaagaagatcaaaatctacagctcttcgatcaaaactaagttcctctaggaaataccctgcgttgattgaagagctgttcatctcagaaacaacaaaatagaagaaacaagaaaaaattgaagacgaggcaagaatctacatccggatagcctgcagcggcattgcgtcgaacaccaccgccgccggggaaagcctcaactcggggagcgcgcggacggcctcgttacccacatccatcgccgccgccgcgctcgcattgtccttgagatcaccgggagccagggggaagagcttgaggagctccggcacagcgcttcttgccggccccggtaagttctccccgatcggcggtgcctgcgtcggagggaacaattggaggcacaccggcgtcagtttcccgcccgcagcctgcccagcgccgccaccgccgccgaggccgagggcgaggccacctgacgggcgctgctgcacgtcctgggcgtggcgcttgcggaggtgggtgttccagcggttcttgatggcgttgtcgctgcggccggggaggaaggccgcgatggtggcccagcggttgccgtggacgcggtgcagctccccgatcttcctgtcctcgccggcggagaagggcagcgcgacgtcgacgctggggtccaggtgctgcctccaccggagacggcacgacttgtcggtcgggccggggaacgcggtggcgatgacgccccagtccttcccgccttgcttccgcaccagctcccgcagcagcttgtcctcctccttgctccaccccaccttcttccccgcctcctgccccggtggtccgccaccgccgccgacgccgccgccgcccgcggctccctccaacgccatcgagtcagtttcttgatcaacgagtcgtttccttttctctcctctttgatcaatgagtcgttcgatggctgagcgttgcggctaaccgttgcttttatagggctatcgccgttgcgtcgagtccgagtcgggctcaattgggcccaatttacatttttagaagtcctctttagaacaaactacttgatactattagtactactcctactgttaaggcaaatcaggggaaaattactagtactactgataaggttgagaaaaaagtttaaggcaagtgcaggtagagagggtactacggggaacatataacggcaagaagcaagcacaacatcaagcacggaaattacgctctgattggtttcttgaagaaatattttccataccactcaataattggcacttacactagaacagggaacatcaaaatcgtacagtttcaacttacaactctcgggagatgagtgcaggctgcagcgcagctgcacagattatcagaaggagaaacaaaagcaagagcatggcttttggttatgaactctactagtaccttggacctagaatcgaaggctccactcaaattagcacggtaaaaaaaaaatacagtaatggtagctcacaccatgaatgtaattaatcatatcaatcagcagcgtcttgatttgtggatttgtaggccgtggcgctgtcgctaattgagactagcagacgccgttggtcctcttggcgagcacgaacttcttccacgcctccgtcaccgaccgctgcgtctcgagctccgacttcttggcgaccaccagcagcggcgccggcggcacggggggcatgagcctggaggggagcgcgtcgagctggtacatcaccttctcgatgtcgaggacgaggcgctcggcgagggtgcggctgaactcctcccggatgaccacgcggagcaccgtgacgtgctgggcgtcgggcggcatggtgtacgccggcacgatccagccgaagcggcgcagcatgtcggagatctcgaactcgtcgtgccggctccggtccttgagcgagaacgccaccagcggcaccccttcgtccttggacacgatgtcgaacctccccgtcttcaccagcccttccttcagcaccatcgcgttctcgtggcagttctccatgatgttcctgtacccctgcaaataacatcggatcgatgggtgtgtcagatcagctaaaaaaaattcatctgatcaagagagttaattgtgttccattgattatacctcgaagccgtggcggatgagctggtagtactgggcgatgacctggctggagcccttggagaagttgagggtgaaggttggctggtcggtgccgaggtagttgatgtggaagatgagctcctcgggcaggtcctccttgttgcgccagatgcaccagccgatgccggcgtagacgagcccgtacttgtgaccgctcacgttgatgctcttcacccacggcagccggaagtcccactccagctccgggtacaggaacggcgcgatgaacccgccgctcgccgcgtccacgtggatcggcgtctcccacctgcacaccacggccgcaatgacatcgattaatctcactttcatagatagataatttagtgtagtagaaatagtaattttagttacccagtctccttgttcttcttgtcgaggaggtcgttgagtagcttgacgtcctcgaactcgccgttgagggtggagccgaggatggcggcgacgcagatggtgttctcgttgaccatgtcgacggccttctcggggtccatgacgtagtagccgtcgcggagcttcacctccttgagctccacctcgaaggagcgggcnnnnnnnnnnnnnnncacctgcacgttggcgccggtgatgatgttgggcttgtcgaacggcttcccctcggccttgcgcttgttctgccaccgccgcttgaaggccagcccggccagcatgatggcctccgacgaacccaccgtgcccacgcccaccgccgtctcgtcctccccgagcggcgcgtggaacaggtgcgcgatcatgttcacgcaccggttctgcacagcgtcacacatccaaagcgttcgttaattagctgtagaacggcccggcccaaaaaaaatgttgtacatttcatgctaggacatcatctggcccaaagcatgtctggctgaaaaaaggactaataatgtgtctcattcacaaaaaggggaaagttgcagtggtgttttctgtgttccaggttttgactgttgtccacgccgtttcagtagatggaactttggtctcttgccctgttttgaccaaaccaagcattattctttcccatttcccttcattcatgcaccttccatattttaatgcgaaaaatgaagagatatggtgatcattcttcccatccccttactttatttattggacttcctatatattttttctaatgcgaattggtgatcatctcggaaactgtgccatgttcttcccccattctgcctcccgtgaatgacgcaaatgataaactcggaaataaagtttctagcctgagattcttatcaccaatctgccaggccaggccaactggccaagccggttttatcgaccaaaaatccggggatttccagtgtgcattcgagccgcgcgcggcggcgagaaaacgcgaggtgataggagaaaattcaacgaagcagagatgcctgcagggtgctgtacctggagctcggtggtgacggggtactcgtccatgtcgacgtagttcttgttgatggcggccatgatgagcttgtcgcactcgggctccatccacgtggtgacgaacgacgccaggttcagccgcgggttgccgtccagcatcagctcgtcgttgatgatctggtacgccgcctccttcgggatcgagttctccggcatccggtacctaataacaccaatcgatcaatcccatcgagtcagccatgaaatattggaagaagctctgcattgggccaagaacagcaagaacagagagagagcagatcgagagcacgtaccttgggagggaggcgcggacgtagcgggaggcgaaggtggagtgcacggacatgtcactctcggagacggccttggagagcaccatcttgcctgccgagctatcaacctgctcctcctggtggctttagcctcggtggcgatcagacgaagaagaagaagaagaagaagaagaagcagaggtggctagaggagagccaggtcgagaaggctctgtggcgcgcttctactaagctcttttcggggggggacttgaacgaaacggatgcgagttgttttggtgtggttggaggcagggggcagcgccgggttttataccgcaaaaaatagtgacgcggcggagacggagcacaacaaacgccgaaagggacggaaggagagagggacggacggaagcagtggccgctccgtcattgcccgctctcgctgggtctagaggaagcgactttgaaaagggggaaaagtcaagcagcgacggtcgactgagcgagcgagcgagcgagctgccaggcgcgaggccgcgagccttcgtcgcgcagacaaatcgccgtgtgctgtcgttacttgattcggtaaatggacacttttgatttggttccgttttcactagttggtcaaaaaatgggcactggtgtgtaactgcgtaattgtccaatgaatagggaaacaaactaacctgtcagtactcagtactcgtgagagagagagagagagagagagagagagagagagacggtgcacagtcttcttaaaaccaaaaagaaaaatctgaccatgaatagtcaaataaacaaaggaactgttgatctgtaaaacacatgctcctctgatcaaataatatgaagatatttttaggtcgttctggtgtgaattggaccgtgattatttattaagataaatttatgaaagtctattctgaccataaatggtcaaataaataaaagcatcgttgatctgtaaccaaaatatacgcatacatttttaggtcacaatgatgatactttaatcacaacccctccatccgtttcgtattacttgtcaatctagcaattttcggacaaaatataaagaagtggctaagtactggtctacccatattagttacaaaaagtttaattagtttatggattattagcgtactactttggtgccaaaataaagtttaaattcatggataaaagtgtacttcttttaagatggaggtagtatttttatcaagacaaagctacatatatcattttttatgatttagacttaagtattttgaaatttattgatgatcaaaattctagtatgattgaaagaaaatcaaatgatgtatttttgttttaccagagggagtactggttacttgtaccagctagtaagagataagacgaaatattatatacaccagaaataaaaatgatttttgtcctcttatactcttatttaaatacttatacaaaattaagagtaaagtacactgccggtctcctgtgtcatataagtattctaactctcaaaatacatttttagatcctaaacttgttaaagtatgttatttcggtcatgacccatccgggatcctatgtgttgttcacctgacatgccacatgaggcattgactcaggggctgtttagttcccacgaaacttttcccaaaaacatcacatcgaatctttaaacatatatatggagcattaaatatagataaaaagaaaaactaactgcacagtttacatgtaaatcgcgagatgaatcttttgagtctaattagtctatgattagccataagtgctacagtaacccacatgtactaatgacggattaattaggctcaaaagatccgtctcgcggtttccaggtgagttatgaaattagttttttcattcgtgcccgaaaaccccttccgatatccggtcaaacgtccgatgtgacacaaaaaattctcatttcaccaactaaacaggccctcattttatagaggggtctaggcaatttggaatcagaatgaaacacttgtccaggaatttgaaaaataaattctgcgagagtaagagaacctaaattacacaggtgaacaagtttagagaccaacaattcactttactcaaaagttaaaaaaaaggtagattgatgtatgatatgtctatgatttctacaagtttacaaagcaaacaaatttaactgtcaatatatgtaaactaactagagttttttttaacttgtagatatcatatttgatcttatatatttatgtagtgatataccacatattaatctatttttttaaaaaaaatacaactacataaatgacatgaaaagaaagcattccctcgagagttttaaatcattttcccaacgaaaagcaaaatggttagtcttatgtaagatcgacacacgttcgacatatattgtacttatatttaactgcttttttcaggttccattcgttcatcttgtatcaaatacgtcactcgccccttttgacatttgatctgaggtggtcgtgactcgtgacagagaacggcagctgagaaactcatgacgtcagcaagctgcacaaaaagtactcctactcttgatgaaacccagtagcgttcttgcatatttttcttacaaagaaataagacctgtatactttcgtccactaacgctaatttttgttaatttgttgatacagggagacctaacattgttacgtttttcagataataacctaacattgttacatgtcttgaacgtaagagaatcttagctgtaaattcttgaaacggggttgaaaaggacgaaaattttgaccacttaccattcaaccttcgtcaagacatatgccatattcgccctgacatcaaaattataattcatttgagggtttggagtttggacagaaaaaaaaaagtaggaaaagagaagggaagggttctaggcagtggcagatctagaaaatagattcgttggtgtcataacgtgactatcggtgtcatagcatgctaattatccttaggtcatattgttataacatatagataagcagttttattatagattttaccgaaagtcgtcggtgtcgaccttaattctgtagatccgcccctgttctaggctaggggatagtatatatcaatgctatcacccccaccccaaactatcatgtgttactcgtcaaaagtaagagaagacttcacattttcattttcacataagtagtacctaaaaaaaagttaatcggatactctattatgaaatttttcatcgttttatgatatattaaacaataggactaacttttattagagactttaaaaatatacattattttagtaaaaggaaaagagaaaaacaagggtaaaataatttaggaaaaggctatacatactaactttttcttactagattcttactaacactgatgtgtcatgctacgcgtgcatctagatttttttttataaacttccatctacttaaatcaaacggttgagatgattgttagtaaaagtttagtaagaaaaatttagtacgtgtagcattgctcaataatttaatagctataggttgcgggaggtgaaagtgcacttgttgggaaagagcaaaccgatacaagtgagctgaaggcacctcactataactagtgaactagtacaagggaggaagacccaaagaatacggtaaggaggactcaccttagggtggaggtgccgtttaatttggcacgtaagaaaatgatttatgttgttttctttaagtagtggacaaagctttttaagtcattaataaccgtagaaataaactaaactttgaagttcatgcatgttagaggagagccgtagaattcgatagctttccgggttaattacacgaactcagttatcaaatgacgcgagctcgcacgccgtgggaattgacatagtccgggtgtctgactacaaacaccctctgtattaatatatagactgtacacgcaggacgaaggggcaaagtcttctcccacggaagcaaacgaattgcaaaaaacaaagtgcaaaaggcaaggaaatacagcacgcgattagtcagtagcccaaatcgtggggtttaagccaaggaatatgtgcatcgctaggcgagatgcccaaagccccaaaccaccaccggcctgttaccgccaaggcgccgaaccggctgctgcgccgaacccaccaccaccgcggcgcgggcctcgtggcgtccgagtcaggccgcacgcggcgcgcgggcggttccgcgcgcgctgggaaagaccgacgccgacgcgcgagcgagagagagagaccgcgtcgtccactcccaacacccagcgccccctctgccggcgcgaagtcgaaaccgccgtcccctggtcgcgcctccctgcgggccgcgggggaatcccgcgtgcgcagccggcccacgggcttacctgccgtccaagatcgaaaaaccagcgtcgcttaattgcttttgttttcttccgcgcgtggctccccacacggccacaccaccccacccacaccccggctgcccaccgactcgcggctgccctgccctgccctgccctgcccgccctttgcgtttctcggcagacgatttatttctagagagcggggacgtgacgctgtaccgcacatgcgagcactgatgtctctgcgaaaggcgccgtttgtcattccatttcatcggaaaaagcgtgtggttaagaggggggggggggggggggttggccatttctttttgtttcggagaattcgcggggatggccatttcgtgcagaaaagctcttgccttgctccttggttttatttatagtttatcgatctttatgacgcgaaacagagtgctagcccgtagaatagccgcaaaaacttaatgcaggttttgtttcacgccacgttcggtggtagtggaagctggctttgtgcctggcgtgggtgttagcacattaggtttcaacttgtatgccctctagaaaggcttttaagtcagtaaatttgattgatatcgatgtccactcacattcttatacgatcagtgtagtgtactcgtgtatgtgactgtgttttggtgtttgataagttcgaaccgttatccatatcggtgctctataggcaatgttggagccaacaatgccgtcaagctcacttcacgaataacgtttttggtggccgattgtttttttaataatgtttattattgtggcgaagatcaagcggttgcctgaccatataacctgataattgctccgccattgaatatggggctgagcatgcttttctattgtgatctctttcttcttaaccatatatgctggattttatagtcccttacaatcaggtactgaacaaaatctaatcaatccatcaacagggataaggcaagaacaaaaattgcatcctatgctcattcaatgtgcttcgtgctcatcaaacaggagacgatggtcgctagctagcaaacttgtggggaaggccgggttgcccaagaggttgaagtcacctgtgagggcttgttcggatcacataataggaaaaatataggaataaaaaaaacacaggaataatataggattgcttatgtaagatgtaggattgaaaaacgaaggaatttgatggtaagaagcattcggaatacaggaatatataaaccgtaggaattttccaattaatattgatctcatatattatagtataattaaacaataaaatattagtttccatctagtcaatccaacgtgattagcatgtaccctgtggtagctaatgaaaaaaaaagagatgtgagtggatgttcagaatcctatgaaattcctacgttttcacagggttgctatagtattcctacaaaattcctacacgtgattcttatgaaccgaatgcatcaaatccaaaggatttgccaatcttacaaaaatcatgtgtaatccctccattccgaacaagcccagagttcggggggagggggtcatgcacgtgagtgaggttgggaaccttcaatcccagcacgcaaaacgaagcgatggttagcgcatgattaattaagtattagctaatatttttttttaaaaaataaattactatgtttttaaaaacaactttcgtatagattttttttaaaaaaaacatatcatctagcagtttgaaaagcgtgtgcacggaaaacgattgtcgaggggtgactctctctagcgggagatcgtgagacccccccccccctttcgtgagttcggccgggggcagcgggtgagattcgagaatttggtgagcaaaactgtgtgtgatcttgatctcggaagctcctccaagacgacgagacaaaagagatttatacatgttcgggccgctatgaagcgtaataccctactcctgtgtgtatgattcttctgagcttagaaagtccctgaatccctggtatgcaagctagggttagacaagctttggctcagggatcctcagtccgatcccccatcctcgctagacatggtcctccttttatactctaaggggataccacatgtgctgcgagtcctacctagggagaagggaaaatattctctatattaattacatgtcttgagccttagcccggaagctatctgcacgtcggttgctgcgcggggcccatcaaatcatgcagggcccccttgtcattcgccatttaatggatgaggacttccgggttctcgttcacactagaaacgggaacccgggtcagttcagagtggttgaactagctccgaccgggtaagaggctatgaagccccccatcattatgatgggacgggacggagcacgccgctcgccgcctgacacactgacagggcgggggtacacagtcgccgtcccatcagtcattcaaccggtcacagaccggtcaaatgcgcagcacgccgcattaaatgcggcatggcgcgattgcatagaccgctttaaatgcagttaggtgggcgttaggcgcgcccacctaaccctgtacatgtgggctgatacgtaaagggggtcggggcagctcgaccccaagctgggagggggcagccgccgcaacaccctgggctcgacccccctcggggggagccacgtgggtttgagggcggcctcctccctctagctgggagggggctgccgccgcgccaccccgggctcgacccccctcggggggagccacgtgggcttaggggcggcccggcctcaagctgggagggggcagccgccgcaacaccccgggctcaaccccaagctgggagggggcagccgccgcaacaccccggcctcgacccccctcggggggagccacgcgagtttgggggcggcctcctccctctagacgtgatacccccgggcccatatcaccgacaacgatagagatgtgttgggaaaggaaaaaaaacaaacttagcctaatagagcaggtacaatagcaggctataagccagctataaacatattttaaagagataaagggaaagagagaatagcagcgggctacagatatgtagccagctgtagcacagactccaagatgtaatgtgtatatgacaggtgggaccaggtattaatagtatagtaagcaactattgtatgaattggctattacattaactatagatgaattggagctagtagtgagctatactattaaacttgctctaagggggaatggcggaaaacaatagagataggttgggaaagaaaggaaacgaactcaacctaaggaggaatggccacccaatggagattgccaaatgagcttggatctcacgggctagttgggaggaggggggagttatttgaaaccagaaattacttacccatatatcttcttaatacctttttcaatggttaggcattaaaggaaataaaaatattaagaagatatgtaaaataagatgaaccattaacacatgattacttaattattttaaacaggaataatatattgatatgatttttaaaacctttttttagagatatttaaaaagaacacaccgtttagcatgtacatagtgtgaggcaccaacctagacgaatcattaggtaatgtactcctaagtactacctttattttaaaataattgtaactctagattatttagcatatattaagatttaaaacgaatgattatggtgtccctcatcaaacggtgtatagatgagagttggaggatggctgagggtaaaataggaagaaatttgaatggaaatgtgattggtgggataattagtattctaaaatggtaactattttggaacatattttaaatcctaggaatacatttattttggaacataggtagtaggtacaaagaggtctcaagaatggtaaagaaaaactctttctaaaatatcaataaactcaaatgaaacacatggattttgccggattttcgttgcgtcaaattaat

SEQ ID NO: 40634 - DNA, 2041 bp, Oryza sativa
ctgcacccacgttggatccgcctctagacacagtgtgtatgacttgtgggaccatgtattaatagtgtagtatataactattgcatgaataagctattatattagctatagatgaattgaagctagtagttggctatactattaaacttgctcttatgcatgcactgctatcgcgagccgaccatggcgttttactagcttgtttagattatactatctttattggtattgggtatatatgctcttagtagttgggagttatcttgctactttactcagcacacccgtctatattctcccttgtttttaattcgcaggtaagctatctgtaacgagcgtaacatgcaatgcaaggaagaatatctgtaacgagcatatatactcttgaactacttctggtgcaggaataaacataccctttacttaactgctagaaagaaaaacaagcagccaagcagggagccaaaggaaaaaaaaaatcctatgacgacccggcaacgcggagtacaccagctactagagataggagtaccaaccaatcacggggcgcggcatgtgcgtgaagccttgaacggacgctgtgatgcgggggcgcgacccacccccacccccgtcacgcacacgacacaccgcgacgcgagcagccgagcacaccacacaggccgacttgagcgcgagccgcggtgctggatagcgcgaagggatgaaactaggccaccgaattgggcttcgttcggcaaagcgtcgaagggcggcgtagggaactagggactggcgcggttggacatgggccgtcatgccgtatgcccacatcgcgtcgataacacgggcctctctcgacggatttttgcagggcccgtcccacggtgcgtgctctgctcgttatgcggttgggcccaactcaaggaaaaaaaggaaaaagtatacttttactccctcaactccggcccgagtatgattcatgacctccaaggctccaactacaaaaccgggtatatcgactcctccaactaccaaaaccggtgcaaactatatccctgggtggttttagaaatggttttggctgacgtgacgcctacatggtggtgttgactcggtcttcgttccacgtgtcgtagacgtgtcgggcattagagtaaaaacaaaaatttgtaggaccaacatgtcattcacacgagaaaaaatagtgggacccaccgacatgtgggcccacatgtcattctcaccgacgccccatcccttcttcctcccctctctctctcctttctctctctttctctcccctttctcttcgtctgcaggcggcggcgggtgttcgagggccgtagcggcggcagccagcgggagggcgggcgctgcctagagacggagcggcgacgaggcgccctcgaggcggagctatggctcgtcgtcctcaaggcgttccgatggctcccgccgcccatgcatgtgttgacgcctgtgccgccgtcgccgcctccggcgccggggctctgctccacgttggcgtcggcgccgccggcccatgcacgcgcacacatggtgctctgccttctctcatgtacctctccagtgtctccctgtgcctctcctcgtgctcccctctcatcagtagttggctagctgcacacgcaaaatacattcacactcatcgcctacatagctcactctcactgacatcatatcacgtcaatgcaaggtgtttgttgctatcacgacgtatcctggcggcaaggatctggacgccggcatacttgacgtcccagctgaacttggtgatggcccagcaggtgccgccaaactcgtccgcgttgtcgacgatgtagtcgaggtaggcggcggcggcggcaaaggcatcgcgacgtgcgtgggcgcggcgggagccgtcgcgacgccttgaggacgacgagccgtagctccgcctcgagggcgcctcgtcgtcgctccgtctcgaggcagcgcccgccctcccgctggctgtcgccgctacggccctcaaacacccaccgccgcctgcagacgaagagaaaggggagagaaa

SEQ ID NO: 40635 - DNA, 10008 bp, Oryza sativa
aatgccacctaagcgacacgtcgacgacacgtgggacgaagaccgggtcaacaccgccacgtaggtgccacgtcaaccaaaaccacctaggatatagtttgcaccggttttggtagttagaggagtcgatatatccggttttgtggttggaggtcatgaatcgtactctggccatagttgagggagttaaagtatactttttccaggaaaaaatgaatcgagtgtgtcaaactgaactgaagacttaaaaaggttgaatggcagtttgactgctagtgcattaatcagatttaaacttacaatactacttatttttttccctctcgaggaatgtctagcagtatatttgcttgacagctcaaaaatataaaggatttgcagtaccatccaaatttaggaacaacatacatggaaaagacaaatcgcctggtgcatgaggcgcttacgtgcaggaaaaataaaaggaaactgaagctggaaaaaagagagacattataatttgccgttgctcattttctattttagtgagagttacatgcgggtgcagtggtgcgtgtgagttgtgactctccacttccgtgtaatcgggaaaagaagtaaaaaagaaaagaaaaggggagtcggagagagcaccggtagcattattccaagcaggtggacccgcgtgtcatccccactctacaaagcgcaaaatcatcaagggccttcgcctcggcgtggaggagagtgaggacggcccacgcggagcagcagagagtggcgggctcagtgtcgggctcgccggagtccggccaatccggccggttcatgcttcattctctcggtgcgtgatttctccgattttcgtctccatctagtacctgaagcgaggcaaatttaattgcccccttttcggtgcaaactatctcgtcagattagtcgcatgcatgttccttcgttgaattttgcaaagttagttgtagagagaagttcttgggagggtggatgctacggtctcatcttctctcttttcccccaacaagcgagctagcgaaggggaaaatggggggagcagaagaatatccatgttaggttcgcgtgcttgcctctcggctgagctctagctgttacggcgttcgtcaggatggctaatccgtctcgccaattagaagatggataggtcgtagcgttagatggattacttgatggttgatgcgctgcccatttattgttcgtagcaggttctgtcttctcagtccgtgtgagtgtttcatcatattggctaccaagatgatcactcttcgtttatcaagagagtagggtgagatctcaatccgttgcaactgatgagtacttccttcgtctcagaatgtaagtatttttgagttagacacagatattaaaaaagtaggtagagatgattggaggagagttgtgattgatggggaagagaaagtaggtgaaaaaaatggttgtgattggttaagaggagagagtaggtgaataaatagcttcattttgggacaagttactgtactaaaaatagatacattttgagacggagatagtagtatacttcacttactaccgagtacggctttagttttgctacctccgtcctaaaatatagtaacctaggatcggatgtagcatgttactactaatctagataggcagcatgtctaaattaatagtaatatgatgtgactcgtttagtacaatattgatatattttaggatggaagaaatatataaatactgtttttttattcgaagtagttggcccatcatttctgaaatagatgattgatgccatgacgccgcttgctttctagaactactagtaattttaggtgagagctagtactgatgcgtcagtctaagataatggacaaaaaagggctacaggctactattgattatcacattaaaactctgtacgacagatttttctgattaaatgatagccatatgcccaacgtgctgcttgtctaaactgaaacctgacatcactcacagtatgcccagttgttgggtggtctattattatttataaattataactctggcatttttttattgtagggcaatatgttttccattattttccattaaaacctctaatctgcacttccactatctgctcaaaatctcaggctactttctttcctcttcctcaggacattaacctggtttacttgtaagaaagtaaagccatggactcctcataccagcatgacaagcctctgctggatgaagagaactcctcgcaagtggtttgttctctctctctctcactctcatagcgagatttgtctgatttttttctcttaaagagaaaaaaatatttggccaaatttgaggtgccttttctgctttcatcaaatggtgtgaaaatactgctttcagctgatgttttgtttctgtttaatgctctagttctagagtgttgcgaaagtaaaaaagaaatatagagtgaagttcagtcggaaaattttctcttacttaaaattattttatatggttgcactagtatggggcatggccgactggggcatgcaatccaagataaactttcaaatgttctgtctaaatatatcatccttacaataaggacataaagtggtagcaatatattactaatgtgaccataagaatggctaggcccttgcatactaataatgtttttagttagtgatactttgcagtttttttggatgatcagttaatttgcttccaatgtatataatataattttgttcttaggataaattttcctggaaatatatagaataattccatctacattaggaaaatgcacaattctctattgaaacatctataccagtgatggatgacactggcattaaaggctatttgtgttttttacttggaaatgcagacccttgaatatacaggtgatggatctgtttgcatccgtgggcatcctgctttaaggaaacatacagggaactggaagggttcctcattagccatcggttagtgctgaaaaatgatgttgcattgtcaagcttctgcttgaagatatagtaggatatttgatgctaaatactcgaacatctgaaactgatttcatttcccagcatttatatatattacagtattattatgatttatgaatattctttcctcctgtgtttgggttctgtttaattttatactggaccttttatggttcattttttattgcagttttttcattctgctcttatctggcctttacttcaattgtaaaaaacctagtcagttatctcacaaaagttctacatgaaacaaacgtggccgctgcaagagatgttgcaacttggtcaggaacaagttatcttgcacctctggttggagccttcttagctgattcatatctggggaagtactgtacaattctgatcttctgcacgatcttcattatcgtaagtgacagtatgaactaatgcacgtttgtatatcatctaaaataacgattataatcctttttttttggaagtaaacactgtaagagatgatcccaattcctacgtccactcagtgagcaaaaatttgtatcctcagtgaacaatagtatgaaattcagatggacgaatggcagtattaaactctagtttatacagttaatcttcagatgtaagaggagtgatgcattcaacacttgacaaacttttatagacatgattgtttacattttcctttatatcatttttctagacatgaccgtttacattttcctttataccatttttctagaaatggtcgttcacatttttttcctttatccttttatttagggattgatgatgttgcttctgtcagcagcagttccattaatctctactggtcctcactcatggatcatatggacagatccagtctcttctcagaacatcatattctttgtcggtttgtacatggttgctttagggtatggtgcacagtgcccctgcatatcatcatttggtgctgatcaatttgatgacactgatgaaaatgagagaacaaaaaagagttcttttttcaattggacctatttcgtagccaatgcgggctcattgatctcggggactgttattgtgtgggtgcaagatcacaaaggttggatctggggttttaccatttctgcactatttgtgtatttaggttttggtacttttatctttggctcctctatgtatagatttcagaaacctggaggaagccctcttgcgagaatatgccaggttgttgttgctgctattcacaaacgcgataaagatttgccatgtgattcctcagttctttatgagtttctggggcagagttcagcaatcgaaggcagccgaaaattggagcatacaactggacttaagtaatacactatgttgacattacaactttgatgcctatattctatgcttttatttatgcttgcatttctgttgaactataatttatttcatttctagtaatatgattttgtaagcttgtctttaactcattctagtgtagtgcccatgcgatgcactggtttttatatactacctctattttaagtatatgatgctattgacttttggacatgatgtctgaccattcgtcttattagaaaatttagtgcaaacattcaaaaatataggtcatgcttaaactatcttcaatgataaaacaactcacaacaaaaaaaaatggtactcacatagttttttcaaataagatgaatggtcaaacattagatccaaaaattaacagcgtcgtatattacaaaacactggtagtacatgaatatcatatagcttaattttaaaatttcaaaatgatggcttgaaatataaaactaaattaaattatatcaaccagccatatacttgtgtacaatatgcaaatatttttttaaaaaaatcctacagtaacactttgaataataattttaatattttgggaaactcctctttttagggagtagagatacttaattccagtaaagcatttcattctttcactctttgaaaattcttctgtgggacacatcacacaatacaaatatggaaaaccagttaacattacaagagtttcagcacattgtttataatattctctaaagaaatgtctcttgtgatatcgcttttgaaacaaagtctcccgtaatacacttatttctgctgttcatttatacatactagaagcaaaccttcattgttcatgaacctttgtttgtcaatgcaaagtcggcaaggagctgtccattccatctcagctctatcaagttagccatctatttattttatttctctcaggttctttgatagagctgcaatggtgacaccatctgattttgaatctgatggcctactaaacacatggaagatttgcacagtcactcaagtggaggaactgaagattttgatcaggatgttccccgtttgggcaacgatgatattatttgctgcagttctggacaacatgttttcgacattcatagaacaggggatggtgatggagaaacacatcggctctttcgaaatacctgcggcgtccttccaatccattgatgtcattgctgtccttatactagttccagtctatgaaagagtccttgttccagtgttcagaaaattcactggcagagcaaatggcattactccactgcagcgaatggggatcggcctgttcttttccatgctctccatggtatcagcagcattggtggagagtaatcggttgcggattgcgcaggatgaaggtttggtgcacaggaaggtggctgttccaatgagcatcctgtggcagggaccccagtacttcctgataggcgtgggagaggtgttctcaaacattgggttaactgaatttttctaccaggaatcaccggacgccatgagaagcttatgtctcgcattctcacttgctaacgtttcggcaggaagttacctcagctcgtttatcgtttctcttgtgccagtgttcacagccagagaaggcagtcctggatggatacctgataacttgaacgaagggcatttggatcggttcttctggatgatggctggcttgtgtttcttgaatatgctggcctttgtgttctgtgccatgaggtacaaatgtaagaaggcttcctgaaccttgttaacattagcaatataatggtggtggaaaaggacaattgtgttgcaaaagcatgcacccgttttcatatataaaagtaagaaaatcttgctgcaaagcatgccccgattttcatggtgaacttttgcttgatctggctatgagtagctggcagaatatgaactgttgtctactcatagtcgtctagcttttttcttaatcaaagttttttgtttgaccaagtttataaaaaaaaatagcaacacctactaaattagtttaattaaatttaacattaaatatattttaataatatgtttgttttgtattgaaaatattactatatttttctataaatttggttaaacttaaaatattttaattaagaaaaaagtccgacgacttataatatgaaatggagtatgaaatggaggaagtagatttgaatgtgctgtttaattcactctcagcaaaatacctgaaatttgtatttgaacagttgggtgtatttggtgtatgattcattatcatctcctctatcatttgagatcattaactccttttttttttatacacaaagcgcatatcattgtattgaaattaggaaattggtttcgctcagatacaaactatgtacaaaagataagaaaaggaggtacgagaactgcgcctagcgcagtggacagggtctgaggtggtgcgccctatggcctacgctcgattccccgcgaacacactcactcctctcttagggtgtgtttgaggaggaggggattgaggagattgagaaaatacgcaaaacgaggtgaaacattagctcatgattaattaagtattaactattttaaatttaaaaaatggattaatataattttttaaagcaattttcatatagaaaatttttgcaaaaaacacaccgtttagtagtttgggaagcgtgcgcgcgaaaaacgatgtgcattctcactccctatcacccaaaacgaacgcagccttaatacatatcgatatgaaagccctttcgacatgacgatctctcgcaacacatttttgaatgactgagcacaccatccagacaggtactcccatatcacgccagagtactgccacctctgcaacttcccgcaatgttttgcattggtcattcaagacccaatcatttgtttcgctcttttcaaattgtcaaggcaactaggatgacaaacgcgtcaaatccccgccacattgatgttgtggtttggctttgcctgtcgtctctcttatgctcgcgtttaataatttgtcactggagagaagtgatttcttaactatttatacatacgtggcatgcccacgtggaaagcaacatgaaccccacccgtcagccccttccctcttcttctccacctttggccatcgcatggatacttttatactcacataatcttacaagggtatgaattaatatagccaataaagatgagataatttttttttgtttttttttaagagtgaaagaccaagaacagctatagaggggggggggggggtgaatatagcaattcaaatcttgcccccgaaaatactcatcaagccggatttctcaaaatccttactagaatcgcggctattagagaagccggatctagaaaagaagagagaaaaagaagagaaaaggaattcccgaaactagaggaggaagagaaaaggaattcccgaaactagaagtgaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacggaaactctctcaccgagcatctcaaaatgattaccaaaaggagcgacctccacccttgcatccatctctctatttatagcctaagacccctaagacattgtctcaaatacccctagggcgaaaccctaactcagaacagatctggtccatccattgttccttctactcaaaggaaaagctccagatgattgccacctcatcgatccgaaccctcacatggtcttcttgctgatgaatccgcgtgctctccgtcttgacgaatccaaacttgccacgttgcccagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacgggggttgccgcgtacggtttttccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttggccttgtgaagcctgttgcaaagaccttttcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaaagggatgcaaatgcaaatgcaagaatgctccccctatgtgccaaactccccctttcaccaagatttaaagcaagttttaattttcaataagtgcaaatttctctccccctttgtcaatgatgccatcaagatcaaaagagacaaaaatgcaagataaaaatgagatgaaacttgcaaattttaggttttgagagctttgagagttatctaaaggcatcaaaaggtagacatggatcacatagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataaacaaagcaatgaacccatgctaatgtgctaatgcccagttcataaagagtatcaacatgataacaaagcatagaacatgagcttttaatcttttctcatgacttttatttttatgatttttttttaatttctttaaagacaatagcacaatcgcggcgtccacatgatcttatcagtcagcaagtgatggttgtgccaaacactgccgtctgaccctcaatcaagttttccagctagagttcccatta

SEQ ID NO: 40636 - DNA, 1526 bp, Oryza sativa
gtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacgtagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcgtcatcatcatctgaatcctcatccacaaagatgctttcatctggaacacctgaaatttctggtctagctcctgggctagcctcatcaaaagtgacttcacaagtctccacaattttgttggttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggaaataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaattt

SEQ ID NO: 40637 - DNA, 703 bp, Oryza sativa
gttactaattaactgtactttcccattacaaactgtcaaagcgctggtaggttggtagggcaggcagcctgtgcagcgggtagcaaaagcaggcatcgatcgtacatggcatgcagaaaatttcagccgttctttgtgaaaatccccccaaacaccacaccacccgtccggccgtccgcgctgagaaatcgcgctgcgtctacgtacgctacactgtcgtcgggacttgggatcagaggcaaagccgcaaaggcaaaggaaaaaggaagggacgcggctactggacgcctagaaggctagtagaaccagaaggccaaaaccgggggaggtgcgagctaccaccagtcgaccacgtgtacttgtctccgctgccccggcttgtgcatgttttggtcagtcggtcgccgggaagaaacatccacgtgacggcgtgcgtgtgtacgcccatttttagccttccccaggtgagatcggatatgtatcgtgttgaatttctgcgctggtgcttgcttcgtgccaaggagcaaggatcgaggacttctttagagcaggtacaatagtagactataagctagctgtaaatatattttaagaagataaataaggagagagagaagagtagcgggctacagatttgtagccaattatagcacggactctaagacacaattaggggcggatccagaaacagaaaattagggga

SEQ ID NO: 40638 - DNA, 1178 bp, Oryza sativa
cgtactagcattgcttgggccaatatatggaaaatctgttcattataatgagccacatcatgttgggccgacacagtgaatgagaaaatcccaaacatgaattctaacacattgagggtgtcccctcatatacttttttctctttaaaatttaatgcagatggttatgaaaaaaaaatcaatatagagcatagtagcatctatcccttgattgttatcattatgtcaaaatggagttgctagaaatatgacgccatatgctatttcagccactttgcacagtagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaaacggaagccaggacttggaccattcatcacaggcgcgacttgggaactaggccgaaaccctaaaactcatcgtagccgacttgctcctggaagaactcttcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaattctaagtgagtgcttctcaaacgacacggatgagacagtgcgtctcgtccggtcggagtatgtgcaatgtatcagtctttaggattgcaacaaggttggcacccggccaacagcttttcaaacggccacccgggccaacaacttttcaaacggccacccgggccaacaacttttcaaacggccacccgggcctagctgatcccatcagctacagatttttcaaacatcgaaccccttttcacaacagcaatttcacaagcagtagtcagacaaaactacgctaggaatcacctcacatccgcccttgaccgtgggcacgactattcgaacagttcaatgacctctgcagagggggtacactttacccacacgacattactaacccggatcacccagcccgtggggatcagccacgt

SEQ ID NO: 40639 - DNA, 1559 bp, Oryza sativa
gatgttcaaaggtggcttgccttgctcgagatctggagcttgatcctcgaaattctcgcactgcgggtcttcgggttccggaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcgcgcgcgcgggagggaggagagagagtccggtggaccgggctcaccacgcgcggtcccgggtgggacccgcttgtcagcggctcggctcaccgtgcggagggagtacgtggctcatgcgcgcgggcggggaaaggacgcggtgcacgcgagcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggtggcaaccggcggcgggagaagagggaaacggcgacgaggtcacgagaggtcgattcccggcggtgagagcatctacgcggcttcgggaactcgacgctagcgtcggattgggtggaactacgccgagcgaggccggcgacgagcgggtgctacggagctcgagcggcgacggcggcgaacacacggcgaacgacggcaacggtcggggcggcgccggctaactacggggaggctactcaagctactaccgaaagctagggggaggagatggagcgaggaggaagaacggagagagacatcaccgagaagaggaggggcgatgtgacgagaggccagcggcgcgggagtaatctctccggcctcgggccggggaagaggaaggagagggcacggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaa

SEQ ID NO: 40640 - DNA, 7849 bp, Oryza sativa
tcccgcgcacgcgcgcgcggcgcgcgggcggggcggaggggggagcggggagagaggcgctcggggcggctctcgcacgcgcgagcagcgtgagggcggggaagagagagagagagagagagagagagagcgggagagcgcccggggggagagggagagatgggccggggaagaggggaagatgggccgagcgagattcggcccatcgaccttgggggaggcaaaatagacttttgcggaggaatttgattggaaggaattggattcggagttgaactcgacgatagatcggggattgatatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttcttgctcccaggttgcctcgtcttcggaatgattgctctattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaacctcctcataccacggaggggtgatactcgcatgtatacatgatctcctttttcgaactcaaggtcacgcctccgattgtcagcgtaattcttctgacggctctgtgctgtcttcaaacgttctcggatcagcttaacttgttcttctgctgacttgagtatgtcaggaccgaataccagtgcttcgcccacctcattccagcacaagggagtgcggcactttcttccgaacattgcctcattcggcgacatcttaatgctggcctgataactgttgttgtatgagaactccgcatacggcaaacaacgatcccaagtgccttcgaaatctaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagctaaatctacatacgacatgggtcatgtagagttctgctagtctctttccatcataggtggttttcactggcacgaaatgagctgatttcgtgagtcggtccacgattacccaaacggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaaatatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaattggtgtctttcttctcctgtattctttttattaattcttttatcccttcgtcgtctttctgagcctcccgatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgtagaaaagacatgtgttggtctgtgagggcagtctatgacctatgaaagctatcatatgtaagcgggcccggcctgggggaaggcgggacgttacaaagtggtatcagagccgactctcgcggtttcacgggcgcgtgtgtcgcagttgcgcaggcatggtgcgcatggctggtgtagaccgagagtggttacacagcatggcacatgcgctggcactggacacatggacgtggccaagaaaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgtgcttggtctgtgagggcagtctatgacctatgaaagctatcatatataagcgggacatgtgttggtctgtgccagggttgatcgacgggggcgtcgatcagtgtgcccgggtgcacacgagtgaggacaaagtgtgcagaaaagacatgtgttagtctgtgagggcagtctatgacctatgaaagctatcatatataagcgggcccggcctgggggaaggcgggacgttacaagtagttacacctcatttatgtcccacttacatatgtaattagtatgtaatttttaaatttacatttataattttagtacttacatatgtaattttgagacttacattgtatatacactaaaattacatatgtaatttagggacttacaatgtaaatacatgccgactattttttgatgaaaaatatgacgccataaatatagctacacccatgtcaaaaatcaatttcaaactatatttacaaattaagaaagaaaaatattcaggtgtgaatattaccaaatactagtatcatacattgaatctcttttttatttctcgatacatagtttttttagacttcagattttctatgtggtatatgtatgttgtataaatgctattaaatttttaaatatttttttcgtagctatttgaatgtttattttacaaacgaaagatttcccgagcgattgaaagagttcccttcttcaaataaaagaagagtttcccaaactgatgcccttttgtttcctccggggatactgttgtaaaaaaaatacgaggcacggcaccatgataaattaagggactataataacaataaaatattaaaatatgccgtcataaatttagcaaatccgtaaatgaaataaattgatcttcaatccgttttacagtacaagaataactcagtccttcgagctaacgggtcctcctcccttaacttccattgacaaatctgcagctcttccggacctccccctggctgcccgtcagcggctggatgttccccatgttgaccatggacctggcgaagctcttgaagaaggccttctggctgatggcgaagctgttgacgatcgccgccgtgggcgcgcccggcgtggacaggagctcctggtcggactggaggaagccgcggttcacctcgatgttggcgaagtagttcttgtcgaaggcgtccggcgtggtcgggtccaggtcgttcagcgccgacgagttcccgccccgccgcgggcagctcttcgccagcgcccgccggtagccggcgtccagcgtcgggtccggcttccccgtcccgctgaagttgtacagcctgtccgtcacgaactggcactgcaccctcccgaacgtgtgcgcccctgcccatttacattcattttcacccacaattttcagtttcagttgattgctattccctccgtttcaagttataagacattttaactttgatcaaagtcaaactgctttaagttgtaaaaaaatagtaatatttttaacacaagacaaatttattataaaaatatattcaattattgatttaatgaaactaatttagtattataaatattactatatttatctataaaattaatcaaagtctaacgttttataatctggttcggagggagcagtaggtagcgtcgtacgttatctccctatctgttactctgtttatttacctgagagggcgacgaggtcggtgacgtcgaggccgacggcggcgaacttctgctgaagggtggtgaggttgtcgcgggggctggggaggttattgtcggcgccggtgaggttggccgtggtgccgtcgcgccggccgaggggcacgcgccaccgggggcctccggactgcacgcattgacacacggacattgtgggcgtcatgtggccgtgttggagtaaagtgcggcacgaaaagaagggatttggtgtgggatctcgacgtctggtcgtcgacacagccgatgccacatgatgtgtgcgaggacataatccacgtcgtaccatgtggtctctgttttttggtgctcataggattattatttttttacagacggttaatgttggtgagattatgatctatctgcagcattgcggttcaattatttggcaccgacgtctagctagctttatgtctcgctccagtccagttcccagcccagtcacgggcatattgtaggctgtagcgtcaacctttctactggagataaagctagcacgaactactagcttgccagtacgttaatttgtcactatgctggcgtgaaaagtatgtgaaagaacgtagctaaactgcttcgttggttagcttccaatgaagttgacgtgcgattgttatcgggagataatgacgggtttacgtgcaaagcatatgcacgtatatatatcttcgcgccggcagatcgatttctcgcgagcgtacacataccagttcgacggagatcttggcggcgatggcgaggatgtcggcgcaggagacgacgccggggcaggcctcctcaagtgccgccttgatgtcgtccaccaccgggtacccccgcgccgagttgttgttcggcgtcgcgaacttctccgacacgatgctcgtgctgttgtccagcaggatcgacgcgtcgcaaccctggaaaaaacggaaacgtcgcgtcagacgaacatcctgcgtggcgcggcgtacgagtgcgcgcgtgcacgccggcaatggtgtggcaatagctagctcacctggacgaagcagtcgtggaagtggaggcgggtgaggctggcgaagatgcgggggtcgtcctgccgcgccctcttcagcacgcgccgcacgatccggtgcacgtccgggcacgtcccgtcgtagtacttgtcgcacagctgcgccgacgcgccggccgccgccgcggcgagggccacggccacgaccaggaccgcggcacgaaccgcagccacagcgcccatctctctctctctctctctctctctctccgctgcagccttgagctagtaacgtatgtacactgctcactccgtgacgcacaaatgagaaatgaccaagtgttaagtcggtgtgacgaagaagaaaggaagctggctatatatagacacgcacacgcgatcaattaatctgacatgtgtatgacatatctcgccatgcacaggcttaattgtttaagtatgacaaactaactagcggcacctttgcttgaacccgaaggatatataaccaatcattcgcggaagaatcgaacgtgttaacaacgtagatagctcttcggctatcgcggcgtcgttttcagagtgcaacgcatgcatgcatgctggtgtgcgaacagaaacactgtgctttagaatagtttcccctttgcatatggccttcccttccctgtgcgttcgttgggtgcacctaattctctcgcccgatcgtgtgtgctagtgccaccagattcaggcagtacaacgctgactcccgtttagtttcagtttgttgcaggtgcagcaatgcagcagctaagctgtgatgccttgactgcacggtccctcgctctccccatcactttctgaacgaataattgcagggccaatgaaagtagtagtagctggcaatatttggagccttcttcttccatcgatcgatcagagaggtggtcgttggctcgtttggaggggaatgatttctccggttgagtggttgctgacaactagtgctatatccgtacgtggtaagcatacacaaattaaggacaacgtacctgcttcttccctctgaatattttgtgtacagtatgtagcttgtacagagttctcgtcaaactaaaattaaactcctcaccgacgtttttccatgacattttagcgaatttttcaccctttgtccttctccaaactaaaaatctgcctgtcatattcaggatcatcaaggcatgatttttggccacatcatcagtcactgtatcatgcaccacgtaatgaaaaagtagttgcagtagtagtacgaaaaagctaaacctgattggatgctggagagaaggcgaggcatcgttctcggaacataagtggtcgatgatgagattaggtggcagatcgatccagaaatgcaaagtcaaaaatctaaaagtttctttgcaacggagtcgttagcattcattccggttttttccttgcttgttcaaggagctgcatcattcagttcggaggacgtacccgagcacctactgataaaaccatatggcagttgcatattctttcttttactctgatagacacagcgcgtttgtctgtgctctaataattggtgatacacccactgaaaatgcagctgcagattcgtgtaggacgagcaactttgcatgctaattgcttattctactcgtgcattggagagagaatcctagatagcttgaacaaaacgaaacatgtagcgctccacaacacattaaaaacgacagattcacacttgagtccaagaagacgatatagcttctggcaaatccaagatggggtcatggcagatgcaaaaaatctttgcctttttgctcatcagttgacggccctgcagttcttgcgaatctggccggcagagccggtgagagggctgatgttgcccatcttgaccatggagttgccgaagtcgcaggagaagcgctggccgttggcgctgtaggcctgcaccagcgccttggtggcggcgacggcggggtcgccggagctggagacgaggccctggtcggaggcgaggaggcccttgttggccagcaggttctggtagtagtggttgtcgaacgcgtcggcggagttgacgtccagcgccgccagctggtcagcgccgccgcggcacacctgctgcaggctggacgccagcgacgagtccagcgtcgggtcgacggagttggtcgccgagaagttcgccagccggttgctgaacagcaggcagcgagatcgcccgatcgtgtgcgcccctgttcaggttcagaagagttcagatcagtcttggattgattcgtagccaaacataactatattttgaaacggagggagtaacaaattggtgcagaaactagtttttgatctgacaaatgctaaatcatgcataatccacgtaaactgctatgcatgccacaccga

SEQ ID NO: 40641 - DNA, 2346 bp, Oryza sativa
ttcagtgttgtcactgtgtcagctcatatcatatggaattatggatatcaattctttttggacaaaggttagacctcgtgcatgaatggcagagtaaatgggcggctagtgagagatcgatgtgtcgtcgtcagcttccataactggtaatcagttttccatatggctgcatgcatggcgatgggtcattggacgctaggacccttttcagcgtttctgaatctctgactctgaagaagtgtgtgatcttctgcaagcttgcatcgctcaactcaagtagataagccgctataatctaatagaatagtgtagcagcgtaaatctgtagtgaagctgcacttagcacgcctcctaattcccagtgctcgtgttatctatctgaaatgaaaaccccaagtggttcgtagtggagcaccaacttaatcaaatcaaatgatcaagtgctgtaaatgcatgcatccatgtatatgcatgcgtctcggtgttaattaggcagcgtctatttgcaacgtgtggcacgattagttgattgggacgaatggtatggggacattgtttatcagcctgcagactttgcgacgatgtgatctgactgaatctgccaatcaaatctgtagacgagtagcagtgtgtagtgctactgctgctagctgcatgtattgataaaagaaaaagaaaacattttccacaaccgattacatctcgtgtgttgagtcttacttggaaatttctaggcggttgctgtatctcgcagaaatataacttttttgttcagattttaaaaagttgtaattcataaaatgaattaaaagctataaacctatttttaaattttttttaaattgactacgaaccaattactcctctaaacatgctcttggaatagtctctcccatcagaaagataagcatcgtgacatcatatcactaaatcagttagtgcgcacgattggttggtgcagtgcatgcatgtacgacgacagtaaagaacaccacaagtcggctagcctccactaggccaggcccgcatagacgaacggcccatgtaaggtctgggtaaggctgaactgtaaacagttttgggcttttgatgggtaagagttgtcctggacgtcaggtcgaatgggctaggtcggttcaggcctgatgcactaccaggccctcccaatcccggcccgttttcgctgtgaaatttattgattaccaagtttttgtaaaatttgtatcaagttttaagttggactttaaaaagtacagcaacgctagctcatgcgtttaaagcttacactgcaagtgttagccttctagattgccaaaatatttctcaatccatacatgtaagaaaaaattacgttacgaagtactccctctacctcaatttgatcgtcatctaaatttttgatattttttaaatgatcatctaacaaaatacttatttgttatttgtgcaaagagtaaatttgcatcgcgaaatgccctaaatgcattcaactaatcaatattattttctattggtttaacccatgcaatatttaaagtgttaattaatttttgttgaacacgacgggacaccttgattgatgaggattaatatcagaatgatggatgttttggtgccttttgcttatgggataatcaaattgggatggagagagtacaaaccaaatcgatcacataagcacaaaacaaatactgcaaatgcggaagacacatatttcacatttgtgtggttaatattgcaacaatcaaaatatctatgttgaaatcatttttttcacaaatattagggtgccttctaacctggttaagatgaaaattaagtgtagacacacaaaacaagaaaaccattagcgcataatttattgagttttaattatttcaaactaaaaaaatcatttgaattttaaatcaacatcaacttctatatataatttttttacacgaaatatatcgtttagcggtttaaaaaacgagctaacgaaaaccgaggtaaattatgtcaatcataatattggaactaaaactatgagtctatgacaactctcttaaaaaaaaaactagaactaaacagcttctttaatttgaaagcaagcaaggagagaattggagaatgacacttctgcaagttaggagtaaaattataatggtatggttccaaattactttttttttcctgtcctctcctcgtctctctctccccaacctactctcttctcctgcagtccagctctcggttccttgctcctccaagtctccgtcggatccatcctcccctaccccgcgaaaccctagcctcccgagcccctcgccgccggcggatggcgacggcttgatcggccctggacac

SEQ ID NO: 40642 - DNA, 1676 bp, Oryza sativa
tctgttcccctgctggggtttcatggatttcttttttagtgaacttttttttttggtgtcccttttgcagcggatattgacctggccaccatcacggatcggatggaggtgaagagagcggtgcaatcagggaatgttcaggaggccatcgagaagattaacgatcttaatcccacggttcgattccattacttactctagcaatttttgtgccacctcgaaatctcgaatgttgaactgcctttggtggtgacggtggaggggcagcaatggtgttgcagaattgggttctacctgagataagaatgtcatagtagcctttgttgttgtttagtaatgctagttttggtgcttccctggggtatgagaattggacaacgagaaggatggttgtttctttctgaaatttagagggccagctagttttggaatcgagggcaaagtccttgaccttgtccgtgttttctgtgcttggcgtctttcgatgattaatgaatactgtttatttattgtattgtgggaattaagtagagatgatggaccacttgatttgtcaaattggattttgccaactggttatttgttcttgcctcttgtcaataactaggttagtgctcctcttgtcaataactaggttagtgctgtctagttaaacacatgcccaaattttagtttccttttctgggtctaaggattattgtggtgtattttatttgacaagttgtttatattttggaatcatgaagcttattcaattttcaaacatgccaaattttttttattcaattggacggggagaaattggaaaagtgaataaccttgaactatgcgaactattcttccctgttttttttttttttttttttttttttttttttttgctttacatgctagttttctgcgataagtttgggaacatttaacttaattggaactgattttggtgagctcctgacataaatcataaagttcagacttgagcactatagtgttattgttcagagtactgacgtgatccccaaggatctaacatattttcataaatatcctgtaacacattggaacaaaatgtctcttgctctattcaccgttaaaatcttcacagtttcttttttcaatgtcccttttaagttcatcaatccaatgatgttgctccattgactcctcggtaccgaggtgtgtctactgtggtaaatggcagctctgatcatgttatttgggaaaaaaagactcaacagattggtcataaatactttttttagtattttactcctttctttaaacaactcagaaatatctacgggaatccagaaattacatacgtggttgattgacgaactgttcatatcgacagtattggccatcatgtgatgtgcaatcaaatcttctccaagtttgacagtttatgtaccttaaaagagcacctagaagccttgtgaaacaacaccttaaatcaaaagtcattctcttaatgctgtatgttctgctgcgatgaattttgtaaattaacaggaagagttctttaacttctgattcttcatcctgacttaacttcccatgtgcagattctggacacaaatccccaactgtactttcatctgcaacaacagaagctaatagaattgattcgtgcgggaaaaataaatgaagctttggagtttgcacaagaagaactc

SEQ ID NO: 40643 - DNA, 14801 bp, Oryza sativa
aagaaaatgtagttttctcaatatttgctacttcagttctgattcagcagttcaaatcacctaattaaaatgttagagagatttctttgaatagttctgttaacatcacactttgctgtgacttttggttcttttctttttattctgcagcaagtctttcttgaagaaatagagaaaactgtagcacttttggtttttgaagatataaagaactgtccatatggggaactattggatgtttcccaacgattgaagaccgcaagtgaagttaatgctgccattcttacaagccaaagtcatgagaaaggttagcacatgtgctttgatatagtattcatattgagacctaatatcacttggttatgttatcatgtatctacattgcaataccagttttgtgcctataataagttttcattacttaaataaataaagatccacaagtgtaaatcttaatcaggaaatgagaatgcacagaatgtggggtgcctgttctcattttatacattgaaacaaatgaatcacccatttatgtgggattttctgccacgttaaaaacaacaaaggcttaactgaaaatctttcagagactaaccacaaagttactaataatactgacaagaatgggttgaagaaagggcactttgcagtgtggtactaacagatctatctattttgatgattttaagatatagtgatcagatttgcactagatttcagttttgttgctcattgattatattttttttcttttttacaatagagttgaagttgatatactgtttggaacttggaatcaataaaatgctggtccggaatgtgacttttactgaagttattttgtatatgtttcccacataatgcagatccaaagctccctagccttctaaagatgttaatttggactcaaaaccaactggacgaaaaggcagcatatccacgaatcaacaatttctccactgccgcacttgaagatccagcgatttgaggccgctcgggaggggatggctaaagaatgtaggcaccataccatgactgttttcacacattgtacttcctggatctgttgtgctcttcacctgcaaggctgcaacagtgaatccagtgctttcttcggtctttgatctcaaatgcaaaaaacgtggaatcagaaaaaaaaatcgctcgtgttgtacatgatgtagaagatgttcatcacattttaatctgtgaaaaatgttcgatttgatttgagttcattcaacatcttttgtcgaacctttcacttctattacacgaaatgttcttcccagataatactttggctgtttggcaagatgacgctcatcatgttgtccttgcgatttcagaattgcttacgaatttgaaagaaaccaaagtttcactcaaatcgcccagcgaaaaattgtttcactcattggggtattctcccatgagggtcctctgcggtactgctcactgacatgtgagcccctagaccctcgggtccacatgtcagtgacatcagtactgcagaggatcagaattgcttataaaggtacatacctccttatgattgaaatatacttttttttaatggagttatcaaaactaatttttaaggttggaataaggttaaaaactcatctttgttaatattgttgaatttttattttactttaagtacatgtattagtcagctgatatatacctcataattagcaatatgtagtatatatacctccgtatactttctcagaatcagaaaagcttcgtcattatcgatctaaatttattttctaatcaatctagtttctttagcactaaaacaattggaaggatgggagaatacctcttcactcaaatgacttgcttttcgcgcttctggatcaatccctttataggagtttcctgctgtgaccatgcgtagcaatggcgtcgcgctcgcgcgccgtctcctccggcttcacgaaggcgccgaccttctccgtcaccaccgcgtcgcagctccacgacgccatcgaccgcctcctcccgcggctacgcggcgacccgtccctcgcccccgccgcgcgcgcgctcgccgcggcagccaccgcctcgctgccgccctccaccgtcctctccaaccgcctcctccacctgctctcctcccacccagccaccctccccgacgcgctcgcgctcttctcctccatcgcggccccggacatctgctcccacaacaccctcatctccgcgctctctcgctccccgcgccacctcccctccgcgcgggagctgttcgaccgaatgccccagagggatcacttcgcctggtccgccctcgtctcaggttacacccgacacggccagcccgaggccgcgctcgcgctctaccggcggatgcaggaggagccggggaacgatggcgcggacaacgagttcaccgcgtccagcgcgctcgcggcggccgcggccgcacggtgcggccgcgcgggcagggagctgcactgccacgtcgtgaggagagggatcgacgccgccggcggcgacgccgtcctgtggagcgcgctcgcggacatgtacgccaagtgcggccgcgtggacgacgcgaggagggtcttcgaccggatgccggtccgggacgccgtctcctggacggcgatggtggagaggtacttcgacggcggccgcggcggggaagggttcaggctgttcctccacatgctgaggacccgaggtgttcgaccaaacgagttcacctacgcgggggttctgcgcgcctgcgcacagttcgccgtcgagagcttcgggaggcaggtgcacggccggatggcgaagagcggcactggagactctgcttcgcggagagcgcgctcctccgcatgtactccaagtgcggcgacatggggagcgcggtgcgcgtgtttgaggccatggcgaagccggacttggtgtcgtggacggcggtgatctccggctatgcgcagaacgggcagccggaggaggcgctgcgctacttcgacatgttcttgaggtctggaattaagcctgatcatgtcacttttgttggtgttctgtcagcgtgtgctcatgccggcctggtcgacaagggcctcgagatcttccattcgattaaggaacagtattgcattgagcacactgctgatcattacgcttgcgtgatcgatctcctaagccggtcaggccaatttgagcgagcagaaaagatgataggtaatatggcagtgaaacctaacaagttcctatgggcgtccttgcttggtggctgccggattcacaagaatgttggcttggcaaggcgggcagcagaagcattgttcgaaatagaacccgagaatccagcaacttatgtaactctggcaaatatttatgcctcggttggtctttttgatgaggttgaggatgtcagaagaatcatggaatcaaagggtataaccaaaatgccggcctcaagttggattgaagttgggagaagagttcatgtgttcctagttggtgataaatcgcatcctaaagctgatgaaatctatgcacttctgaagaagctgtatgtgaaaatggtggaagaagggtatgtggcggacattgaatttgttctccatgatgtcgaagatgagcagaaggagcaggacattggctaccacagcgagcggcttgctgttgcatttgggatcattgccactccggagggttccccgatcaaggttttcaagaacctgcgcatttgcggggactgccatgctgctattaagctcatatcgcagattgtgcagagagatatcattgttagggactcgaataggttccatcacttcaaggacgggatatgttcttgcagagattactggtgacccgcacactgcatatatgaagtagttttgtctcccgattggagctactattactctttgtacggctaatgttaatatgcggcagcaactgatctgaccaaaggttttcactggttcgagtgattaagttctggaaaagaaattccttgtcaggctgaccctaggtaaacggtctcaccttttatcattcgtgcctatcctgatgaaagtttatgttatgtacgttcgctttattttattaacatatcctgtaaatatgttcattttttgtttgattgttgattgggggttagtaataaagcaatagaattgaaggggtgaaattttgtgatattttaactgatcgtccagcttcacaatttcccattgcctgcacatgatatcttactgaacaaagttgacatatgagtgggtgcaggaacagcatggtgctctcaaatagaaaagggaaaatacatataactctgctacccatggtgactcagtcacctcgattctaaaattttcatctaaaataaatcaccaaatgaactacaaagcaaattcatgagagcgtttagctaaggcatcttaacttacatggtctagtctgtacaatgcattggattcgatgaatgtaaaatctgttattactaacacaaactgaccttaccatgagtacagtcatcatgctttcttgtatctgtatctcattgcacaaccagtgaaaaccagtaaattcacaaagttgatcccagcaatcaatgaaaagaaccgatctaggtggccttcattcaggttatctgggatccatccaggatcccctccttgagttgtaaaatatgacaccaaggttaatatgattgagcttaaatagctccccagtgagactgttacaagcgcaaatgcactacacaaactcctcatggcatcaggggcttcattgtagaagaactcaacctgacctatggcagcaaagacctcagcagcgccaaccaagaaatactgcggtatttgccaaagaatgctcatcggaacagcaacatcctcatgaataagaccttcagatctggcgatccctaaacgcctcaactcaacaagagctgcagatagcattgcaaggatggagagggctaatccgattccaatccgctgtaactcagagaaacccttctcccttccagtgaactttctagctattggcacaagcacacggccataaaacggaatccagatgatgacactgatgacatcaaaagttgagagggatgcaggagggacaatgaaagatccaactcgcttgtcaagaaccattccctgctctatgaacatagaagagttgtgagcatacaccgcgttgaatataatagtagtggcccaaatgggaaacattctgattagaattttcagttcttccacctgggtgacagtgcatagcctccacggatttgtaaaggagtcactcttggcatcatcagatgagatgatggcagccttgtcaaagaatctgtataacaaaaagtaatttcagtcagacaagaaaacacaatatattatattgtctaaaaaagtaaaagaaatgtgtctgtaaagcaagccacctactgacatatattgcttgtgctaccctgatattttcagtcattatacaaatatacctctaatggtcccatattaattataggcaccagtaatagtaattataagtagacttataagaattgcatgccatggacaaactactaatatactactagcgttctgctgtatggccttatccatattctttttgttgcatttagtatttaatttccaccaatcccaaaatggaacagtacaagaaggtagtgtatcagttttatgtatacatccaactgcaaatggctggtgttgtccccatccagactttcctccttttttctttgtaacagaatgaataaaagtgagacaatgatgcattgcaaaaatccaggaattactcaagttcacttgtgtgctccagcttccggcttccctcaatcgctgaagtctggccatcaacctcatataaaagagatgtatcatgtggcacttcagtgtgccacttacggaatgctgcaacaacaacctgacacactcttgtaagagggcttccaccaggtttctgaaatctgtacatatttgaggcaacaaagaaacttgcaatcgctaatgccataaatatagtaggaatggcaaatcctatcccccaacctgagttatcttgtatccaaactataacggtgcctgatacaaatgcaccgatatttatacagaagtaaaaccaattgaagaaggagcccttctttactctgtctgctggatcactgtcatcaaattgatcagctccaaaggatgatacacaaggtttgatgcctccagtcccgagggctatcatatagaggccagagaaaaatacaccatactggagtaagcttgcttctggacaaatagatcctgaacatttaggcggctgcagagctggaactgatgctgacagcgtcaaagcaaccagacccttcagtaaaaaagttcagaaattatccatgtttcagatatgaaattattttgaaaagatcagttcagcacatggtgcaagtgcaccgaagtaggtaatatctaatatcttctatagcaataggcttgtacttacaataaaataaattgctgagaaagcagcaatagtccagtactttccccagtaagaatctgctaggagggcaccaatgaggggtgttaggtagcatgtcccctgccaagttgtaacatttcttgcagcttcaaggttgccttgatgaagatttgttttcagataagtaactaggttctttgcaataccataataggccagtctctcacagcattcatcccctgtcaccaaactagcatttctgaaacttcaaagctactcattgcagaacagataaaaatgtgcacagcatttttcaattgatctgtaaagtatgctatctggtacttcgaccagcatttcttttgtgttgtatatcaccaaaatattttggcaaaaggtaaatacaggattgtacgattcaaaaccatatagaagcattactcactagtgcgaagaaacaaggaattccttcaagtactgtgccaaagttttatgggatatgctatgcatctttaacaaattacctaggatgaaaaaacatgcacgccaatttccagtggcatgctttaatgcagggcgccctttgatatcaacagatccatctccggtgtaaagattagcatcctgctaagaaaaaaaaccatttcagtctgaaccacctaacgagatctgaaaggcaacaagttgcatccctcaaaatgaacaaataaatggaaacaaacaaagagaagtcaaatcaatcttcgaaaggaaaacttcaaaaatttggaattgccacttcagtattttggatgggttgattctctttcttttttttgctggcaaggaagtgaatcaaattaacaacaccatatttgatcagaaaaaaaaaatccaacatcatataatccggagttcaagagatagcaccaaatacataggaggcgcctacaaatcgggcgcccgattttttttttgtctaaaatcgggcattgtttcaccaagtagatcgaaaatgtttcagtaaatagatcgaaaatgtttcaatcttttaaaatactgaaacacaaccaaatcacctcatgaaacattttgctacaacatacttcctccgtttcacaatgtaagtcattctagcattttccacattcatattgatgttaatgaatctagacatatatatctatatagattcattaacatcaatatgaatatgggaactgctacaatgacttacattgtgaaacggagggagtatgaaacaacggtttctaaaaaatcggacgttgtttcaccctatacaaaaacaatgttctagcaaatagcgaaagaatgtttcaattcttaaaaaaaagtgaaacacggtcagatcgctagatgaaacaatttggttcaacgtatgcaacaaacgatttaaagccattgcaacacttaaatcccatgtacatcaacaaaccacgtgtccatcaaaatgaaattattaaacagtattaaaaatccactgcaacatttgatccatacatagtgaaacatcatgagtaaactagctgaaacattgttggtggaacaaaaaatgaaacggatcccccttaatagggcgtttccgttatatccgggcggccgttgcaaccggtgcacgtggtgggggtgcggaggcgcgagcgcggggcgccgatttttttctccccaatcgtgcgcacgacgcggatgattcacgaaatacatgtgttaactgtttagcagaagaaatttgttgctaccctagctttgatcaataatcagcttaatctttcacagaccttcagaagggtgaagtacacctacatacttcagaaccagacaagcaaaacggaacacacacacacacacacacacacagaagacttaatgtcattaacagctttaaggccttatcttacagtctctggtttcagttgtgactcaagagaatcggttcctaaatccccatgcttctattttcctcaagtaaaagaaaacagagccagctaccataaagaggcgaatcaagcgtgacgtactaaccgggataaacagcttatcctgaggggaaaaaacagagaaaatataacatttttacctgaggaagaagaaggagcggttcttgatcaccaccctcttctcgcacctgcaatcgcctatcttctgctgcctcttccatggaggggggggggggggggctcgtcccggggacggaagcagctggagcagatcaagaagctatacaggagcaatggattgcccccatctgagtagagttttgcgaccgcaggggagcaggtggacttcggcacttcggatggatcagagattgaactgatgattggtgaatgcagtaaactactgtcacgttttgcataaaacccctgcattttggttggattttgatttgagagtttttttttttttttttttggaactgggagtgctggttggattaggaaatgcaatatactccctcggttccacattaataaaacgttctgggtttgtgcagtttgatcgtttggtttacagctaataagctgtaaaataacttaatcagcaataaaagataatttaagggtatttatatatatatatatatatgtccttagcaattaaaaaacggaaatgctaaataccggtatcccgttggactcggtcgagacgggacatgttctttcagggatcaccagatatcatagcaccaggtatctgagtacatccccaggccgggcccacttacatctgatagctttcataggtcatagactgccctcgtagaccaacacatgtcttttctgtacactttgtcctcactcgtagtctccaccaacaacagattcttcacgtccccatttctctcattcctttttttcatccatgccatattgtaacacatgtcttttctgcacactttgtgctcactcgtatgcacccgggaagaatttcccggtcggtcacccatcccaaattgctccaggccaagcacgcttcccatcccaaattgctccaggccaagcacgcttaaccctggagttttttggagattggcttccggaaaaaaagttgcaacttattgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcccgtgaaaccgcgagagtcggctctgatacctttgataccattttgtaacgtcccgcctcccccaggccgggcccacttacatctggtagctttcatagatcatagactgccctcacagaccaacacatgtcttttctgcacactttgtcctcactcgtatgcacccgggacccgggaagaatttcccggtcggtcacccatcccaaattgctccagaccaagcacgtttaaccctggagttctttggagattggcttccggaaaagaagttgcaacttgttgatatgagtattctattaatcctattaagccctaggccgggatgttacacatatacatcgatttcctaattttgattttcctttctccatttttgcgatttctaggtttcgttgaatccctaacctgtggatgcgactcctcatatctcatccaaaattgaaatcgaagtaatctaaaactccccatttttgtgtgtatttgttcattcacatggggtgtttgcaacagaggcgaggatgtgtgtgtatatatgctaaatcatatgatacttgcagcaaaatgttaaaatcatttggatttttgctttgaaatgatgtgattctttggttcaactgatctaatattcatcattaaaatgatattttctttattctttcaccttttcaataatctcttgttacatctccaattaacaaaatcagttgatttagccaatgaaacctgcaggaaaccactgtacatctcctaaagtatcacctatgaaacctgatgataccggacatgatactaaagaggatcatgatacctccccgatttcataagatcctactcaagtatcatctgtgaaatccacaggaaactactgtaccagacatgatactagacatgatcatgtgatacttcacaagtatcacatataatgatactttgaggatcatatatcatgatacctgggtaggatcatgtgatacttcacaggtatcacacgaacctactaaagtatcatctgtgaaacccacaaggatcatgttaccagacatgttacctaagtaagatcatgcgatactacacagatatcacacataatgatacttatcacatgatcctcctagggtatcaactgtggaaacctaatgataccggacatgatacagaggaagatcatgatcctcctagggtatcaactataagttttatactgtctatagaagcatttcatggataacttatcaataatttacctgtagtctattgcatctctgtaccactagcttcaacacttgtttctgacttctttttaccgcctgaattattgaggaaataattcagcgcttctctatacatctactatttgttgtcacaactgactcactagccacaaacacactagcagaacgtgtacacaaaggggattcactcgggggggcatcacttttttttattctccctgggcatcaaaagaaatcgcacaaaacagggagcaatgttccatcagacatttcctcgaatacattgcatgcacaaaatagctataacagagaagtggcttcagaattcttacacagggtagtcggcgttgaaacgcaggctgatgttgagctcacatcacacttgtagcagaatcaattgaggaggtaggagcaaaggagctgacgaaatcaactgaaattgctggattgtagaggaaatcgcagacggcatgtgtgccggcagaatcaaccgaggaatcgctgagttgtagaggaaatcgacagacggcgtgtgcaacggtgaaatgaaccgaggaatcgcgcacggaggcgcgcgattccgaggaggattcgctaggatgcggaggaaaaactgggggcaacgctcgcaccggcggaaggaagcgcggaggtgcgtgattccgaggaggattcgccgagatgcagaggagccggcggacgatgctcgcctcggtggaaggaagcgagaaatcgcgtgcgattctgaggaggtttcgctgggatgcgtacaagccggcggatggcaatcactggtcgttctccttttttttgcaacgctcgcatgtggtgatactgtagtttcagaatcatcccgtttttgaacgggatttcggtatgtagcagccccttaaaaaaatactaaaaaaacccttaaaatcactccaaaattaagtttgattaaacgtatttgcgttgaaatattttgattaaaccgagttcaagaagctcaaactcaagaagctcaccggcgacgcatggtggcctgatgggcaatctgtcacaggatgcaagttggcacttctgattagtcatattcagtcaaatccaaataaaatacctatactagccaagcacgtgtaacgtgccaaatatcctttcagtttcagcaaacagtacacatggtttatttattctgatttctgacaggaaaacaaacagatcaattatgtctgcaatagaaaatgtttggaggggaacaacatgctttcatatgaaaataaactgactagcaaaagcaagaagaagattgttttttttcccattctccaagtaatattatgtaccagtaccactgaggagaatcaatgtacatatacaagagattattcagtattttttgagataaaatatatacatacaatttgctgtacaataaattcctttgtccaagtaatattgctctatgaaggctgacattaaattgcagctgctttcttgcacttgtattgctgtgcatagtagacgaaaagaagaagattcagaaaactaaggccagctatgagccagaaaaagcggtcaagatggccttcattcaagttatcagggatccaacccggattatcatctcgagttgtaaaatatgaaaccagggtcagtatgaatgaactaagatagcttccaagcgacaccgtaacaagagcgaaagcggagcacaagcttctcatggaatctggagactggttgtagaagaactcggcttggccaatggctgtgaacacctcaccaataccaaccaacaagtattgaggcgcttgccaaagaatgctcatgggaacaggtaccttactatggatcagatcttctgaccttgcaatctccagacgcttaatctcaaccaatgctgcagttgccactgcagtagtagccacaaacagaccaattcccattcgttgaagctccgagaagcctctctctttaccagtcagtctacttgctatcggcacaacgaaagtttcgtagattgggacccaaacaacaatgctgataacatccaaggatgacagagtggctggcggaattttaaaggattcaatttgattgttgagggccatcccttgttctataaacattgatgaattttgagcacatacagtgaagaacacaatgccagttgcccagattggaaacatcctcattaatattttaagctcttcaacctgtgtgatagtgcaaagtctccaaggatcatgagaaccaccacgttcattcgacaaaatgacggcagctttgtcaaggaaactgtgaagaaaagataacatattaagtaagagtgcatctcagtctgtgcatctgcactaccgatacacaaatcttgtgttacattacctgtcatgactctgaaaaaaggtcattgtgtccaggaagttccaagacacaaacttgcaagatgtgaatgtccgactcagaccaaaataacatatttgtgtccatgccgactttgttacataataacactttttagactaaattaattttatgtactttttcaaaaagtatttttttaatctagtaatctaaactacatgtcaccatttggttgttttctccccatttctttgaaaattgggtaggaactctggcattcagttaagaatgagatgcacaatcaagtcaattttagcatttgaacccatttgaacccgggtggatggggaggttaaacaacctcctcatagcatttgtttctttaaggaatagtaccatgttaatgaagcaaatataccaaggtggccaagaaaaatacctgaattcactactatgttccagcttacgactcccctcaattgcagaagtcttaccatgaagctcataaagaacagaactatcaaccggcaaatcaacatttctcttgtggatggctgcaataaccacctggcatactcttataagggggcttcctccaggtatctgatatctatatctctgagaacctataaaaaaacttccaatagctaaggcaatgaagatagtaggaattccaaatccaattccatatccacagttttgttgtacccaaataagaactgtgccagatatcaaagaaccgatgtttatagcaaaataaaaccaattgaagaaagcacccttctttgttctctcaactggatcagtgtcatcaaattgatcagcaccaaaggatgaaacacatggcttaatacctccagaccctaaagcaatcatgtatagtccaacaaagtatatcagatactgaggcacggttggttgtggacaaaaggacccaaaacattgaggaggttgaagagaaggaaccaatgctgaaaatgtcaatgctgccatccccttcaattaaattgacattgaggagccgttagcacatgttatcaacagaaatgagtgtgtaaataatataacagattcacaacctggacaagtaggttttcaattgatgtatcatgccagtatgtatcaagctggtgattgctaaggtcaccattatgcatgtgatcataatattattatgagataagctttatgtctgccctcattttccctgtttatagttaaccttccattcatgaataaactacaatgcagaaaacatctactataattatttggcgcttaattcactagcacatgcatagccaatacaagtgaaccaatgaaaaagacaaaattatatgatatctctcccagtatgaaaatttctcaatatatgcatgtatttgcatcttaccagaaagtaaattgttgagaaaacagcaatagtcttgtactttccccagtatgagtctgctaaggttgctccaataagtggcgtgagataacaagttccttgccaagttgtgagttccttgctgcagagacatttccttcatgcaatcttgtcgataggt

SEQ ID NO: 40644 - DNA, 1659 bp, Oryza sativa
gtgagcatgccctccaattgcccgtttcatgcttcaaaataggttgaccactgaagcctacagatccatcgcctgtgtagtcatcaacatcctacggagagaagcaaagtactagttgattctaaattattcatgtttttgtcaaacatgtttaacgcatttcactccatcagtttcaatcaatcttcaaacccatccaaaaagaaatcaaaacttaaaagttacaggtcaaagtaaccatcagatttttcaaggaaatgacatcagagtgcagacaatcaatcaaatttcacagagaaaataacttccacaagtaatttgtacgtgtcaatccaataaatcctcaaaattgttgcgtgttccagcataatacccaaggtgcatcaaggctctaagcagtacatcaaaaaatgattgtctttatgagcgggaccctgtggcctgtgggcctcacctgtcagtcatcactgcgcctctagagtctagaccttcaccttccccgttcccctttctctactcacggccatcgttttgcaaccgactaatcgaagtgtcacacgccaatctgaccaagctctacgcgatcccaagaatccaagaactgagcaatcgagctgtccatcattttccccctcccttttctcacgatttctttgctaggccttttctcacgatccgggccaatttaagcattttcaatcgatcggaacataaccaaaacaagaaactaaagaggattgggaaaccctacgaatcctcgaatcttggtggaacaaagaggggaaaaaagaagtttattctttttcgtgtggatattgtgggagtacctccggctctgtcgtccgcactatcaagctctgctgctccgcctccagcgacgaccccatgaatgcaccttttgcagctcggaagggttgctgcaccctccacgaagaaaggtgttcagctttgaactgcttctttggcaactcctgctgcaaaaggactccctccatattttaatgcataacgtcgttgactttttaaccaacatttaatcattcgttttattcaaaatttttatacaaatataaaaatatttatatcatacttaaagaatatttgatgatgaatcaagtcacaataaaaataaatgataattacataaagtttttgaataagatggatggtcaaacgttggataaaaagtcaacagcatcatacattaaaatatgaagttagtaggaataatcccagaggccagaacgcgagagcttgagacgttaaagaaacaggcttatcatttgagttttatgaaggggcctttcctccaacatgataggacccaattaaaattggtcgccatctctcatatgtatctctttgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggctt

SEQ ID NO: 40645 - DNA, 1079 bp, Oryza sativa
gtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttact

SEQ ID NO: 40646 - DNA, 11407 bp, Oryza sativa
ccagaactgatggccacagcaaaaatctaagggcatttacattgatggctctcagtctaggccaaagttttccacacatgaagatccatcagaagatagcttcccacttccttttacactatgctccactatctcgctgcatccttcaatcgcaatcttttgataaaggacaaaaactacgaaaataaattccgtagtagttcttcaccaaaaggaagagatttcataaggaatcaccgagaaggaagagcaaagagtaatgaaagaaatgagattttacacttcctccggtcttcaaattcggtgtggttaaagcaagagtagtcatcatcgagccaaataactgttttttgctactctgatgctcacaaaatagctgaaagtaggggataaaatgttatataagtgttggacctacgagaaaatgcgagaatctactggaagaagccgcatgtccagaggtccccataatttatcttgcatctcttcagaaaagaaagcttcaggtccacttaatggtgaccgaagtgacttatctttaaagctagaagagtgcaccacaaataagtaacgaaacaataaaaatattatcttttttattccaaggctgaataaaaatgtgtctctaggttttggctccattcctgacgaacgcaattccatatactcaaaagataaacggcacaagtacaggagaaacgcgctggctagctagcctgcttataaacatgctaccactatccatagcatcaagaaaggaacgaatatgttgtatggctggataaaagtaaagtaagatgatttggtgagaagtttgtagcttacttgcggcagatcatcttgtcctggttgtacttgcgggcaagcgcctgaagcgacggctcgatgataccgccacggagcctgaggacgaggtggagggtggactccttctggatgttgtagtcagccagggtgcgtccgtcctccagctgcttcccggcgaagatcagccgctgctggtccggcgggattcctgccgacacaaacccccatgagctaccgccgcaaagccacagatgaaggaggaggaacaacaagaagaagagggtgtagtgggtgcgtaccctccttgtcctggatcttagccttgacattgtcgatggtgtcgctgctctccacctcgagggtgatggtcttcccagtcagggtcttcacgaagatttgcatcttggcgccctagctgctgcttcttcttcttccccggggctctctcccctttgtctctctagctccttgctgctgcggcggcggggggagaggaggctggatgttcgccgatttatacggtgcgagctagggtttggtctgaagaggaggggagcgtggagtgtaagacgggcagccgaaatggtccgcacaatccgagggaatagttggcccagctgcgcctctagttagtgggccgggcaagttcttgccgaggtagatgatgatggaataagttcccctaccatccctcaactttacgtcgagtctgtggtgtccctaatctccaatatcagaaatcttcaccccttaaatgttcaaaaccgtgtaaaataggtctcatatcagtatatatgggtgttttcactgacatggcatcccagttagcaatctagacccacatgtaagggagacgaataaaaatgtggggtatgcatcccttctttcttctcttttctcttttctcttctcttttctttctcttcgccgtagagaaggatgtggaagcgggtggcggcaagaccacaagagtctagagcgagtaggcagagcaacgcgcccgcgtggagcggagcaggggcgccagcggcagagaagagagcgactgcgggcgagcgcggcagcgggcggcggcgagcggcttgctccgctcaccgctccgccagctggcttcgcctgcttcatcctcgcaactacctcaccgccggccatgccattctcctacgttgctatggcctctagctctgcgtcctcttctcgcaagccggttcccatcgccacagccagcgcccatcgattagttccattgccggcagcggcggcggtcgtggcggcacctacgccctcgccgtcaaacctagcacggtctccgagaccccttctcgtacttctccggggaagatacctatctcaccgcctccgatctggtggccgcttccgtcatctcctcccacctctccgttgtgggggatggcgccgacctctccaaggtcgggatcttcctcaactccacggcgcggcaccgctctgtaaatggcatatgggctctgtaatttttttattccttctttgctgactaggcggatgccatgtcagcaaaaccacccatatataatgctatgggacctatgctatgggacctattttgtacggctttgaacatttgagaggtgaagatttctggtatttgagattagggacctcggactgactcaacgtgaagttgagggacaataatgaacttatcctatcttactataaagttataacccactaattctaaagctcaacatgcaaagatgtcacatcataatacattaacaatatatcacatcatcatccattaacaattattacatttaaacatcatacaagcatgttatcttatctataattttataatttattaaattttagagtttaaaaatgtaaacatgttaaatcatcactccaaataattcacataatatttcaatatatatcttcatcatttatgataatatcatatatacctatatggtacatcctcacttagttagtgttatttctctcttctcccattaaatcatatcacatcaattatttttagccttaaatgattaatctatggtccaaactatctcactccctttattctcttataatacttcaatatcttacttttacatttgaatcgtctatatactatttaaatttaaattatcataaaccatatcaacttatgtaagtatatgttgttagccatcttacatattatttttacttattgttatcatactgaaatcccgcagcaacgcgccgggtttcacctagttccgtagatgattggtcactaaaaaaaattaggaaatgccttttttttttcttcaagaagtaaacgttcttgtactagttagatgcttagtttgagttgattttttcagttatacagactcataagaaagtacgtgaagatcccttctaatcatcagactaattctatgtcacgaaaattacttatagcagtaagaatccaagaccagttcatcaactggtaaatactggagcagttggaggcctgaagaaggtgcaaggcaaaacacctgacaagccaaatgttgcacgcttttgaaattatctaatgcgtgtgtgcagagtataatactaaaaggtttactgtttgtactaataataatacaataaactaacaattcagcgatttctggccgacgagttgctctctcgagtaatcacctctatctggtcacgatcaagaaattagaccccttctgtcacatcagcagatcagctcaagtgctcaaccactacacaagtacacgatcaagtaggcaagtagtacgcgttggcgttggagggagtccacacatcattgcacgaaaaagcggcgtctgcaactaccgtagccggaacatgtcaaacctcgttcgagccctggtatataaatacacccggcgacgccatgtccgctccacgaacaacgcaacaccaagcttagctaatctcacagtcaccgagctgaggtagctggcgagatagatatagctagcacagagagcaaaaatttcctagcgagatcactttaattcgccggcgtgcatggcggcggcggcttcggtggtggtgttgtgcgcgctggtcgtcctcgcggcggcggggggcgcgagcgcttggccggtgatgagcccgtcgtactacgaggcgtcgtgcccaagcgtgtacgacatcgtgcggcgcgtcgtccaggaggcgcgctgcaccgacccgcgcgcccccgccagcctcctccgcctccacttccacgactgcttcgtcaatgtgcgtacagtgtgtcctaggttgcgtgccatgcatggcgtttgcgtgacatatttgagctgggattaacgtgtttgtgtgtgcaggggtgtgacgggtcgctgctgctcgacgacttcggcgcgatgcagagcgagaagaacgcgcccccgaacaaagggtcggcgcgtgggttcgacgtggtggacggcatcaaggctgccctggagaacgcctgccccggcgtcgtctcctgcgccgacatcctcgccctcgccgccgagatctccgtcgagctggtcagtccatgcacgcacccatgccatcaaacattcaatcacgccgaaccatatagtatctgtggatcgctgacacgtacgctttcttgtcgagcagtcaggagggccgagctggaacgtgatgctggggaggagggacggcacggcggcgaacttcgagggcgccagagacctccccggaccgacggacgatctggacctcctgagacggaaattctccgaattcaacctcgacgacaccgacttcgtcgctctccagggcgcgcacaccatcgggagggcgcagtgcaggttcttccacgaccggctctacaacatcagcggcacggagcagccggaccagacgctggacatggcctacctcaacgagctccggcagagctgcccggcgagcgaccccgaaagcgcggcgctgcgcaacctcgacccgcccacgccggacgcgttcgacaatagctactacggcaacctcctgcgcaaccgcggcctgctccagtccgaccaggggatgctctccgcgccgggcggcgccgcctcgaccaccgcgcccatcgtcgtgtggttcgccggtagccaggacgacttcttcaggagcttcgcgacggcgatggtcaagatgggcaacatcagcccgctcaccgggagcatgggggagatcaggaggaactgcagggtggtcaaccgcggctgatcatcaggttgatcagcgtctccgtgaaattgtttgttgaaaggaaaccagttgggtggcccgcgcaattgcgcggttagcacctatacaaaattatatatctttaatatgattttatttaaaatttattaaatagttatattgttgttaagactttgaaatttcaaatcttatcatttccatgtttctaattttatattttttattaaaagtcacaccagttgctatctgttacttctgttatatccttctttatttgcttgtccgatctggcactgtttctattcattctatttggagcctttcaaaattagatcttatggtttttagagtttattgtcccgttgggtttcgattttataatttttagaagtcccgtcaaacgctaccattatactcctatacggctcatccactacctcttcttttttattgtcgttgttattttcaaaatagaacataattatcgcttgggttcattttttactttctaagaagttccgccaaaacgtcagcagctttgtcaatgtgctcctctatggctcgcccgttgccttccttctttattgtcattgagattttaaaatcaaacatgaatatcattgaagtttttttttactttttagaagaccgaacttttaaagttggaccttatagtttttataatttattgtctcgttagaattcattttttataattttttgaaatcacgtcaaacgatgccactatattcctgtacgacccgtccgccgcttactctttatattcattgggattctaaaaaccggacataactatcattggaattcattttttaatttctagaagtcacaccaaccatccgcggctttgccattgtactcctgtacaacccgtccactgcctcttcattttattatcattgagatttaaaaaatcaaatatgattatcattggttttttttttactttatagaagtcccgccaaccaccttaaccggttgcttcacggcctgcccgtcatccttccttttgttaatagtttttagatgtcccatcaaccaccatcactctactcctttataggcctattacttaaataatctcgtcatatgttttagatgatctttgtctttcaatagtctttattttttatcaccaattttagttatttataaattgtattcctagttaaatcttatttttctttttctaatttcataatttatttttattttttatttcgaattttaactaatattgtattgtgttcttttaatatttatttcagtcttcttaaaatggaaaattggaaccatgccattataattttgtaaaatttgagatatgccatcatgacccacatgtcattgactcatatgggtcctatatgtcattgagataccgatgacatatctcaaactttgcaaaattataatggcatgattccaatttacttttaaaattgtattcatacttgaattatatttttaatttgtctagtttcagattttattttatttttcattccgaattttaattaatctcgtattgggttcttatatgtactcttatttcaatatttcatatatctaattctaaattttagttaattttaaattgtattcctagttgaactcttctttttttttctagttttgatttttttattttttttctgaattttaattaatctcgtattgggtttttatatggactcttcttccaatattgcttaattttaattctaaattttagttatttttaaattatatttctactcaaactcttctttctttttttttctaattttggatttcatttttttattatgaatattaattaatctcgtattggattattatatggactctttttttcaatagtacttatttttaattccgaatttcagttatttttaaattgtatttctagttggactctccttttcttttttttcgattaatgttagaatttctagcctccatagcaaacgcgatacctccttttaaagctgtttttaataatatagttatttttaaattgtatttctactcgaactcttctttcgttttttcaaatttcggatttattttattttttattctgaatattaattaatcttgtattgggttcttatacgaactctcttttcaaccgtacttatttttaattccgaatttcagttatttcgaatttctagttggactctccttttctttttctccgattaatgtggaaatttctagcccccacagcgaacatggtgcctcctttcaatttgtttagtaatataatagattgcacatgtgttttatgttttaatttcgtttagttatttcttttctatgaagattgaaatgtacacgtgaattaataattagctacgcaaaaaggtaaaaatgaatagcttctatcaaaagagaaatggtttgacagatactttctaagacgaagtaacgacggaattaagcacaaaaggataattaatcatgcattcaaggcgcaatggcacaacatgcaaaaacactcgtgcatacagccatcaaatttcttgtctagtacaaacatccagcagcataaatagcacaagtcattgcataaaactatgttaaactcaaacgctgaacacagccggagaagacgtttacatggaggtcaaagtttgttgttgggtaagtatatgtcgctcgaacgactatgctaacgaagttacaggccagcagatgaaatgctgtttcagcttcttcagatttttcttttcttaactaaaacggcaacaccaaggctacataagagctactacaacacttgaatacaaattgggtcggttttacacttctacgaatgaccatcatgcttcccaagctcgctaggcgggggtaagagaagtgcaaggcgctgcttgtatctttcaatccgtcggagccgctccttttgcaaactgccaaagaaatttatgtcaaagtggaacacaacactcagtaactctgtctaatgaagataacattctcaaacagccattcctcaactaatgttttcaatctgccgtctatcaaaatgacaacctaaaacctctccactacaccacataaaagggcgttaagttagctaacttaatatctccacccagcaatataagtttgattgagcttgcgattaaggtgttaatatatgttatataaactgactacaccaaaacaatcaacatgacaacatcacactacatattttcatttgtcttgtgaaacactttcataatatatcttcttaccatttttgctagtgcatcattattgtttcgttggatacctgaagaatcaagctggacttacatattggaagcaaaagccaatcatcactattgcatcaccatattttgaacttacttgctcacttcacaaatcatacgtaaaagggctggaagatgaaaacaaatacatacccagcacggatcttttttgcacgcttcacatgctgcttcagcaagtcacttgcagtatattcaccggtttcattctgcacagaagatcaaagccaatggtttttgagctaatatagtaacactgcgattatagatgtaaaaaactatgcttgtggtgatagaaaagataatagaaggaaatagtaacaatagctacaaagtggtcagtaacagaagtcacaagcaagtagctctccccaagaatatcaatttacagacgaaaaagggactcctttatcccttcagtctcaagaactttttgggatactacatttctatggcaaggttgaaatgaacccggatttctcaaacatgttggatgaaaccgtcacctaatacctaatattattgaaggttgtaactgggaagcaaatctaactattttgggagcaaatggaacacatgggcaaataatggaccaagacaactgcaaataagcaagagtgggatatgcaggacataagatagacaatatacttcattttaaataacagggtaaagcgtaaaattcagagttggtatgtgcaactcctaagaaatacagcaatttttgcatgtattagtcataatattagttataaaaggcatacacgcttacatgccaaaaatcagaaaatgccagtatgatccagaattgcctggaaagaatataactaagtgttatgctgtacgatgaattagcataactaaaatgctagattcattgaatcaaagatcaaaacttcaaagttagttttttacaagataccttctcttcctctgagttctctttctcagcatcattgtccttttctgatatcctagagtccacgactgaagcaggcagtggtcttggaagaattggtgcaccagttccaaagcttggctgcaagaactagtaagacaagtgcatggatagcatgatgcacatacaaaatatggactatgaactgcagatattcacatattaagagccaaaaggggaattccttgtggtggtggtggaggggagtaaagtgacaggagccttgcctgtctattagtacaaaggaaagaagaaagcatgcagtgcaaaacaactcacattgtctctacaggagacatcgctccactaggcaattacattttataggacaattcaatccatacaaagtgcacctggcaaaattctcacaagtttgaagcttgttgatgttaaaccaaactttaaataacagagagcaaatgtgtgtccgttcaaagtagtaagaggaaaattcaggcatacaacataatcaatcaagttgtagtcctagaattgcatttataaattataactgagaagaaatacactttagagtaactctagaaattataagaccaccagaatgacaattgaggcgtgtaagaacctgttaggatctagtttaacataactatagagaaattttcacatggcaagtgcccaaatcattcatttgtaacgagtgagcatgctaacctgactttcatgtggaactccattacgcacccatgatcgacaaagtgcatacaaggatcctgactcactatccatcaagttaacctttggaacaataaaaagaaatgtcagtttgtgctgtccacttgatctgtcgggataaaacaaggtatagattatattgtgaggttcctcatatgtgggccaattatatttagaaattagaatttcagcctcgtagcccaagtatctacaaaaccatttggataattaagaaaatgaattgtgaaatagaagcaatttgcatttgcatgaacagaaaaaataaggtgtgaagagccgtacgttttaaatttctttggtaaatgttaaaccaaacaaaatcatgtttatcataggagctgaaatagtgtcactaatcagagcaaagaaaaagaatttgtatcatataaaacgtctaaggtgagccataactggtatcccaaagattcatgataatgggcaaaagtgattgggcatgttccaactatccaaaggtacaggtattctcctcatctagccaatgtatttgcattaacacagcgcaaatgttctagaaaaaagtttaagaaacataaacttactttacggtcattaataaccactgttgtagagtcctccttgctcctttcactacaaataaacaatcaaaattgacagttgggaagtctaagtccaaaagataaaacactatagtttgtaactatatcccctcaaaagaaaaagataacacactacagtttgtagttttcttacctatcttttgagttgttgatctcttgaggagatggagttacagctggtagtggaatgacctaagaaagatgccagaaaagcataatttaagggaacttcaaaattcacaatatttaagtccagaatttatcaataaggaatagcctaattaacacagcacccaaaatagaccagcaccatttataatcaaaataacaataaaaaaacccatgaattcgtgtcttcgcttttacaagatctaaatccagtacggaaccattcacatgggcctaatttacctcagaagtagcattgtgctattaccaaatataagttcactaagcaattcaacatgcacatgaaacgtagcatgcccaacaggtaataagttccaaaatctaccataaatcgccaccgaaatctacaagtagcgtttaattaaaaagctctagagagtagaacgttcaagacttcaagttctcgtctagttccccttccttgcaaagctcgcagactaaaattagtcactaaccttgggctgtgcttgctgagctatagggactcctcggggaggctgctcggggcgcgacgacacacctgccaccaccgccctcggggcggcggggaacgaccggccatgcgtgggcgccaggggatgctgcggctgcactatgggcaccgcgacggcgtgggcgcgagg

SEQ ID NO: 40647 - DNA, 1000 bp, Oryza sativa
aaacttcctgataaatggtgcaaggactgagttcataaggcactgaaaggtggagggtgcattcgtgagaccaaatggcataaccctaaactgaaattgcccatgatgtgtcttaaaggctgtcttggcttcatcagtttccaccattcgaatttgatgatacccagctttcaagtccagtttagagaagaatttagtgcctgagagctcatccaataattcatcaacaaccggcataggaaacttacttttaatggtgagagcatttaatcttctgtaatccacacaaaaacgccaactaccatcctttttcttgacaagtaaaacaggtgatgcatagggactcatactaggtgtaattaaaccagcatcaatcatttctttcacctgtttctcaatctcgtctttttgtaacggagaatagcgataaggtctgcagttgacaggagctcaccttcctactgctattcgtttgagagcattggttcacagtaaagtcttgttacttttggtggattctggcagctctcacagctttattgattacaactttttcagtgtcaccattgccggtcatgacactgggataagagggtgagaacttctcaccatcattatttgatgggacatgtcaggctgcacgccgcctgacacaaaagcagcgcacaggcgcactagccagtcccatcggttattcgaccggtcacagaccggttgagtacactgcacgccgcacgaccgctcgggtcaccataaatgcgagtaggtgggcacctgtacgtggtgacctagagagggggtcgggggagcccgatccctagtcacgggaaggggccgccgccgcccgacctcgggctcgatcccccctcgggggagggccacatggcgcctggggcagccttctccctctagtcttggccagggagtggccgccaccccacctcaggcctgactccccttgggggagggccatgtggcattggggggcggcctcctccga

SEQ ID NO: 40648 - DNA, 5066 bp, Oryza sativa
  unsure (1)..(5066): unsure at all n locations
nnnnnnnnnnnnnnnnnnnnnnnnnnnnnnnnnnnnnnnnnccagtgtcccaaaaaacacgaatagcagtttccagaacagaaggccaaaaaatgaaagaaagtagaaaggatccacaatgctcataatcggtaatgcatagcagatacaaaagcttgtcacacccaaaaaaaatacgaatatcaatttccagaataaaaggccaaaacaattgaaagatagtacaaaggaaaattaatgcaactaattgtgttaagataattgctccttagacaaacaagtacaagtatgctctggtgttaatattgagttgacttaagtgtaaaaagaatcaaattaatttaattaatattttgctaaactgtacacagcataataacataacaaataaagaagtttttttacacaaacaattacttcgaaaggaattactgacccaggaaatagccgagctgctgtccgaaatgcagccattgcttgatcaccctcctcctgtgcagcataagcaataccagtaccaatccaagcaggaggaaatgtcccatctaaccctgtagctttgctgataggaaatatattagtgcaaaacatattacagctacttaaaattgaacaagaatacaaggtataagaagttgtaagagggttaaacccatccatgattaaattcaatgaacaatgagcattgaacaaataagaaacaaaataacctgcaacctttggactggtataactgagacacatgtcttaagaaaatatatattgtttatttgaacttggactctggagaattattggacagatatgtttcaccttacaaaccatctgacagactgatactacatgagtagaacctactcatttctgtctttttatcacattgttctatcattccagacaactaaaaatatttaacaaagaaatatattgtttgttataagaaatcaatcagtcagttggatatgcgtagatttcaggaggcaatggcacctatggacactgttctctccatcagatggtaacactattgtagcacacatgttataccatgtctgccatgttttcatgacaaaagtgttgccttacgcaggaacatggttgtgatttgcagtgcagaggatattcactaatcacaccctattttattttacatcccaacatcgaaggcacagcaggattatcttctaagctatcctaaggcaaaaatgcatagtgaaggttcaaataaaaataatacagtagaaattaagagaagaatatgcttacccaaagtatctgcgtgcttgatcatacttcttaatacagtagtaataacacccaacagcaaaccaggaaagagctctacagatggaaccacagctgacattaaaataatatactttgtttgctcatgtctgactacaaacaatcaagtgtactttagtattatgtccctccaactattggagtctatataaccaacatgaagggggggggggggggtcaatctcttcttgttcatcacataaataaaggtcagttaacatattttaccccaatcccgatgctattaaaggctagattttacaagttgcattaaagtttgcagaaagatgaataatgtgcacaacactgtcattatatctaagattgttacatgcaaatgaaagggggaaaagcccatctagcaggataacaaatattatgtgggtctgaatgtgggcaggccagtgggaatactcacttctgaggatagtccttcactagattgcaggccaaaatataaaggtcatttgaatggccaagctccattgcagctgccaaatgaactaacgtgcatttcaaatgaaaagggtccctttcaagtaacctgaggcacatatagcatcacaagaatgataaaccaatattgatcaaggaaacatatgtaccgacaatgaatcatttaccaacttacgcagatgtgagttcgaaacatttttggtactctccactctgatgatagtattcagctttgcaagccaacacgtcaatattatttttcagtgtcagtcctgaactcaaagatgaaatactacaagattctcgttcaaattccttgaactttgcttccactatatattctttttcatgctaaagccataaaacaaaacaaaccatgatcaaaagaaatataagtgaatgcagatacacatattgtttattaaattgcaaagcaatgcagttaataagtcgtgtaccttccttatcaaacaagagtagaatgctgagagccacccatcttcttttccaaattttagagaggacaatagctcagattctgatatcattgcataacaataagtaccaagaacaaagagaggattgaaggtccaacattaagcatatcttcttaaaactagtccagtaataacaataaacattgtattatttaaaagaaatatcctaagaggatggacatgacagatgggaagattgattttgtaaaacttaccttcctcgcatgtcaacatgtagttatcaacaaggcattcaagggcctgccatgtacagacataagaagttaggaatgaactaactggggttaccacagaggcccaattccatgttagcatctggatgccaaattccatatttagtagaaccaaaaatacaaaataatggtggttcatgtaattgaaaaggtattgtactaaagagtcacatgattcttctcacctcatagcacaaaggatcagccttcactgcagctttgtacctgagataacagcagaacaaagccataaaaccatcttaaccaagctatttggccagatatgcccaaaaaaaaacactgattagacaatcctgcttaaatcttaatttcaaacaaagaaaattagcagtacttccaggtagcaacagttatttcaactattagcagtgtgtcctcgttttacaagaaaaactcattttctttatatcttctaaagagtatcgaataacccaacattctcagtgaagatattgagtaaaaggtgtaagagaagaaagacttcaaaataactgcatcgtcattcaccagaaccactgaatacactcaattagacaaaaaatgaaatgatgctttaccattgtcgagcaaggtcacagttgtccagtgcttcgtatgccttgccacgtaaaaaacatattgccgctttgatctggcaagcaaatattactatcaatcaccatactaagagagagagagagaggcatggggaagagaaagaagagtcaacacacattgatctcatggtcttcagcatccttatcaaagtaaatgtcactgccatcatcctgatcaacaacgtttccatgctcatctatttttgcatctccaagtatgatcaaacactgatgccattctttcaactcctcctaacaaaccaaaacaaaacgatgaaacagtagctaagataaaaggaaagacggtagataaaataaaggactacacaggactgtacaccagagcacaaatcagaaaaatctatactgaatcataatattttctggtatggttcaattttctaaagtaaaatcttagaagtacattaaaaaaatcactaatcctatacagttcttttgatctttcctataagaaaccagatttttgtttcgagtgtcatggatattgattgaataagcagtcaaaatcatatgtgcagtttatatatctgacatatatagaacttaaacaaaattctcatttatctaaaagtccgaagcaggaagcacatattataatcaaccaaactcccagatcagaccagctattaagaaccaagctaagcacccgttcattgatggaatgcccaagtaaaaatattctggtcgagaaaatgcaggtgtatcatgttaattattttgaagcatcagcagagcattggacttgaagccaaaaaaatgaaatcccccagtgcaagccattgggcgcaccttgtgtgaagtaaacgaccctatctcaactcatacagctaaagctaaaagctgatcaagcaaaattttatcgagtgcttgcaaacacacagaatcaaatcgtcaaaaaaactgccaaacaatgcccagagtgaaagaacattgaggccaccatacaaccacaagctgttcataaggaagctcaagcgcagccacgcactggaacattaacaggggcagtgaaactaaaccttctatctacacacagcatgcacccaacatgttcgacaaaatggcagactaaacaagggcgtgggtggggaagctcacgaggcacttggctgcgaggaagcggaagcggaggtcgcggaggagcttggaggagttgaggatgtggagcgcgcggcggaagtggcggcccaggaagagcgcctgcgcgagcatgtagacgtcggcggggtcccccgtggccgcggccaccttgtcggcgaggaagatggcggacgcgtacaggtgcttcccgacgctgtcccgcaccaccccgcgcagccgctccaccgcctcctccctcatctccgccgccacctccccctccgcctccgcctctctcctccgcttgggatttttctgcgctgcggcggcggtggtgggcggcgctgctggagggaaaccgaattttgtatcccacattcgccactagggttcgcggcggagagtggtggtttttggaaatttctcacggggaaaaaaaaatggagtcccgacgcgccgcggatcgcagcaagtgatcgatggatggaacgtgcaagcagtatggcttatgggccacgggcccacggcccacaacatatgcaaacgaaccagaaagcctgtataggagaggacacacgggccaggcccatcatctggccggattcggaatctacctctgtgaaattgcgatcaaaacctacggaaatgtatagatttcgtggtatacaaatgttgattttgccagcttacattgacgttcttcaccttagtcgtccctgtttgaatttacttttctattattattaacacgggagaaacgataatttgaaatgattcctttggaattcctgcaaattcttatgtctatcttacaattgctgcactgttcttctttt

SEQ ID NO: 40649 - DNA, 3728 bp, Oryza sativa
gccgccagggcatcttcgccgtcggctgcgaggtcgccgccgccgcaggagaggaggcacgaggcggtctgggagcagcccagcgtggtcacgatgacgtagctgccgttctcgtacagcttcatgacgtagcactcctcgtcctcgagggtctcgcgcgggacgccgcccacccgtcgcgcaggcgccgccggcgaggccacgggaacggcggcgacgtcgtcggcggcggcggcggtggagggcgcgtcgtcaaagcagttgaggtggcagtagtcccagtagatggggcacctcctgatcaggatcgggttgcgcccggtgcagaggtagcagatgtacatctccgtgtcgtcgccgccagtcgtcgccgtggcggtggcattgccgggcgccgtgttgccgtcgccgcccgtggtggacacggcggcggcggcgaggaggaggagaacttggtaggatgcacggttgatggaagctgctgagagaggcatatcacaaattgatgagagatgatgcgtgcagcctgtctcatttataagggttttttttatggcggggatatttataggtcattttggctgcagctgcattttgacgtcaggagcgtagtagtatgaaattatgattatgttgggagaccaacaaaatctcagtcaatgaatggatactacaatttgactatacgagaataagtgcttacctgtttctgcgtaagagtgctatctgaattctgaagggtggtatcaaatttcaatcgagcaatctgctaattatctcttcccatgtagaggttacatgtttttcttcatcaagataaaccagaaaaatcggttgcatacatatgttattttgtaattaagattcggattgtatctctgtttcgttagcacgcttttaaactattaaacggtatatttcatgcaaaaactttctatatataggttgctttaaaatattaaagatacccatttataaaggctgtaataattatattttaattaatcatgcactaatagttttctcgtttcacgcgcatcaacttaatatttcatcctcatctgaaaaatagctttctagctgtactcattttccagatcaaacgtctagggtatacatttcctattttcctctgtacaaattttctaacaaggttcatactcatgaatacccggtacatatccctttcaaaaaaaaaacatagtacatgcacgtagactacgcatatcgctatgaacagcaaacaaatgtagtgcaaatcagtagtggaatagtgatttactaattcagctgttcagcaactacgcgctccggcggtggatggtactatttgtcagcggtggacacggttaattagcaagcccaggaagcaatggattctgtttgaaagtggtgagcaacaagcaaagtgtgttgtgctgccgcagccatttaccaaaaaacaaaccaccgaaacggcaggttgggacgtttttagccatagaacgaggagacttctcgtgttgctgccgcaagccgcaagatcgatccgatcagtaagaaattaaacggctgtgaatttatcccaagaacacacactcgtaatttggttaacagagacagatcgtagtttgcaaatatgagctggttgattcttccacattaactactacttcctgaaaaaaaattgtgaaacctaaagtgttactcgtattattatttttatttgttttgcttgcttgaatttcttttggttttctctctaccatactgcctatatatttatgcacagattgacacgaggtttagtgctatgtccaacgttacattcgtcggatcggatcatcaaacggcacgtacgcgttgtcgacatgggctcgcggacggcggcacccgggcacggctagcgctggtcgccgcaccgctcgaactcggtcaggccgcgcggcagcgggctaccgatggcggccggggtgatctcgccggaagcggcgcccgacgacgacgacgacggcagcgcgtcgccgtagctgcacacgaggtagcatcccgcggacgcctggcagctgaccacgtcgacgacgacccagctgccgtcagggtacaccttcatgacgtagcagtcgtcgtggcccccgccccggccgttgtcgccgccatcgtcgtcggcggcggaaaaaggcagcgcgcgcggcggagacgaggaggaggagcgcgacgccgacgacggcgacgagaggcaggcgatgtggcactcgtccttgtcgagggggcaccagctgatcatcagcgtgttgcgcccgcggcagaggtagcagatgtactgctgctcctcctccgtcgtcgccgtcgatagcggcgaggagcggccgcggcgcgccatcacggttgcgttggcggcggccgccgtggcattggtgccacgagccacgacggcggacgtggctggcctggcggccgccgtgcctaccaagaggacggcggcgacggcgaaggagtaaaaggagaagatggaagccgagaaagccattggcaaataataattgaaggcgtgtgcgcggtgacactgacacacgcagcgcgtggcttatataggatggtatttaggtggagagattagtactatggtcatgtttggaaaataggtttgggatatgatttcccacacctcaaaggataagtcttaatcttagctatccatcattctcaccatatttcatcctatcgcttcattcatttccgtttcctaattccacctctcctaacctattttccaaacaccctatagtactaaattagcgagaagattggatgtccttgagctttactgcagaggagtatatgcaaagaagttatcatgggttttaaaatttaatcatttcctcccaataaaactttgtcagtgatatgggcccggggttatcatgtttagagggaggaggctgccccccccccaaaatgccacatggccctcccccaaggggagtcaggcccgaggtggggtggcggccactccttcccaaatactagtcggaggaggccgccccccaatgccacgtggccctcccccaaggagagtcaggcccgaggtgggatggcggccactccctggccgagactagagggaaaaggctgccccaggcgccacgtggccctcccccgaggggggatcgagcccgaggtcgggcggcggcggccacctcccgtgactaggggtcgggctcccccgaccacctctctaggtcaccacgtacaggtgcccacctacccgcatttatggcgacccgagcggtcgcgccacgccggcgtgcagtgtactcaaccggtctgtgaccggtcgaataaccgatggaactggctagtgcacctgtgcgctgctcgtgtgttaggcggcgtgcagcctgacatgtcccatcaaataatgatggtgagaggttctcatcctcttatcccagccggagtcggtcctcccgctctggtcaaagctaggctcccgttccccgatgtaataggagcccagaagtcttcacccattaaatggtgaatgacatgggcgtccctcgtgtcaggcggcatggtgtggtaggccccacgaccgaggcgacgtggatgcggcttccaagttaaggaacaagacatgcatttaatgcaaagatggtaatacttctcgaggaagttagttgttgggcctatgtggtatccccttgaactataaaggaggaccttgcccactgagaaaagggacgatg

SEQ ID NO: 40650 - DNA, 1924 bp, Oryza sativa
ttgcggcccagcctcaccgaaaggtaccacggtagcatcaacccctccgagtccctccagatccacacgacgatcatagaggcggcgtggggtgacgaccgggtcaaggcgagtttcttccccatggcccttcatggccaagcgcggggatcgctcatgaacctgccacctgcctcggtctactcctgagaggactcttgcagttgagctccgggtgtcgtcgaagcccgggaccccctgtgctggctcttccatagcggctagttttggtcccgccggctggctacggtgctcggcccggctcaactaatcgtcctttcaagcttcaagtattttcattttttcaattcatcagcttaatacagcttgaagtcttatatttattttcccccgttcttttctcatggccatatgacgctcgcgtgttgcgcatttgtttgctccctcggtggtaaaagcccaacctctctcccatctacatgaatgtttcctcgctaggtgtgggggctaagttttctagccctattctagccttaagttgagtgtcgggtgccgtcgaagcccgggaccccctgtgctggctcttccgtagcggctagctttggtcccaccggttggctacggtgcccggcctggctcaactgtggacggggatcgctggctctagagtttttcggctctcacacacgggcgaaagtagtcgtccgtgtagaaggaagagatattgaaaggaggccaccgaaaggaaagatcaaacagaatgtgtagcgtggggacacaggcttgtgggaacctaacctcgtttgctaagtggtcgcaggcttcccaaagtggttagggacccatggagggaggccctcttcaagctaaaggtttgaaaggtcgcgacatgcaagcaaggtttgtgtttgcttcattcatacaaacgattctttgctaaaagtatgggggctacgattcctagctctatcctagccctgcgtcgagctttgggcgccgtcgacgtctgggtccccctgtgctggctcttccgtagcggctggttttggccccgtcggctggctacagcgcccagcttggcttgatcgtgggtgaagattgttggctatggaaaatttagtcctcgcactcgcgcaaagatgatcatttgcatagaattattattgcttatgtttatctctcgcccatctcttcctcgcggtcccgcggtacccacgtgtcgcgcgctggcttgcctcccttggtaacaaaaagtttgtattcacctcatccattcaaacgattctttgctagaagtgtgggagctatgattcctagctctatcctagccctgcgtcgagctctggtcgccgtcgacgcctggggtcccctgtgctggctcttccatagcagctagttttggccccaccagctggctacggcgcccagcctggcttgatcgcgggtaaagattgttgactatggaaagttcagtccccacgctcacgcaaaaataatcgttttgaatagatgaagtataacacgaacagaggttaacaagaggcaggggcaagcaaggtacgcggcgtaaggtcacgggcccgagagagtctaacaacatttgctgagtatatacaggaaataagttcacgacctaaggtatgggctaaactcccgagcccgcagtgcctcggagaccgggaggaaagtgggaagttaaggcgacgtatgaacgtgactaaactcccaccgcccaactcccagaatgataggacagaagatcgggcccgcatgtcaactgactagcagattggtgtcaaccctgatcacctgggaaaggttttggccagggctaacgccgggggctactgtcggtgatatgagcccgggggtatcatgtttagagggaggaggctggggtggcggccactccttcccaaagact

SEQ ID NO: 40651 - DNA, 2273 bp, Oryza sativa
gctcagcttgcttttgatcagttgaagacagctatgagtaacactccaatgttagctttgcccaattttcagcttccttttactttggagactgatgcatgtgcttatggtcttggtgctgttttaagtcagcagggtcaccctattgcttattatagcaaaactttgggccctgttaatcagaaattgtccatttacgaaaaagagtttctagctattatgatggctgtggataagtggagatgttatctgcagagaggtccatttatcattaaaacatatcacaaaatcttgtgtcatttggatgatcaaatattggggactgaattacagcaaaaggcaatgactaaattgatgggtttgcaatattcttttcaatacaagagaggggttaataatattgttgctgatgctttatctagaatgccttcctcctctcaattttgtgctttttctgtggtccaaccgatctggattcaggagatgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggattaagaaattatttgcttggcctggtctcaagttggatgttgaaaattttgtgaagcaatgtcaggtttgccaacaggccaaacatgaacactgtcggcttcctggactgttagctcctctcccaattccaaaagaggcctggcaggacatctccatggattttattgaaggtttaccgcgctctgatggctataatgcaattttggtggtggtggatcgttttactaagtatgcgaatttcattcctttgcgtcatccattcactgcatcacaagtggctcatctggtggacaaaactgtatttaaaactcatggcatccctcgttctattgtgtctgatcgtgatcgtctctttactagcaagttctggacaactctttttgctacttgggacactcaattacagatgagcacagcatatcacccgcaaacagatggccaaatagagcgtgtcaatcagtgtttggaaatgtatttacgatgcatgactcaggctaaccctaagaagtggagccattggattcatttggcagaattttggtacaatacaaattatcatacatatcttggctgttctcctcataaggctctttttggggtggatcctcattattctcaagttcctgatctgacattggctactctgcctgatgtggtggatgttcagactgaaaggcagcacttgtctgaatttttacagcagcagttaactcgagcccagctgcgcatgaagaacaaggttgataaaggtcgttctgaccgtgtttttgctgtgggtgatgctgttttcttgaagttacagccttatgctcagtcctcagtagttaatagaccatatcctaagttggcttataagttctttggcccttttactgttttggagcgcattggagtggcggcttatcgtttggatctacctgccagcagcactgtgcatccggtgtttcatgtttctcaactcaaagctcaggtgccagatcatactcctgtttatacttctttgccatcccaagtggttcttgatgctgctgacgttgttcctgaggcgattttggagcgtcgactagtgaagcgcagcaatgcagctcatgtccaggtgttgctgaaatggtcttcattaccagcagatcatgctacttgggaggactatcatgttgtgaagactcgctttccagatgctccagcttggggacaagctgaaactcctgcgggcggcactgtcatgaccggcaatggtgacactgagaaagaggtttaactgtgaatgatagtgtgtgtgttttgggctagactttatcaaatagaatgcggcctgtgtgccttaaatcgtttgggccaacagcccatgtaatcaggagataaatactcgagagagagaatggctgtggccaacctggcaaaagaaatcgaatctatctctctccaaactctgtctctcctctgcctcagctctgtttctcttcgtccccaactccgatctcgtctaaatatatatatctctctctctcgtcggcggcgagtttcgcggtggcgtagtgttacacccagccggagtcggtcctccca

SEQ ID NO: 40652 - DNA, 7908 bp, Oryza sativa
atcgtctttgggggattgaacgccctcaagatcacacagcttcgctcaccaaaccctcgaatctcacccgctgcccccggccgaactcacaaagggggtctcacggttccctgatggaggagtttatctccgacaaacttcatggacatatatctatatttaaactacaataaactactatccaaatacactgagaaaaataaaagcatataaagttcctatgaagaaaaaaaaatcaaaaccttaaattggcggatccaaatttcaaacatttatttttcaccgttggatacttggatggtactagttaactcacgcaaagacctacttttccgataaccaattcctgttacgggtaggtggtgcataccctggttaaatattcatgcatatgaccttttttttttcaattatacggtagagtacgtgcacacaacactatacacatatttttatgggagtatccacaggtttgtccatgatgcacactaaaaagagcgagaccagcgacacatctttggtgtcactaaatttttgttgaaattatacttgtattattgagcacatcaaattttaatcctagtgggtgaaatcatacatttacaactacaccaccatactgttagtgcttacttacatgcatatgaaattcccaaatggatttatcaggtaatttgggaaatatccgtatagttaaaatatcttatattataggacggggtagtacctaaccttcaaatgtacacaagttaccgatccaatttctaatatatttttattgttgtatcccttattaaataaaaatatgtgtattgcattttcttaaatctgttaaagttccccgcaaaaaaaaatctgttaaagttaattaaaaaggaatctccatgaatttctaagagaaaaataaaaaaaatacaatccttgcatagttggctcatactacgtattaattattaaccctcgcagggttttatcgaagggagaaattttctttcaggtattatcaccttacgtgcagctattatagcgtgttaaagttcatggtgtcatcattgttggaaaagacatcaaaactagttacagaagtactcagagttatgagaaaaatcgtatggttttagtgcaaaattgtttcattttgtgtcaagtttagacttgcagtagatggttcattcgaagagtcgtatgagccttactgaagtggaagccgagctttcccccaacggcaagagtccaactgtccaagagcaatcaggaaactgcaccggcagattagtaccatccgattccgattctgatccgagcttacttctccttattggaatcggatacggatccattcctggcccaggagccattgcccggtctataaatatacagtactactccggaagaccccgcaagagcagcaaactcaaggaagccgacgcgacgcgacccgaccgatcaaggagattgcggagatgggcaaacgacggtcgcgatcggaatcggatgctgaccaccgcagcggtgcgtgcgccggcggagaggccaagcggccgcggccggagcagaagcatctctacctggcgctggacgactgggagaaagggtacaatctctacaaggttgacgtccacgcgatcggctccgcggacacggaggccgagtcgcaactgcccgagcctcccgtgctccagctcgaggccgccaagggcgcacgcgacgtgctgttcgccgccgtcggcaccgacatcctcgccctgtggcagccgaggtacgagacgacgcgcaccgccgtgtacgacacggccacggggcggctggacgccgccggccctcgccacccgagggcgctgcagcccatgcgcttcgtcgtcgcgtcgtccgccggcgcccgcgggctgtacgcgctgcacgggggcggcatgcacttcctggagcgccgcggcggcggcgaggcgacgaccgagccgcggtggacgtggagcacggcctgctcgtcgctgcgcctgccgttcgacggcatgcagcccggctcgccgcgccgcaccatgcaaataacctcgtacgccatgcatcccgacgggcgcaccgtcttcgtgtccgccacgagtggcaagcaccacggcacgttctcctcctccctcgacgacgacgacgacaacgagtggacgcgccgcggcgactggctgctgccgttccatggccagggccactacgacgccaagctgcgcgcatgggtcggcctccactcgccagggcacgtgtgcacctgcgacgtcccgtccaccaccttcagtagtgtggcggcggcgacgtcgcagccgccggcgtggcagctggtgaacgcggagcacctcttccaggaggatcatccggagcgcggcggcacgtcgctggtgtccacgggcgacgccgagttctgcatcgtggagtccgtgacgccgaaatggatggatccggtgtgggatcgcgacgagatcgacgagtacgtgctccgtgtcaccaggtttcgtctcaagcacgaccggcacggacagctccgtgcttcgtccaggtgtcgccgcgcttcctacagggtgcgcaagcatgactctgtctttgcgccgcaagcgttctggatgtaatcgtgttacactagttactaaacttactactacttgtaaattgtaagaagtccaaactttctcaatcacgaaaaaaaaaagaagaaaagaaaatgtctcgttcgtgaaaaaaccttgaacgacaccacatccgggatcagggagatgaacagcaggtggaaaattgcttgcctgcctcgcttacgagccgtgagttgtgacttgtgacttgtgaccgtgcgtgacgacgacagaggctgacaggcaatttgtggacgagcactgctacacgtgctttttttttaaaaaaaaagaactcttataaacaatgatgtttgatttaagtatataaaaattatagcaaatgcagatatactcatagtgttagtaatagataataagagtttagtaagacgaaattgtatagacttttccttcatggacctaaaccgccaggcccatgggcctcagcttctggagtctggaccagcgtaacacattgaacaaaacggaaagacagaaaataaacaaacaaacttgaaaagaacgaaaaaaataaaaataattgaacaaggaagatgaaaattatacgagaaaaaagagtagaagttttggagcattcccttgtcataaaatttagagacttttaggagaaaaaaaaattccatccaatctaccaaaccccatctcataccatccaaaatggtcgtatccaactaacaaaaacaaatttacatatcctatatacttatgcaattcatccccactaagttattttcctgcttcctggtgcagccacgtcacttcagaaggagaaccgccagatcagttttctacgccacgcacgcttgatccttgaacagacgcatatgctctccttcctgccggtgaacccaatcagccgactccttccatctccatgttgtcccctgagcttcctactgccgctgtcgttcgacctcccagcagttgcttgacgttctttctcctttgtaatggccgacttatatatcttctaccggctttccatcttattgagtctgtttattgctcaccttaattctatatatatatatatgatcctttgaagtctgaacaagccaattgccaatgcagcatatcgggcattctcgtggtctcatggcaactatacattgaccagttctttcaccttgcaagtgaactcctagcccattattccagcaagtctgacttggaagtcattggaaacaaaacaaggttcctccgatttatcttgctcgatattagtacataaattggccttttttttaaccactcgcacgagacggtgtgaacttctattgatagagcaggtaaaaattacaagattacaaccttggaaggtctaaccaggaaaaaggaaaaaaatataccaccacccacacaccgacagcgccaacacacaagcccgggagaaggcaagcaccggaccgatcgccgctagaccaacaaaggaacatagacgagatcaccccctaggggatgccaaaacgacgtctccaagaagagaagtgacgggagaaccaccgccgccgccgtccgtcaaggttcaaaggagccaagactaggctttcgcctggcaaccacctttgaggggtgagacagcacgacaacaccctcaggagggggaacatcgttgccggtccggccaaggccgggctaggttttcacccgctgctcaccacatgcaaatctacagctggtgtcccgatgctccaccactgctcaagctctgccgacatgtggcacacctgcaccgccgccccccgccgaccagccttcgtgcgcggaagaccgcgccacacccaccggcagctcctcctcataccgaggtcgcctcctccaccgccggccacgcctctcgcgccaagccggcctccatctccgccgctcgcgccgagccggcctccactgccatcggctacgcctctctgcgccaagccggtctccgacccctcctccaaacgatgtcgcgccggctagaagtagccgtctgccacgccctcggctagccgaccgaagccgtcatgcctccggtgaccgcagacacgatcaccaccaccgctgctgccaaacacccgttgccatccacacctcgcacccgactccttccccgcctcaacctgctgtcgccggcgatcgtctgcacgacgtcgccagccgctgccgcatccagcgacatcagcaccgcctcacagacccgaccgccgcaaaccagccgccgttgccgctgtcgctgtcaccagccaccgacgacagccgccgtctccgcaaaccgccgccaccgccaaagaagccactgcaccgtcgccctccaccaccaaagcagccagcaaccggcccgatgccgccgccatgtcctcagctgccgcagcaaccaccaccggccaccctccagatccggccgagcggcacggatctgaggtacaccgccgacgtcgtcaccgagcaccatgccaccgtcccctccttcgctcccgccaccagcgccaccatgccggcctccgcctgccgtgcaccaccgccaccacgcacgcaccgctgccaccatgccatgccgggttttgccgtcgctggccgagccgccccgccagtgctgcgtcagtcgaagctgccgccgtcgcacgggctccgcgcgcctccgtcggccgcggacttagcctcgcccgccgccgcaccaccgggcgccgcccacgccgttgccaccgaagccggccgctcctccttccccgtcgtcggacgcctccgccgcgcggggagcgcaggggagctagatccggcgtcgccgcacgccggcgagcccgctgccgcggcctctaccccgccgccaacctcgcctcctacgcccacgccgccactacaacctctgccgcaccgccgcctccttcaccccgccaccgactcctccaccccgctgccttcttcacctcgccagccggtcgggcaggccggtgtcgccgtcttcgcgccccagaccgtgtcggtgcccccaccgccgacgggagggagagacgaagccccgccgccgccgtccttgtggccgtgcggctttgccggcggccgctcgggcggcggcgaggcggcagaggcaggagtgggggagcgggcgacggcggcggtggtttctgcctcccgtgtcgcccgtgagggagacgatgcgggggctctctttcgatacgaatgctcaggttacagattaaattggccttaaggccccctttgaatcacaggaatgaaaaaacgggggaataggaaaaacataggattctgataggaatacaagtgtaaaacagaggattgcaaaacacaggaaaaacataggaatgaccgtttgattgagccgcaggaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttcctttgaatcaaagggggcctaagttttgtcgtttcagctcatgccttttctccgtgcttttctgactccatgggcaagatttactatgtccctcactacgtgggaactctgtcatgtggtgtatctgtatttttgttctgtctatcctctacagggttttgatctattacgtgtactctgtttttcactaaaaaatatttcacttacccatgtttaatccccccccctattgtttttctacggatgggcctaataaatgatggtagcagatcttaatttctgggcgtaatatcattttaattaattccaatcaaaggttgttgcacttagaaacccagacttcatctgaagattcgctgctaagctgtttatagaatggagcaactgaaaacgaagaattaaaagggttgttccaagtagttcatcttttaaccttgcaggcacttcatacctcatatacattatttttgtttggtttctaagcccccagtgcatttgttgcttgaatcacagaaaactgatttcttagttcataaaagcactgggtcttcctaggaatatataatctagaatttcaagaggttcagcttccttttttttttgcataacacaattaattcattccttcgagttttacctcgcattaacatttatgttgtactgagaatgcgaattttgttctgtttgcatgctcattgttgctgacttgctgtggacagagtagactgttacatggaaaatggaacacacatactcacttgggcagtagctacaagcaagttaatcgatgtacaattttttctatcctcaatcaggatacattgattggtgataataactacttagctgtagcttcagtagtctccgtagaaaggattggcacttttacatttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcagatcctcatgccgttgcagcttcgcccattggcgtaaccaatgcgtacccctgaatagtacctgcaaaaaagatttcggtccgtaattgtcaaacactaactcgtttcttgttaaccaaactgtccagaaaagcgctgctgctgcagttaacagtaaagtattttgttttttattaccccccttagaccactgttggaataactcaactaagtttgatggggtacttataccaaacaaaatatgaaccgctcgccacaagaacttggcaatatagcaatcaaaaaacaggtgttgaattgactcaggctgatgacagaaagcgcattttaaatcaccatgccaattcctcctagctaaattatctttagtaagaatgacacctttctttaagtaccacaaaaaaatttttatttttgaagggaccttaatttgccaaatatcctgtgaaactctaataccattactgattagtgcagcatacatcgatttgacagtaaaatttcctgaggcctgcaaagaccacacaaacgagtcacccccatcctgtaataatacttcctgtatggaagcaagcactctattccatctactaagattcgctcccaccaaattccgcctaaacgaaa

SEQ ID NO: 40653 - DNA, 1267 bp, Oryza sativa
cccatgagatggatgttttccatcggaaaggcctcaaacactcgatggctttggtagctgatccctctggtagtacttcttctaatgactcagcctttgtgtatggtggcttctctcttgccgctttacactcggtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgatcaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatc

SEQ ID NO: 40654 - DNA, 13280 bp, Oryza sativa
gaagttggatctcgtgggctgccccaagctgagggctctcccaccacagcttggacagcaggccaccaacttgaagaaactctttataagagacacaagatacttgaagacggtggaggacctcccgttcctctctggtggccttcaagttgaaggatgtgaaggactggagagggtctccaaccttccccaagtgagagagctgtttgtaaatgaatgcccgaatttgaggcatgtcgaggagttgggtggtttggagcagctatggctggatgaaggtatgcaggagatctcttcactgtgggtcccaaggcttcaggagcaacaccgccagctccatggagatgagcatgagctggaggtcaccgagtggctctgagacccaattaatttagatggtgcaaggtatgtacactaattgcttgggatttttcactggaataaactaatcattgggttgtacattcatgctgctcctctgctcttcacttgtatatatgcagctattttagcatttgatagtctccttagttgttcatgttgtgtgcattgactgattgtttaatgatttatatgatttagttttattttcatttgtgctacatgtaaccatttcattgtggtcaagattttcataaaatggtggatatcaatcgaaggacttgaggtagttaggaagaatcattttttcacttttggtacacaaactgcataagtaaaggagacatatgggccaagaaataaatatcatttagttcagatgcagaacagtttacttgcatttagccctcaatgacccaagtgtgttttgtatcgagattatgcatgtacataggagacattgaagggagcacatattatcttgtaaaaacaagtagagacgtcaatttttcatgaaatatttcaactgtgtaatatattaggcatatacaacggtcaatttagacttgcaagcgatacaacgcccaattctacagattttcggcctgcagcctgttggcagcaggacattgaacacaaaaggggcagcgcccaacatctgctcctaggccactaaggtttgtttggaaaataaaaagctgcctaaatgcctttgtatttgttccaattgattaatattttagttatatccctaacaaataaaataagcagggtacattgccctgcctacatgcttatgtgtagttcgtatgtggctttttcttagactattttttttcttgatgtctagtaggtttaactccagaaaacatgattgttgcaaaaactgatcacacttgtattttattttccttaactaagttattgaagtaccaaattgcttatatatagcgatgcttaatttgtgtgtgcttgtttattttgtaggttgctaatctcgaagatttgggcagtgcaggcactttcttatttatttgttatctttacctagttaccgatctatggaagatttaagaaatccaaaaaaaaagaaagaaaaagaaaaatccaaaaaaaggtaaaacttagcaaaaaaaaagaaaaaaaacaggggcatttgctttacctcatgaaatgtatttcatttttttttatgatttgtgtgtgtttcttcttcttcttcttcttcttcttcttcttcttcttcttcttcttgtagctgtgtaggtaactccgcctatgtcacttgaggtgtgattttaatgacatagccggtcccaagcccggaaaaggaggaggggataatcttgtatatatacttgtctagtgaaatgatgctgtgctgctaggtggatcattgaaaattttcttgaaatttgctgcattcttgtcaagttatttgtatattcaattattagaggcacatccactctgctgctcgcctgctctattggacaaatttgattctaaactattttagctcaacctcattacaatccagttttcaagtaaaagcaattgaacacatgcaccaattcattctcctcccagtcccctgtttgagagttgagaattgagctactgagatattttcattagtgatatctactgcactgtgcaacctcattacaatcacaggcagaaagatgatatgtctattagtactccttgttctttattttttcactttcatgatgtgtgaccaactgatggtgaaccaattccttctactttcacttttcacttagtggctttcaaaagcatagcccagatgctattgggacatgttacatgtaccgtttcacttcaattcttggttcctgtaaatggtcccttctcctatgccactatggcaccatccactagtaaggacagaagttagctccaagaaaactactagtggtactatgtatttatggagcagtgttgtaatgtcaaagcaagaaaactactagggtgccacttctgtaaatcagtatatgaacttccctactgaaaatgctgaacaactatttgtctgcaacagcgaaagacgcaaggtaggtacttgggtagtgttgtcctatgtcaatgcaagttaataattttatgcttaagaccgattcccccgcgtcgctctcgtgcgggcggctcggggggcgaaaaaaccctagccgccagcgcctccacttcctctccgttgcctcgccggagtcggagcttgccggcggcaagccggcagcaagcacggaaggcggcggcgaggctctccctcttcttggcgtatcccaccccggcgcgacgtggacggggcgcagccgacgaagaccctcaccgcggccagaggtgtgacggtgggatggtgtggggagacggccgccaaggctggatctggccaccccgcgcacggatctagcacggcggcgcgcggtggctgggagcggcggcggcacggcagcccgcagctcggcacggcagcccgtgcaacggcagcgcgacagcccagggcggccgcatgcccgcatggcggccctgcaagtcctcgcttccggggtgccgccacggtgcccttcacgaccaggtgggcggcagggcgcggtagttggacaacggaggcgtcgacgggttgcgccagagccggagtagcagtagcgtcaccgtcgtcggtgcaagcccagatggctgtgtaaagggagctggcggcggtgggtcatcttcctcgttgccggtcggcaccctcgcccttcctggagctcctccccttctttgcggggagtttctaggttggattgaggcggcagctcgtaagcgggggaagctcaggctgccgaagcaatgccacctagtcctgggttctccttcggccaaaactagcgaggcggccggtgggtagtggaacggaggcgtcctaggccagctctcaggggtggtggttcgatgaagtcggccgacggaggggcgtcggtgcggtgtggtggatgctgcgtgctgccatctgtctgtgtgggggttctgagttggtggacggcgatccgcagtcaagggtgtaggtatcaagcgaaagcctagtccggtggttcaccgggctggcagcggctatgtcttcgggcgttgtaacctccttggggcgttgtcgagggttaccctctcctttgctcgacgagcttctctgagtgaaaaccacatcttttttagatgggcgatggcggtatccttggatgtcgtgagcaccgtggtggcatcgttttcaaagcctcgtctgtgtggtgttgccgtaggcctagcggcgttcggccacgcttagcgggggtcgtttggtgctaggcttcaccctagcggtttgtgcttgggtggtagcgcgtggtgtatggcaatgcaccttggtgtattttgatgttttttcttgtaacttttactccttcttaatatacccggttggcctccttcagccttcccggtgaaatttttttttttatgcttcaatactgtaaattttgcacccaaactgcagaaaacatggagatgattccacaagtccacttccgaaggttcctagtagcagtgtgttgcctcatgtcatcatgtatgaatccaccgttctgcattacttctgtccatggccataagcacaaaaaggccacttgcaagcatgcaccactcaagtggaaccaaactggatggcttcagctcatggaattcagcagttgtagatgtaggtttgaagctgaggctacactgcacaacatgtggtactgactgcatgtagaacaggatactgtatatgctcaaacagttggtgaagtaatgggagcaggaatgaatggagggatgataggagtaccagactgacagtgtatctgttaggcaaattgagtcatggactatattgagtctctctgattgtatacagcacatcttgactgaattttgcatctgtaatgattgtctgcaaggctctttctcccccaccatgctgcgaaatgcatgtatatcttcagaaacagaaaacaaaatctttccctccgttatccacctttgtttttttattgaattcatcattctacatttaaacactgaacagaacaacttgtgagtcatcagaattggttcaggacagatgtgatgaccagtgccttagctttcctcatagctgtcccactaaattcttcaaattaaccgtaattttgatgccttcatatggtctgcaggggatgttaaccagtgctcttcttcgatacttgaaccttcctaatttttcacactgtattctgttctactagcaatgccttcccttccctgattcatagctcgagttgttgtctcaaactgatttctgtacagtgtacacataattctaggtaaaattataagggccatcagagattaatagcagttgagagtagctgatggaggtgtaatatggctcttgtattgtatctgaagagcagtgtggcttgtcagaagtactctaattgcacttccagtttcacacacttatctcttatcaacgtttcacctgatggcatttgatcactacagtatgttcatagacgttcaattctgacgcttaaaagttcactccccaaatcttcaacctctcatggactattaaattagaatctagcttagtgttcattcttgtactcttcacttattcagtatttcagttcactagttcagtgctctagtttcatctcaaccatttcgattttcgggtacaaattattcttcccatgcatgagtgacgcacaaaacaatcaacggtgtttggcgtttcatctaacctgagcgacgagaagggaaaggaacggcgacgacttggggtaggttcttcgagtcttctgcaggcttagggtctttccatctcctctttcagatcgaacaagttcagcgggtaccaagtgcgaatttgcagaggcatcccaatcgatagaggatgagttcgtcagtctgttccaatttgtttgtctgtagcattcacagattcagatcagataatatcatcaaggtaccacagtacctggtgcaaacctgagaaatttgcagagggattgtaaagtccaaactggaagaaaggtttccaagaagattgagttgttaaatgttcagtttgttcttgtttgtttgtctgtagaattcaaaaattcagattatgtcctgaccttgacttaaaatatacaaatgtactaaaattcagattagttctcctttgcaatggattgggctagcactatttggggattgagaagcactctaaaaatatgctttactgaacttgacgatcccatgtcagacgcttgccgatgttctgtaagctatgctgttctgcacacaacttatttattcagatgacagaattcagttttatactcgctccgtcccattttaagtgcagttgcggatttccatgtacaacgtttgaacatccgtcttatttgaaaaatttataaaaaaaattataaaatttataaatttggtggtacatctggacagccagaacatgaggagcagcggtgccgccccatgtaaagtttgtagctctaaacttgatttgaccttttcagaacgggtatataaggttatattcagtttaaaaactagctgggtggcccgcgcaattgcacggctagcatccaaacaaaatcatatattttttagtatgtttttacttaaaatttattaaatagctatctcattgttttaagactttaaaagaccaaaccttactatcctcgtgtttctgattatatagtttttaaaagtcacaccagttgctaccctttatgtcatctccttctttatttgcttgctcgatttaccactatttttattcattcttcttggaacctttataaattggattttatagttttagagtttattgtcacgttgggtttcgtttttataatttctagatgtcccatcaaatgttgccattatactcctctatggcccgtccagtgtttcttctctttattgtcattgagattttaaaagttgaacataattatcgtttgggttcatttttactttctagaagtcctaccaaatcatcagcggctttgccattgtactcctctacggcttgtccgctgcctcccttctttattgtcattgagattttaaaatcgaacctaattatcattgggtttttttactttttggaagttccaaacctttaaaaattggacttgtaattttattttttttataatttttagaagttccatcaaacgatgccactatgcctctctacagttcgtccatcgcctactctttattgtcattataattctaaaaatcgaacataactattgttggaattcattttttattttctagaagtcccgtcaatcgtcagcggttctgcaactatactcttatacaccccgcccgctgcttctcctttttattgtcattgagattttaaaaatcgaatatgattatcaatagggtttttttttactttctagaagtcccagcatctgctttacttgtttgcttcacggcctgcctagcgtccctccttttaatcgtcattagaattctattttgtgttttattaacaatttttatatgtcatatcaaccgccaccactctactcctttataggtatgttacttaatttatctcgtcatgtgttttagatggtcttttctttcaatagcctttatttttatcacaaactttagttatttataaattgtattcctaattgaaatcttatttttctttttctaatttcagaatttattttttttaaaaaattagttaataccgtattgtgttcttttaatggttttatttttttattttcaatttcagttgtttcaaaattgtattcctacttgaactctcttttaatttttctaattttgatattattttattttttattcgaaattttaattaatttgtattgggttcttatatggattcttctttcaatattgcttatttttaattccgaatttcagctaattttaaattgtattcctacttgaactcttcttttattttatttttctaatttcagatttatttttatttttattctgaattttaattaatctcatattgggttcttatatgaactcttcatattcttacttagactctcgtttccttttctaattttgtattttattttatttttatttcgaattttgattattctcatattgggttcttatatggaaacttctttcaatattgcttatttttaattccgaatttcagctatttttagattatattcctacttggactcttgtttccttttctaattttggattttattttatttttatttcgaattttgattaatctcgtattgggttcttatatggaaacttctttcaatattgcttatttttaattccgaattttagctaattttagattgtattcctatttggactctcctttccttttctaattttggattttattttatttttatttcgaatttcgattaatctcgtattgggttcttatatggaaactttttttaatattgcttatttttaattccgaatttcagctatttttagattgtatgcctacttggacttttcttttcttttttttctttttctccgattaatgtgggaatttctagcctccacagcgaatgtggtgcctccttttcgaggtgtcttaataatataatagatagatgattcagttttcaaaatgttctatagtcgacctgtaactcgttttttaggaaaagtcaaactttaactgaaatcatagaaaggaaatcgtcatgtggtttctggccgatgttagtgaacggccatcttctgaagcagcacacaagattccaataatcagtctagggacaaggatgcaatagtgacgtatacgagtctacattaattttttatatctgcagctatcgtgtgaggacaataagccattgtctcgtcacaaccagaaagtaacataagcatacttatattcttatgctagaaaagaaacaagaggatcgaggcacatagtactatagtagcagcagaaactcatcgctgctgcaagcttttttttttttttgaacaaaccggcgagctgccaatttgaatagagaaggagcatcgctgctgcaagctcaattcatggcttcatacaaggtataataagttgctccctttgtctggtattgctactttacttctcagtgttgtgtaatttttgtttccgtaagttctccaccggcttccctcaatttaccactggtctcagtgctagctttgccctgatccatccatggcgggcttaccagcagaagcaactgcaacaaaggtagcgatgctcgctgtactcaggccagcgtctccaccaccttcagtctcatggaatatgttctgctgctaattcttacactccaattgttgctttgtttctgctacctgttttatgccaaactgcagtgaacaggtgaccagctacttttttctttctcccctttgctggcacttgataatttctcacatgtaaaatgaatgaaaaatttgagttcctcgccagtccagatatagacaccagtgccctcgacaagtgaccctgatcttatcatccacacgatgccctcgccaagtcaccatgatatcatcatccaagatgaataggaactttgcacaccaaccgaataggggtagagggatcactgcactatatgaaatttacagtggttagtatcgaatatgattttatgaaataattgccttcctccgttcattttagtatgttaattagtattgttttacagttgttagtattgtttgctgttaattagttagtcttattctcaccagtcctatatacaattatgtaattgtaaaagatgcaccattctttagttgtagtcccattttaagagtagatacactacactaaacagaaaaaaaaacatacttctatgaatacctcacatgataagaatgtagtaatagtttttagtgttggttatgtacctcatactgtgcatgatttgtccctagaactttagtttaagtatgataagctaattattgtattaatataaatgtcaattcagtagttatacccatggatgtctattttatcaatacaaaagttttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatgctgaggaaaggaggatggaagagtcagcagttgacaattggcttggtcagctaagagaagttctatatgatgttgatgatattattgacttggctagatttaagggaagcattctactaactgatcatccttcatcgtcatcaaggaagtcaattgcttgcactggcctgtcaatttccacttgcttttctaatgttcaggcacgtcatgaggttgctgtgaagattagaagtctcaacaggaagatagaaaacatttcgaaggacagagtatttttgacactcaagagtacggttcctactggaagcagttcagtattgagagtgagaaaaagttcccacctacttgagcccaacattgttggcaaggagatcatacatgcctgcagaaaaatggtagatttagtgcttgaacataagggaagaaaactttataagcttgcaattgttgggactgggggagttggtaagacaacattagctcagaaaatatacaatgatagaaaaataaaaggaagtttcaacaaaaaggcctgggtttgtgtttccaaagtgtactctaaagcttctcttttgagagaacttcttcgaattatggaagttcatcatgatcaagatgaatcaattggagagctccagagcaagcttgaaatagcaattaaggagacaagttttttccttgtgttggatgacatgtggcaatctgacgcatggacaaatttattaagaattccgttgcatgctgcagaaatgggagcaattctcataacaactagaaataatattgttgccttagaaatcggagtggaccatacttatcgagttgatttgatgtcaaccgacgtaggatgggagctactttgcaagagcatgaatatcagtgaaagcatagaattgcaaactctgcaggatgttgggattgagattgttcgcaaatgtggttgccttcctcttgcaatcaaggttattgctagagtgttagcgagtaaagaacaaacagagaacgaatggaaaaaaatattgagcaaaaatgcttggttcatgaacaaccttccaaatgatttgagaggtgctttatatctgagttacgatgagttaccacgtcatttgaagcaatgctttctttattgtagtgtatatcctgaagatgcaaacatttaccatgatgatcttacaaggatgtggatcgctgaaggctttatagaggaccatggaggtcaactactagaagaaacagcagacgagtattactatgagctgatccaccggaaccttcttcaaccagatggtttatattatgaccacagcagctgcaaaatgcatgatcttttaaggcagcttgcttgttatttgtcaagggaagaatgttttgttggaaacccagaatcattggtaggtaacactgtgtctaaacttcgacgtgtttcagtcgtcacagataagaacatggtaatgttacctagcatggacgaggtgcaatataaagtaaggacatggaaaacttcttatgagaaaacactcagagttgataattcatttttcaagagatttccttatcttcgtgttttagatttgactgattcatttgtaccaagcatcccaggttgcatcgggaatttgatccatctacgtttgcttgatcttgatggtaccaatgtatcttgtcttccagagtccattggcaacctgaaaaatcttcaaatattgaacttggagaggagtgttgctttgcacagtcttccttcagcgatcacccaactgtgcaatttaaggcgccttggcctcaattattcaccgatatatcaagttccaaaagggattggcaaattggaatttctcaatgatgtagaagggtttccagtctatggtggcagtagtaatactaaaatgcaagatggatggaacttggaagagttggcttatctttaccagctaaggcggcttcatatgattaaattggaaagagcagcttaccgcactacttacccattgttaacagacaaagggtttctgaaatttttgtatctatggtgtactgaacgtacagatgaaccatacacagaaaaagatttcagcaatattgagaagatctttgagcagctaattccgccgtgcaacctggaagatcttgctattgttaaattcttcggtcgccaagtatccccttctggaattagattctaccccccatttgagcttaaatgtaaaatcccctttgcatcttcttcaaactgcaaattctgtatgcaccttccaccagttgggcagctacccaacttgaaatatctaaaaattgagggagcagctgcagttaccattattggacccgaatttgctggccacagggcgagtaatcttggacgaacagttgctttccccaagcttgaagagttgctcattagagatatgcccaactgggaagagtggttctttattgatgaagcaacgtcaactgctaaggaaagggttgatgatggagattctgcaataccaaaagagaaagcattacctccaaggatgcagatactgtcacggttgaggaggctggaactttctggctgcccaaagctgaaagctcttccacagcagcttgcacagattaacagtctgaaggagatagagctaagatgggcaagcagcctgaaggtggtggagaacttccccctcctctctgagatgcttttgattgcgacatgtcaagccctggagaaagtctctaaccttcctcaagtgcgagagctgcgcgtgcaagattgtccaaacttgagacttgttgaggatttgagcactttggagcagttgtggctttatgaggatatgcatgaggtctctacattgtgggtgcctgggcttcaacagcagtgccggcaacatcatggagaggatcttgaagtctacaattggacatagtaataatgtatggatgcccaaaattatttggacgcttcagttgtttgatgcaaggtatgtgattttatatactctggattcggattgcgcccattttttggcgtgctattgtgtacatagatatatattttttgctttaccagttctcggtcttgaggatgaaaggatctagtactttgtaatatcggatattacagatatgacaataatcccaaagatatggcagtataagaactaaaaaactgtacttctagtttgttctggtaatcctctattaggttctgcaacttccatgcagctcattatcagcacatcgaccttctactgagcaggaatgaatgaatggatcaacgggtagatggtaggagtaccagactgactgtgtgtatattcagcaaatttagtctccctgatgtttacagcctaccttaactgaatttcacatcagcaatgattgcgtgcaaggccctttttcctccaccagatgatgcttaaggaccacaaaatacatgtatatctcgatgaaccgaaaataaaagcattccctccattatccaacatcgttttttatcgagtccatccttctcatttaaacactga

SEQ ID NO: 40655 - DNA, 2071 bp, Oryza sativa
catcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattctaacaaacctaacgttttgacaaagaccattgcgtttccatggtgttactagaacaattgcttcagcgctagtgtgcaggaaatcaattaccatttagtgatgattggggatatgaataagaaaaggagtagccatagctaactatacggttcatgaatatacacaaaatgttgggttgtgcagcatagacaagtggacaattacttaaaatttggtcagtgatagtaacatgggaaagataaaagaaaagaagagtggttcagcagttgtctagctagtctgaatgttcagctatacaatatatgtaaggccttaccaccttgcctaaatcactccctagcctcctgcagtactgttgctttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatatatactgctcttcttgaagcactccttgatcggtgaatgtcaacacatcaaccagtatttctggtactctcccgttgattcttctagttaaccttctgaatcatttcagttgtacatatataatacacacttcacttttcttctgtcccctttttgcagttgtagcagtgcagtctgcggttctctcttgatgactggctcataatgttctgaaatctattctatactctggcttattcaatcagattcctttggtcttgattaatctcagtttattgagatcttaagcacaagatgggaccgagcaacctgttaacctgtgcaagatggttgctactatactactgatccttgttatgtaccatatgttatttttgtgctgaatgatcgctctgtaaggtaagatttgcatcccggcgaaaacgaaaaaagatttgcatgtgtacttcaagtttcgaatgcatcattctgtgatctttttttgggatgcagctagtagagtagtaggtagggaggtgtatccgccatgcaacttttaggttttcatgtgtgaagctacctaaataatatagaccctgtttggatgcttgggctgtggttacataaccataaatgtcaattttgctagccattagactcaacatgcacggtacaccgaattaagtggaaactcttatacaaagaatagatggataatatatttactgaacttcatcttgcattcatattttgtcagccttatctaacttttaaactatgttaacaaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcaacgaagaacaaacgtcataagatcttctcttcaggatgctgaggcaaggaggatggaagattcagtagttgaaaaatggcttgaccagctaagagatgttatgtatgatgttgatgatattattgatttggctagatttaaaggaagtgtcctactgcctgactatcctatgtcatcgtcaaggaaagcaactgcttgcagtggcctttcactttcgtgctgcttttctaatattcgtatacgtcatgaagttgctgtaaaaattagaagcctg

SEQ ID NO: 40656 - DNA, 6347 bp, Oryza sativa
  unsure (1)..(6347): unsure at all n locations
tagatccaaagtttggatccaaacttcagtcctttttcatcacatcaacatgtcatacacacacaacttttcagtcacatcatctccaatttcaaccaaaatccaaactttgcactgaactaaacacagcctgactcataaagtagagtatatttgtaagagaggagcacatatctagctagtatgttattttgcatgtgttttgccacaagaccatactggatcactgaatctgaaaaaatgaaataatgaggttacctttttctatagcttcttgggtaaacgggcaaccagaaagaaatatctggcaacaaagttgaggggttttactcaagtacagaaggcgaacttgctcagcatgaaaggaaagaccggagtgatcctagatcaatgggaacagcagcggcatggggcgcgtctgctgcatcgcaagacgacatttccatcagacccaacaaccaagcaagcacatgctatgttgcgaggaattgaaagaaagactcaccccagagcgaggcctttggtgcgtgcagccatggcaagccggcaaatcgatcgcctattgcgaggaagatgacgagcaagttccccggtgattgcgtggatcatccagatgggctggctcttatgcagtgacaaagagtggaagacaagagatattgctgttaggtggtatgtccatttagcttttctgtatgtgtcccagtgtggatgtgaaaagaacagattccagtgtccacttagtctgaaacgataagaacatcttgacttgctgacttgtattgggcaaaatgcaagaaaggatttacggatggctgggctgatcaccactaacagtaacgctgtcaacttatctggttcagcttcaccaagatcaattgctcaccattcattgtctagaaaaatgatcgattctcaccattgggttgttttctggccttctgtccatcaccgtattctcctctgaactgactggtttgaacgttattttcacggttgttctatcttttcggaatgaaataatattaccttttttcaacttgtgcactcatgcacaattgcacacaacatattgctgcacttgtagtcctctcctctgccagcggaattgcagtccagccgcagctttctagccaagagatgttcagaactgcaattatatgcttcaacagattgaacatgaatatttgcctacatctacatgaatttggtcttgagtttaccctttcttgagttaaatatgcaagaacatcaaagagcaaccaacaatgtcgaaactaataaccgaatgagaagattcagatattcattattgtccattgatttaagatcaccaccttcctccttgggtgctactatttccaggttttgttggatcaacagtgcctttgttatataacatcatgcatatatattgtgcgattctgaccggctgattagtgattagtagcatttgtttgtagcgatgttattctttcatttgttggctcaaccagatccatgggtacttttatgttgaaaacatctacatagacgatgcttatgagcaatccagaaaacaaaaggtctattttgcattcggggaagtcatagtcaagtagcgtagcactgtgcccgtaaaaaatcagtccatgcacaattcacaggtttcgaaatcttagatagctatgaacacacattaagcatgtcaaaaatcaaatccatgggcacctaggttaaaaactttttaagaaaatattttttataaaaaaaatactttctcatgcgtgcagatgcagtaatactaatagaatccgtaagtaaaagtccgaactttcagatgcagacaagcagtgagtagcagtgactgaaacttgcatgtattattcatgttgtgtgttcaggcagagttggggatgctcgatcgtgcgcgcccgcacatggcggtccggccggcctcgcagcgaacatggcggtgtggtgggcaggggttcgccgtctcagacgaggaaagcgacggcggcgggcggccggcgacggcgagggcttggcgagcggccgccctggggagatcgtgggctgctacggccggatgcaacgtgcggcccatattgtatggcccatcaaggggattctctgtggaataagttcactttggttccctctatttgtcgcctagtctgattttcatcccttaattgcaaaagtgggtacgacaggtcccccaacttacgaaaccgtttaaataaggtccctcggtagtatttgacctcggttttggctgaggtggcgcctacgtggctaatttgactcggtcttcatctgacgtggcattgacgttgcgcttacgtggcaattcgatccaaaaattaataaaacctatgggacccacatgtcagtttcacacacacaataataaaaaaaaatggtggggcccacgtggaccccacctatcatcctcactaccccttctctctatcccctttctctctatcctctctctccttcttctctctatccctccctccctctctcccttgagaatggcgagcggcagcgagcggcgcagaggggcggcgatggagctgagaggcggcatgcagcacatgcagcatggcggcggcgtctgggacaatgcgcggttggtcggcggaggcggcgtgtcacgccccgaactagtaccgactggaactagcccgtgacgctccaaattaacctgttgatcgataccagtcccaggaaacagtgctggtatcacaaggagacagaatatcacagcaacagcggtctctttattatagagtagagatacggtcatgttggactacggacagaccccgagctcacaactgcattacaaaagggaaacggaagcaggacttggaccaaacaacacaggcgcgacttgggaactaggccgaaaccctaaaactcattgtagccggcttgctcctgaaagaacttctcatcagcaggatccgcttcatcttcttcagcaactggggggggaattatttatatagagcaagggtgagtacgggagtactcagcaagccaagggaaaataggtgtttaatgcaggcttcaaggagaggctgttgtttttgcaattgattttatttgaactcttttctaagaacgactaagtgagtgcttctcaaactacacggataagacagtgcgtctcgtccggtcggagtatgtgcgatgtatcagtctttagaattgaaacaaggttggcacccggccgacagcttttcaacggccactcgggccaacaacttttcaaacggccacccgggccaacaacttttccaaacggccacccgggcctagctgatcccttcagctacagatttttcaaacatcgaacccctttttcacaacagcaatttcacaagcagtagtcaaacaaaactacgctaggaatcacctcacatccgcccatgaccgtgggcacggctgttcgaatagtttgataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgttcggatgaaattccaaggaaacgatccttaagtgcaagagcgggaaaaccgtacacccggtacgttccccggttcgcggttttggaaattcatttagttcgcaagcaccgacccaggtgtcgggttttccaagtcttttgtaaaactccagttttacccaaattgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccgatctgccttgcagacgggacaacagattaagtgcgatcctatcaatgcataatattttgcaagcaatataattgaatttcaaatataggctcaagatgttcaaaggtggcttgccttgctcgagatctggagcttgatcctcgaaatcctcgcgctgcgggtcttcgggctccgaaactacacgcgaaacgggacaactcagcaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggatggaaaatagacttccctcgggcggctagggcgtggcccgagagaaagggcggctcggccgggcttaacgggccggccggcccaagaaggcggcccagagcggcccaagacgcgcgcgcgcgggagggaggagagagagagccggtggaccgggctcaccacgcccggtcccgggtgggacccgcttgtcagcggctcggctcaccgtgcggagggagcacgcggcccggcgctagggtgggggaggaacgcggtgcangngngcgcctcnnggtggatgnggangngnccctcccacgcccacccccccggctcgcggtggaacgcgcgcacgaggaggggctgaccggggtnggntngannnggtntnggnngagnncccgcccacgcgcctcccaggcgagnnggnggagggnngnnnnnnactcccctcccccccccccccaangaagagaggagaggggnggagngnnccccccccnncccctcccgggnnnnnnccnnggatggttgaacaggacaaggggagacgagccaacggctcggattcgccggaggatgcccgacggcggcgaattgcggcggcggcatccggcggcggaaaaagggggaaacggcgacgaggtcacgaggggccgattcccggcggcgagagcatctacgcggccacgggaatccgatgctagcgtcgaattgggcggagctacgccgagcgaggccggcgacgagcggcgcttccgagctcgggcggcgacggcggcgagcacccggcgagaggcggcaacggccggggcggcgccggctagctacggggaggctactcgtgctactaccgaaaactaagagggagaggtggagcgaggaggaagaacggagggagcactaccgcgatgaggaggggcgctgtgacgagaggccgacggcgcgggagtaatctctccggcctcgggccggggaagaggaagaagagggcgcgcccggagtccccttccgcgtccttgctcgtgccggctcctccgacacgcgcaacgacgaacggcgatggcgaacagagcacgggggcggcggcaatggcgcggaggcgatggaaggagaagagagggagggcgcccggggctttaagggcggcaatgtcggtttggaaaccgactttgggcggtcaaggcgcgagctggcgctcggcgctcgcgtccaaatcggcgacagggcggagggaggaggatgacgccagcggtgacggaaaaaggggaaaagagggagagaaaaaggggcttgcctccttgccgcttttggaaaaggaggaggggagcgggggcgtcgcggcagagggaggaggggctctgcctccgtcccttggtggcttgcgcgcggaggcggggccgaggcgatgacgacggcgatgacggcgggacggtttggagcggcgcgacgacacgggcgacaggcgcgggctggcgcggcagagggtgacggcggcggcgaccgggcggtcggccaccacgacacgcgcgcgcgggaagcaacgggcggcgcggcggtttgagaggcgcggctcgggcacgcgcgctggctagcggggccgggcggctgcgcggtagggcagtgggggccaggcggcacagacggcgcaggcgcggcaagggcggcgaccgcgcgggcgcgcgcacgcgaacacggcgcgcgggaagtggcagcgagggagcggagagggaggactcggctcggcgcgggcggctcacgcgcacgcgcgcgggcagagcggaggggggagggagcgctccgtgctgctctcgcgcacgctcgcgcggcgcgcgggcggtgcggtggggggagggggg

SEQ ID NO: 40657 - DNA, 8129 bp, Oryza sativa
gggtagatgggccgagagggattcggcccatcgaccctgggggaggcaaaatagacttttgcggagggatttgatttggaaggatttggattcggaattggactcgacgatagatcggggatttgagatcttgagatggcacggacactagacaacaagcaaagaaacatatttcgcaattagggtttttaagagataattttcccgctaggcgccacgacggaacgggcgctacacggcggcggccccttcatcgtcgccaacaaggggctcgaggtcgacgccccacacgctcgtgcagaggttgtgcacgcagcgttcgtgcggtcccacgaacacaccgggcgccgcgtgcaggtacttgcccttgagccacttcagcttgtagtacaccttggcttggtcaatgtgcagggagagggagcccctgatggagtcgaagagcgcgcccatgtcgggaggcgtgggacatggacgagcgcgcgcggaaggtggcggcgccggcgaggagcacgacctcgtcggcattgccccagagcttctaaatggcacccccgtgctgccccacggcagcgggcgcggtcacctcggtggggtccgtgaaccgcgctgcctgctccaatgtaacatcctcaaattttaatctaaaatttgactgcatcatgctggcttttgacttgaattaatcttaatttagcaaaatcaaaatcctttttaaaatttcctttttaatcttcatttttggttcaagtattacccctttaaaattcctttaaacctaccctataccatcgtacccaaaaatattctaattactcccctaccctaaactctagtgagtttagcaaatttctttcaaaatttaaaatctagaaaccttctttaaattacccttatatttgttagacttagttatattacaaaaccctagcaaaaacccttcaaaaacccctagagaaattcttttctccttaggcaaatttgtcaaatttctgaatttcactgttcattgcacatgagctgctcgatgaaatgcctagcccggccctagcagcccagcatccacccaaatatttgcaaagtctagaattgatccttgggggaccacacccatccaaaactgtggcctctctttgcctttccaccccctgccatgctgccttggtgccctgcgcgtcgtgccgccgcagccgccgcgcgtaggctccacgaccgcccgcgcgtgcccggccaccttggcgcgccatccatctgtccagtgcgcctcaaccaaccgtcgtcgcacaaatcttgtcaagacaaatccgggacggccaccgccacagctcgccgccgtctgccgccatgcgcgcccacccgatgtcgacgtcgaagctgacttcgcctctaccggggatgaaaccctccaaattcgccgccgctcatttaaacacaaaaggtgtaactaactttccctctctcaactcgaaccgaacgccgccgagccggatattttaccccttgccgccgccgcgcgtcgagcccgggaggacgccagctcaccgccgctcgtcttcacccccagttaaacccaaccgtcgtcggtaaatatctgaacatgatctcccgccactcaatttgctcttcccttccctctcacagcctttgccatccctgccaccccttaactccaagctcatccatggcggcattggtttagggaaaatgaagagtttgctttagggattactttcaatttgtcaacattgatgtgcttaagggctttaatagaaaaatcaacctcagaagaattatttcccaaagagacctcaatacggtttaaagacgaacaaaaactaagttgagaagcggaacaagaacttgtaaaaggctcattaggtgtaccttgaggggaagccaacaaggccggccttgccccataaggggcaaattgatcatccagattgatggctgctttcctcttcatcgctttcaacagagagtcatcatcggccgaagcgatgccgagggctgtctcggagttggaacgatcactgcggcgtattggtgtcatgttcggcgcaagcccgacagccactgcttcattgctgccggtcactggatagtgcgaaccagcgtgtcccgaagacttaagaagcattgccgcggtcatctccttttcaggctgcgccgacaaaaccatatcaccatccgctaccgtcaccacttgctcgccagccacctgctcgctacccgatatcttcttgtcgaccaaagtcggctttgtcagcccgacagtcgcccatcctgtggcttgtgcgtgctcccaaacaggggactgggaggagaatgaattggtgcatgtgttcaattgcttttacttgaaaactggattgtaatgaggttgagctaaaatagtttagaatcaaatttgtccaatagagcaggcgagcagcagagtggatgtgcctctaataattgaatagacaagaatgcagcaaatttcaagaaaattttcaatgatccacctagcagcacagcatcgtttcactagacaagtatatatacaagattatcccctcctccttttccgggcttgggaccggctatgtcattaaacacctcaagtgacataggcggagttacctacacacctacaagaagaagaagaagaagaagaaacacacaaatcattgacctctcagagccactcgttgacctccagctcatgctcatctccatggagctggcggtgttgctccggaagcccagggatccacagctgagagatctcctgcatacctttttccagcaatagccactccaaaccacccaactcctcgacatgcctcaaattcaggcattcatttacaaacagctctctcacttggggaaggttggagatcctctccaggccttcacatccttcaacttgaaggaaaccagagaggaatgggaggtcctccaccgtcttcaagcaacttgtgcatcttataaagaactccttcaagttggtggcctgctgtccaagctgtggtgggagagccctcagcttggggcagcccacaagttgcaacctcgtcaaacaaggcagcagccatgacgaccttggagttggagacggggcttcctcccccttttgcttcgaagcagcagttccatcctctcccccttccttggctgctgcagctgcttcctcctcctgcacttcttcttcttcaacaaaggaccacttgtcagactcgtaagaagaatggaggaaatttcagaaagttcagagtttcggttaactgaagatgcaaaggagggagaaaacgtttcatcctgggtaatgaagatctaagagatgagacaaagccacgtgttcgagagagggatccgacggtgttaacgtcatgagaagccgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagaggtatcagagcacgagcgaatccttggctcttggatctctctggtgaaggttggtggaaggcggcggcgagatccaccgtaaaattcctgagctaggagggattcaatccggaggcgagtggtgcttcagatcggacagcaagggttgggttgccactttcgtggtgtgcacctgtaaaatctccggcgcttctgatttgaggttggcggctgtagatccgactgcaggggtaataggggaggaatcttgaattctgaacctaacctgcaggggcgaaatggtgaccaagatgcgctcaaacgatgagattgtgggactggaggagatgaacgagtttcgctcagatgtggcatctctgaagaaggaagtagtagagcttaagggcttgaggtcagaggtgaaggagatcaagggccttctgctggagttgtgcaaacagaaggggaacgagggacaggagaatcctgtgggagatgctgcagcaaaagagaagagcacgggagaagcaggacccagtcgatctgtgcaggtaaccacgcctagtttgggagttcagttctctattgagccaaatactatgagcctatctgcacctatgggtcaagaagctagaccacaggggggagtcagtagtgttcagacagatttggggcaggtgactactgtattatcaaaacctccaccattcataccatttgccccatttccaaaccagagggtacctttcttaaactcagctccttttcaaactcaaacaacagttgggggaagagtgcccaattcaaattttcaaacacaagggacagccactagctcaggcactgggcaacaaggggttcacatattagatcatagcagacctggtggtatggtttatcaaggagaaaatcaacattatgctgaagctgtaatcaagggacctcggttggaaataccactgttcacaggagaagatcccattgactggttgaagcaatgtgagaaattctacgagattactgggacaccatatgatcaatgggtcaatctggcaattgcacatctgcagggaagagcaatgaagtggtttagaggagtaggtattccttggcagttgattccttggccacaatggtgtcacatggtgagcactcgtttttcggctgcaaatgagcatgaggcagtggaactattccagaatgttaagcagtatggttcaactgtggaacaatatatagataaatttgaggagtatgtggatctagtcaggagggaccatccttacttacaggaacagtatctgaatagctgcttcatcggtgggcttagagaggatatcaagcatgatgtgtgtgggcaaaaaccacaaggtctgttggagtcctattggtatgcaaagaactatgagaaggcagctaatgcaaggaaggtggcactgaatttcagcagaaacagaaatcagaacaccaatttcaacaatcttggcaggaacgcaaataatagaccacaaaggggtgatggtgagaagaaagaagacagaaaatgctggttttgtaaggaaccatggtttcctagacaccaatgcaaggtgaagcaagctatcaatgctttactggtagagaatgaaccttgtactgaagaggaggaggatgaatcaaaagagaaggaacaagaggagctggccactgaccaaatagaggcacctaagcaggagggagcacatgaggagttaatgagtgtgtcatttagtgcagcttctggcacaactcggcctgatactttttcagtcctaatcatgatcaatgggaaacaagcagttggtctaattgatagtgggagtactgggactttcatgacccatgagtttgcagttaagtgcaagtgtcctatagcaacctcgactattaagaaggtgatagtagcaggaggaggagaattgaaatctaatcttgtagtcccagaagtggcatataaaattcaaggggtgaaatttgttaatgctttcagcctgatcaccttgaagggatatgatgtaatcttgggggcagactagatttttcggcatagtccaattactttggatctcaaacagagggaactgtctatcaccaaggaaggtaagctagttgaatttcaggatttcactaaacctgggaaacatttcttaattgatggtcataaaatggagaagctgataaaaaagggagctgtggggtgtgtgttacaagtgaatgcgatgactgaagaagagaggaaggaggaggctgcagtgccagcagatgttcaggaagttttatcacaattcccaggagtgatgaaggagccaaaaggcttacctccaagaagagcttgtgaccatgtgataaacttgaaacctgggtcagaacctcccaaccagagaccctatagagtgccacattaccaaaaggaggccatggagaacataatatcagatctgatccagtctaaggagattaggttcagtgacagcccttatgcctgtccagctataatggttagaaaaagggatggatcttggagaatgtgtgtagactaccgacagctgaatgcccagacagtgaagaacaagtttcctatgccaattatagaggacttgttggatgagttacatggggctagaatattttctaagctggacttaaggtcgggatatcatcagattagaatggctgaggaagatattcctaaaactgccttcaaaacacacatgggtcactatgagtaccaagtaatgccttttgggttaactaatgcacctgccacttttcagtcactaatgaaccaagctctagcaccctttttaagaaagtttgttcttgtgtttttttatgacatcttgatttatagcaaaacaagggaggaacatatcaagcatatcaaggcagtattgcaagtcctggagaagaaccagttggtggtacggcttaagaagtgtgcttttggtctgagcagtgtggcttacttgggacatgtgatatcttctgatggagtggcaacagatcctagcaagatcagtgatatcatgaatcggaaggaacctaaaaatgtgactgaagttagggaattcttggggatgactgggtattatagaagatttataaaagggtatgggttaatctgcagaccccttcacgacatgttgaagaaaggaggtttcaattgggggttagctcaatctgaagcatttacagagctaaaagggaagctgtgtactagtccagtgttagccttaccaaactttgagcagccgtttgtgattgaagcagatgcttgcgaagttggtattggagcagttttgatgcaggcaggaaggccaattgcttattatagcaaggctctagggccaaaagcagcagctcagtcaatttatgagaaagaggctatggctatactagaggctttaaagagatggaggcattatgttttgggtggagaattagtcatcaaaacagatcagcagagtcttaagtacatgatgaaccaaagactggtggaagggatacaacacaagttattgcttaaactgatggaatataattacactattgagtacaaggctggtagggagaacttagtagcagatgccctatctaggagcccgaaaaacaaggaagaagtgactgaactttgtgcagctattgctgtggtggtgcctgagtggatactggatattaaaagaagttatgaagaggatgttcaagctcataagttgctgagtttaattggcacagcaggggatccagaaggggagtataagtttgaggctggaattatgaaatataaaggaagaatatatgtgggggaaacaggagaaatcagagggcagttaatacaagcttatcatagttcgacttttggggggcactgtggaattagagccacataccaaaggattaagaagctgttttattggccaggattgaagaagggagtggaaaatcacataagaaattgtccagtatgtcaggttactaaatctgaacatgtgcatataccaggtcttttaaaccctctagaggtaccagacatggcttggacacatatatccatggactttgtagaagggttaccaaagtccaaggggaaggatgtgattttggtagtggtggataggttaaccaaatatgcacatttcatagctttatcccacccatacacagtggaggaagtggtgcaggtgtttatggataatattcacaaactgcatgggatgccgatagctattgtgacagatagggacagagtttttactagcacattctttcaagaagtgttcaaatctcaaaaggtccaattgaggtttagcacagcttaccatccccagacagatgggcaaactgagagggtgaaccagtgtttagaatcttacttaaggtgcatgacatttcaagaaccacaaaattggtgctcttggatagctttagcagaatggtggtataacacaacatatcacacagcaatacaaatgactccattcaaggccctttatggatacagtcca

SEQ ID NO: 40658 - DNA, 22090 bp, Oryza sativa
  unsure (1)..(22090): unsure at all n locations
tctttgctgtagcttgtaacttattctctctctttttcccttaataaatctcggctggctcttcacgccagcccggcgaaaaaaaaaaaaagattggcacctgtagactgcatactctgcagcattggccatttcagaggtgtcctccctatgagccctctttgaaagtagtttccatgtgagatgtttttatttaccttgttctagttccagtagagatataaataaacttgtcctgattctactgacgatcatgaataatttgctatccactactacaaacgcatcaacataaagtttcttaaggaccttccaaagacaaaattaaatttaattgttttgagcactagtgtatctgtgtatgtaactctctagatgcagctcattttccattggactctagactcatctgcaaagtgcaagccattacacaaaagacgctgacgaagcgtattctcaaaacgacgtacaagagcatcgattaaactagcattagtgggccatgtcatccactaactatacttcacaacaacttattaagagaaactcttcagattaaaagaacttaagagaatgtttcatggatagttctgtaattaggagtactggagtactttaaatctccttttctcctataaaagtagtccgttttactcttttttaagtggaagactctcagatccaacatctcaaaggctcttcttatactgtactttgcttcatgctcttcttatactgtacttttgaatgctttctcctaaatttttgttacagtgagaatcaaaggttccatgcaatatattattatcaagactggaagctcctagagtgcatggatggccctactcaggttggaagacaaatatttccaacctgagccgaattatgtgatgcaatggctctgcaagatctcagacgctatttgcagcttaataaattatagagttcaatatttgattgcagttgaagctaaatactcaatccacactatacattgaaattttatccattctcaaaataggcactgaggcctgtttagatacattggcaaaattttcaccctgtcacatcgaatgtttggacacatgcatggagtattaaatataaaaaaataactaattatacaaattgcgtgtaaattacgagacgatttttttaagcctaattgctccatgatttaacaatatagtgctacagtaaatatttgctaacgacggattaattaggcttaataaattcgtatcgcagtttacagatagattctgtaatttgttttgttattaatctacgtttaatacttcgaatatgtatccgtatatccgatgtgacacgccaaaactttacacccatggatctaaacaccccgtgagtagaataggaaggtacctcaaattatggacttgatgaaccttgacatttccttgatctcttcagaaacaacagaataaggcatgaacacaagaagcaagaaaatgcaatgtaatgaagacttctcatgcaaatagtaatgatttctctcgtgcgcaatgtctgcaggataaaaatgtcaagcatcttacaacaaggacagcatttgctttcattcaggcagtacttccggtgctaaggccaaatcataagtaagaatggctctcaggaagtgaccttctaccaagaccatagatgtcagcacacagcagtaggtttggaagaggttctctcaagagggaatctttatgcagttgtcgcaagggctacaaccatgtttgcacctttgcctgtcatactgctcaccgaagtggccaagaagagtttgcctccggcattctgtctgcagggaaattcattcatcaagtcgttgcgatgcagcattttgaatcatacaataacattagttggaagaattaaatcatagagttaccttcagctcgcaatatgtttgcattttctttgcttgctccattgcaaccttgaagctctcactcttgaagttccctgaattcctcagcatgcatacaattcgaccgaggtcctttttctgatataacacaatgcaatgtgccggaagattgtctcttcctgctctccctgactcctgatagtagctttctatcgattttgacatggtgttgtggataacaaagcgctgcatgatgaaatatccaaatcaaagctttgcacctaccagcaaaagaatggaattatatcccaacattgactgaaatacataccacatcaggtttgtctattcccatgccaaatgctatggtcgcacaaatgactttgacctctccgctgtgccattttccttgtacattggatcgttgacgagcagccaagccagcgtggtaatgtgcgcattttatcttgtacttctccctcaagaacttggcagtgtcagcacattcatttttggacagacagtacacgataccagacatgttcatgaaacgctcttttaggagatcacccagctgcttctgtggagtttttgtcttgccaatcacctcataattcaggtttgttctgtcaaagctcctcttgagtaccgttgcattagggatcctcaaggtacttagtatgtcctgcagagtacatccaaattatagctactaatttccatccaagtagtagtgcaggaacaggatcagtgtgactagaaccttgcagacagatgcagtcgctgtagctgttaaagccataattggtactcgagggaagttctgtttgaggcatcccaggcctcggtaatctgggcggaagtcatgtccccattgactggtttaacatggaaatcggtaccattgtcaggaaaaaaagctgcttcttatacaactatcacaaacgtggagtttaaacattaccttacacaatgggcttcatcaatcacaaatctcgccagtaaaccctattgaaaaatgcagtttaacaacacttcctcggataaaataaaggttaaattaaaaaaacaaagtaacaattaaaaaaatgtaatatgagatttgtaccctctggtgtaaacctatgaggatcccaataaatgagctgtttccagccattctttcaggagtgacgtagaggagtttgaatgacggtttaccacttctgcaatgagatgagaatatgggatgagaagctaaagtaatgtgatatgtttaagaagcattatgcaagttacaacacaaaattctattagatatgctagagatctaatcaaatgtttacctaagctcttggattactgcagatgactgtgaaggtgtctgctgagagttcaaaaatgctgctggtatagcaaacttgaagtttaatgccacaatttgatcctcaataagtgacagtagagggcatacaacaaccgtaacacctgggtgcagtgttgcaggtagctgcaagacaagtaattccaggtggagtttctaagtctcgactcatgcgtactgaaaggtcaactctagatgaaaatgcagaatttacggacctgataacacaagctcttcccaccacctgttggcataagcacaaaggtgtccatgttgcttactgcagccctacaggcctcatactgcaggggcctaaagcttttgttgccaaagatgacaacgtttgcaaaattgatgtcatctaggctatacagctgctgataacttagagtttctctgtttgaagttgaagtggatgactcacatctattgtttcctctgttcaccttcaaaagaaaatatggagtttgaaacataaagatcaatgaatatgagattagcagcagaaaagcacatatttgaaagtggaaaagcatggaagtccaatattggtaaatcagggtaggtagcttatagattaattcgagattctattgtgcagtttagcgtttcgagatcataccttcttctgggtactgactgaacgatcacaatgggactccaacgtttcaaagtcatcatctgaggagaacccgaaggagtccagattgatgcgagtctgtcgagcagaggattctgcctgtctgaacaaaggagttctcacctcaacttctttatcatcaattacaccgtgcttcatcatgccattcaaattgccacaagcttcattctctatagcattgagatcatcccaatcatcattattgtttgttgcatcagccaatgcgccaaggaaatcgtctccacagttctccacggtaataaaaccttgtccgccctctcctgtaccagaacattcaattataatctagtgaccaaacaatcttacctttctagataatatcaaacaatctgaaaagtcagctaagcaccaaaatttttatagactgaaaagcaaaattacattgcagcaaaagcaagcgcttgatgtggactatggatactataatatgatataaaagaatatcataactccatagatagtgcatactttaaaggttgtaagaggtcccctataaagttaagaaacggaactaaaacccaccaaaatttagcacagatatatgtaacaagagactttctccagtacttggaaattaagacaaccgttgatcaattaaaatctaatggttagcacaaggtacctatgaaaagttacctaaaaaggtaggcgaaattttagcttagaggttggctgaaaggttagataggaaattttgtccatggtatcatattagatgctaaagacaaatcagtaaagttagttcagttcttctcgatgaatttgctgcttcggatcatggggcagttctctatggtgggtggcagccggacctattatgaagttcccaatttcgattatatggtatctgtgattgatagcagaacatagtgtcatataattttaagtttcagcagctcatgaatagaagctagggctggtgccagatggagtgagccattagagacaaggaagtgagccaccggcatgctctgccagggaagaatcatgcatttggaggtggaaagggaagaccgatcgtacatattgaaaaaaactatataattgatcaattatcctaaactgtgtaaaggacgataaaacttggtaattgatcaataattgcacaccatgtaactgatgataaaactatgtaatttaccaatagttgtccccacatacctacactaagattcccatttacaagtaggcaactcatcaaattggtttagttatacaacatgacttgctaaatataaatttgcaagaaatgtaattgtacctaaatgctatgtaactggctaataaagaacatataataccagaacaacgcgattgactgtcatggcgtttactgatgattctgaaataaagcaggattaaaatatctcttcctttcgcacaaatggattacaagagaatgattctgaaatgtcattttttttataacaaccatcagagggaagaagaaagtggatttgattcagtggtggcagaaggctctgtaggatgcagcgatgcaatggatgtgaaaaacagtaatgggagcagcagctagaaatgaaaattactgaattgcacctaaatgctatgctgtgtttactgatgactatgaaataaagcaggattgaatgtctcctcctttcgcacaaatagattacaagaaaacgattctgaaaagtcattctcttttataacaaccattagagggaagaagaaactggatttggtttagtggtggcagaagcctgagtaggtggcaacgatgcaatggatgaaaaatatagtgatgtcttgtgacctttactctaaaggtaaaaaacataaaattactgaatagtgatgggagcagctggaatttaaaattactgaattagcctgacaaactaatggctaaaatttgttgcattttttcagtcaaaagaagatccatagcatttcgagccttcgagggatcccaaaactaaaacaatccccaactcaaaaccccaattaactaccgagaaatcctcctgcattatcggtagaggaaaccgtcggcagcggaggctagaggaggaggggaacgaggtcgagcggcggttaccgtagaggcggacgatcctgtcgaggcagtcggcggcgaggtcgcgctcgaagccggagtcagcggccaggtcgagcagccgcttcttctccctctcgtaccccgccatctccggcgagcgcgccccacctccgccccgccgaatggaggaaaccctagcgccggtcgccggagagaggggcaaaaaaaaagcgcgggaaactgtcgcggtggtggcgcgcgcctccgcttctgagctttttggcgccgggagttgtggatctcgtgggccgtggaactctcttgggccgaaatttgggctgaaataagatttggcccaacatgacactcggtccagtatctgcacagcaaaagcccaacagtaaaactatggccctagagacggcccaaccactggaaacctgaaaaaaggtatttacttgatttcaaggggctgtttatatggtaaccaaaataaactttatcaaattttcgtaaaaatttataatattgataagttttgacatgatttcttatgtatttatcaaagtttggtaaaaataaataaatgtatgcatatctttagtaattttaccaaaaaaaaatgttatgatttgaaataatatcaatctgaacaaccccaaatataactagttattttaggcttatgcacaagaataaaaaaggatgaaaaaaactgtcgccagactgaaaagtacggaactgtgacgtttgattttattaagtacagtgcaatgttgcactattataaagaagctgcaagctagtactcgtaataaaccatttggtagtaaagttggagtaattgcatcaaacagggtacaagagtaaacatgatttatactacatgtactactgtacatttgattgtgtgcaaatcaaagtacgcagggtgcatgtaaggtttagatagctacttgaatgggtacactttgatctgtccgtttgattgagtaaaaccatggaagttgtgcgagtaggattcacaaaactcatgaaaaatgttcaattcttacgaattttcgtggttaccagcctacttagctgacaaactacgaggtaaaccagatttgaaataaatcaaagtaaatttttgaatttcaatgaaatttgaaatttacaagtttatcgacggttttcaataggtgaacggttatgtgaaccctaacaagcattcgaggaatcaaggctaaaccgctaagggcaagcacaatgtagttttatttgcttgttgccagcaataacatacagacatagtaattgttattattgttggtctgttaggcagagtttaacattgaaacaattgttttgatacttctgaaaaatataggttttatagtttttagtttatagtttatttttttagattttatagctacatattcttataatttagatgaaaatttatacgatttgaagtgagtcggagatgttagaagaagctatgtttgaattcttctaaatagagccattatctctttctacgatgcttctcgcgggataatggcgattctggataccggattattgatactagagtaaggattttagatggatgtgacacatcctagtacaatgaatctggacaaaccatatgtacagattcattgtactaggatgtgccacatctacccaaaatctcttatattatggaacggagggagtatcatatttgtgtggtcgcactaacagaggtttgtgatgcttatgcttatatttatatgccaaaatttaaatttttgaccttaaatttggagctgattttagggttttctcatcaaagtttatttttcagtctttacttttaaatcgttgagaacacgtatataaaaattttattcataaattatttttttttgtaaatataccgtttggtttattccacgaataagcgaaatgatggggctggcaacagtgatcgagatgggctgagtgcaattgtgatcgcggcgaggggggggggggggagcaaatacggccacgcacgactccacacgttccgtgcgtacgagatgcagatgcacgcacggttgcagcaaagggaaggaggaagcaaacatactattcgaccgttccaatactgttttaacgagggcgctgacgtggccatgccttcgtgccgtcctactgtcccatagattattgatgcgcgtaccatcgagtggtaggcgtagagtagagatagtatcttttaactagagtacttgtatcctgtattccaaaataaattaaggctatgggtgtgtttagttcacgctaaaattaaaagtttggttgaaattggaatgatgtgatggaaagttgaaagtttgtgtgcgtaggaaagctttgatgcgatggaaaagttataagtttgaagaaaaagtttgtaactaaaagtggcctatgtttagatcgatgggtgaaaatttttagcgtgtcacatcggatatacggacatacatttaaaatattaaacatggattaataacaaaacaaattacataattcacatgtaaactgctagacgaatttattaagcctaattaatccatcattatcaaatgtttattatagcaccacattgtcagatcatggcgcaattaggtttaaaagatttgtctcgcaatttacatgcaaactgtgtaattacttttttttatctatatttaatactccgtacatgtgttaaaacgtttgatgtgacggggcaaaaaaaattgccggtggatctaaacaccccctaacttgtaaagattaaattttatttgaaataaaccaacttttatcctcttgcttaccatcggtccataaatcatgaattttattcactcaatatctctcaactactccctccatccgaaaacaaattaatattgtatgaatctgggatgatactatatcatattccctctatccccaaaaaaaaaccaatctaatattgaatgagatattttctagtacaacgaatagactctcttttatcaagattcattatattataaaatagcacattcaataatagattgttttcttttaatggaggaagtatgtcataataaattaacttattttggaacagggttagtgcccggctagcacacaattttcttattaatggaggatattttagacttttatttttccttttgagtactgcccgaatgccacgcaacattagagcaacgataataatatagcccacttcatactattagtgcacccacaatggttatctatagactctctacaagagatccatgtcagtatattttcctatatggaagatattaaatgaagagggagagcaaagctatctactaacttagagatagtctatagagaaaaacgaggcaatgtatgagagagctatagatacccatgtagacatactattgaggtggtttactattaatctagtctattgctgagatgtacatgttttatagatagcaccttactttaccattgcgggtgctcttagcttatactaaagttaacacatataatagattagctataaggttagctataattttcttcttctatctctatctctcacttatacatttaatgtatttgtcttggagtttgtgttaagctagctcttgcatgagagccaacactattatattttgtttacctctctcctctacataagtttatagtaggtttatagctcactattatacttgcccttatgggagatgtatagtaagcgcgcagccacgatgatgatgaccccatggaaagttatagcctactctatggagtacgtacctgtactgctgtacatagccacacagacagcgtacgtgcacgctctagctctagtaggctgggatgggagagtaggaggagcatggccggtgtactactggcaggcgactttactcacctatacaggtattctaccagtacgtagaatacaatactacggagtactgtatatctgtatctattcaattcactctcccctactcccccgtccctaaaaatccatcttataaaggtccctttaaattatatgaatgtaaaaacagagaaataaaaaaaataggattctgacaagaatacgggtgtcgaaatagaaaaaaatataggatcttgatagaaaagtaagtgtaaaatagatgattgcaaaacgcaggaaaaaactgaatgttcatttgattgaaccgcgggaagaacgcagaaaaaaacatgaatgtccatttgattgaacagcatgaaaaacgtaagaattggatgagagagatagactcaaagaaaagttaccaagaggttgaaactcttactaaatattctccaaaatctatatagaattgtccattccataggaatttcaaaggattggataagatttaatcctttgtttcaaagggcttcgtaggaaatttttctataggattaaaatcctccataattcctatgtttttcctccaaatcaaaagggtcttacaagtgtaaaacaatggattggaaaaatacgtaaatgactgtttgattggactacagaaaaaacataggaatcggacgagagaaatagactcaaagtaatttttcaagaggttgaacctcttgctaactttcctctaggattacccattcgggccctttgaatcataggaccgagaatacagaggaacagaaaaaaaacacatgattctgataggaatgcaattgtaaaatagagaattataaaacatagaaaaaacacatgagagatagactcaaggaaagttttccaagaggttagagtggatgttaaattttcttcgtttttcctctagaattgtaggaataggaaagtttaaacacataaaagatagactcaagggaagttttccaagaggtcagagtggatgttaaattttatttgttttttctctagaattgtaggaataggaaaattttttacgtttttccttttctcattcttatgaatcaaagacataaatagtgtaggattttattttttttatttttccttcatttaccctccaattcaaaggggatcttcgtatgtattttaaaggatatgatatgtttctaaggccgagtttagttccaaatttcttcctcaaactttcaacttttctatcacatcaaaactttattacacacataaacttttaatttttctatcacattgtttcaatttcaaccaaactttcaatcttagtgtgaactaaggccgtggttagttctccctctattcccaactttccatcacattatataacataaaaactttcatacacacataaattttcaacttttttttaaaactcccaactttcttcaaacttccaatttttttttttttgggaaaacacaccctaaacacaccctgagatggatggccgggcgggggcggcgcatcgcatccctcatgcatggaaacgaggtcgagcagcagctacagatgcacatagcagagctgccagagcagagggtggcgccgtgcagcgcagggcaacgcaacgcaaagcgcaactcttcctcctcctgacacaattcacgcactgctcctctactctactcgtagctcagtttagccacacccacacgctcctctttattacttcctccgtcccatgataagtgcagttttgcactattcatattcaatgtttgaccattcatcttatttaaaatttttttatgattagtatttttattgctattagataataaaatataaataatattttatgtgtgactaaatattttcaatttttttataaatttttcaaataagacagacgatcaaacgttgggtacggatatccacggctgcacttattttgggacggaggtagtatactgtgcgccgcatcacccgtccgatcccacccacggtcccctgtctgcggggcccaccgatcggttgggacccacctgtcggtggcggaccttcacgggggccccacctgtcatagacggcaacaccgcccctgtgctaacaactgtgcactcacggagctttacctcatcagtctcagctgagcaggacacgtggatggatcacatctactcccgctgtccagctccttaatttggcctgctacagtacagatccgccattaatgacgactctaatcacatcccaccatcgaataaacgtgctgttaaagtgttaattaagacgatgggtgagcttctgcaaacaatgctgctagtgtcgtcagtgagtagtacacacaacatatctcctcttctgatgctcggctgacgacgacaggagaggagaagaattgggaagcacacaccactgcactgctcctgccatctccaaaacgaagagagcagtgtatatgatgatgatctgaccatggatgtgactagcaacggctcggcaaggagaggaataaacgcgatacacgcagacaagcagcaccagctcacgtcttgaaatggatggaatgatagacaggtggacactgatctggacggatacacagagagagagagggatgcacacttgcattgcacatactgcagagagaagaaagccaatgtcgcctcaaccgcggagtttgcctcccgtgtcgggcacaccggtggttcctgttccgctccctgctccgccggattcggacttcggactcggcgaaagcgcgcactggtggtggtggctaaactgctccacttcaggtttggaatttggatgcttgacatgagcccaaaccgtcccatttcctattattgccactcctgcaacaaggctcaatctacctctgtgaatcactgctcaaacatacccctaggacctgtttggcgcagctcaatctacctctcctgcaaatgtgcaaatggagctcagccaaacagtttcagattcacttaaaatgaaagcgaagctgggtggagcgttctcacgaaataaactagagatgtagagctgggttttggctgctccacgactccacttcagacccaactcctgaagctaaattttggagttggagctctaccaaacaggacagaacaggttattaaataaaaagataggaaaaatcatttacaggttttcacaggatttcaaggaaaaaatgggttataaaatagcaggagtacagtgtagagaatttcctgttgtgtaaaatcaatacggcaatactagagatttcctccagataggacgatgcgacccggtcccacctgtcagagggatcgaataacacggcttttccagtagtacaccacaaaagaggacgatcctacaattacgcaatccaagagggttcagatctgatcaccgggacaattacattaccacctcaccccccgaaactcacccctaatcaccttagaacccctcaactccactaacacactgaaaccccaaaatttatgtaaaaccaaggggctgaatcgaaaaaaacccgagcagttaaaaactcccaccgtcccactcctcctcactcccaccacttcgctcgccgcaccaaaccaccacccccagccagccatggcggccgccgccgaccacgcagccaccgccattgccatccccggcgaccctctcgccgacagcgcctgctccaccccgttcgtcagcgcgccgtccagcccgacgcgggagcgggagcgggagcaccacttcgcttctccccacggcgcgccgtgcttcttcagcgcgccggcgagccccacccgcggcggcggcggcggcgggtgcctcggtgacttcgacttcgacttctcgtcgcggttcccgtctccctccgcggcggcgatgtcgtcagcggatgagctcttccacaacggccagatccgcgctgtccgtctctccgcgatgctcctccagcctcagcctctggctccgctcgtcgacggcgacggccacgcgtcgcatctggcggaggaggatgcggcggcggtggaggaggatggtgcggaggccgacgagcgtggccgcatccgcagccggtcggttcgacggaaggcgcggtcgatgtccccgttccgcacgcgctggagggcgccttctcccgcgccggagaccgccgaggaggtcgaggcagtcgccacgccggcggcgtctcgctcgtcgtcgtcctcgtcgacggcttcctccgcttcgtccacctcctcacgaggctcccgccggtgggcgttcttgaaggatctcctccaccggagcaagtcggacggcggcaagaaccaccaccacgacaccgcgccaccgcctcctccgccaaagaggagcccgtccccgtccccgtctccgtctccggctccggcggcggcgagcgcgagaggagggagaggggcagcaacggggaggaggagcaggaggagatcggcgcacgagaggctgtacgaggcgaggagggcggaggcggaggagatgcggcggcggacgtacctgccgtaccggcaggggctcctcctcttcggctgcatcggcctcggctcccgcggctacggcgccgtccacggcctcgcgcgggggctcaacgccgccgccgccgtctcatcgcggtcatgactcgtgacctccatggctgctcccgccattgatgccgttcttggagctcggatgcatgctgctctgcttgctcgtctgtgtagtggcaaatgcagtgtggaaaaacctgcaaaaattgcatagaaaatagtagtagctagtattagaagtttgcttttgccttaatactagtttcttgtatggattttggtgatgtaaacaaagcttgttcatctggtgatggtgatgaccactcccttaacaatggcaaaaaatgtgttcttttactacagtacttcagaactatacttgtattaactggaaatcgactgatcatcttatccttagtttgttcatttctaactgttggtgtccggacagagctagatctccgaacaaaatgtctgcgtttgcaatagtagtagtaataactattgctagtaacaatctccctttgttcactgtaaaattatccttcacagatctttggcttccatcacaatcttctccaaagccttttgtagtatcaaatgagttctttttgtaggaaccaataaagctaacaaaggtgagtttctaggggtaagatgtcgactctgaaaaccaaaccaaacagtacagagatcaagaacagcttttctcatgttattaagagatttttacatcaaaattattgctcaaacagaatcaaaactactaagaaaaaaagggctggattattctcttccgctggttttgcttaacagtgggggtaacatcatcttttattctcgattattatgtcatgcattcgagctgggacgacaggctcaagtacatctcacgtgacagatgacatgtcgtttatcttttgtgcctcgggctcagtaattttatcacggacagaacaacgagctgtgttaatctatgctaaactactgtttactttgcggtgattatttacctaaccaaggtaaccgaataaacggcctttcaccgtcctggcgcgacttgtccctaatcgagaccctattcttttagtactagcaataacaaaaggaactcacaaagtcacagttactagtaagtcactagctacaagtctaaacatcagtacaacactgcaaccaagctaatagcaccaggagcaaattccaaacagaaacaaaatttttatcaagtttgttttaccttaacttgttaggcctaaccaagataagtcacctctttcactttttgttggaagcatgcactttggatgcttgtaccataagttgttcagcgctgcatgcgtgtgctgcaaaaagtcacacgcttcgtgtcaagatctgtcaaacccaacgcaacaatggtgcatttctttactcttagtaacagattaaccgactaataaccatctgtactgtgttgattcttcattctagtactatcatactcctaccagtatttcaatccatttcaacgaaaaagagagaaagggaaagatttttgggagaggaagcaaccataccactttgaagttgagttgacaacatgataaaggtcacagttgcatggcaacttcatccggacagtcaccagcaacacgcagcaactgcactctccagcacaaggaaagctgaaggggaaaaagattacgaagtgagaattcaggcatgtggatgtgacaataccagcctcccatccatgtgtgttcctttccgaagcaagcatgtcaccgtacctcaaggcaaaccacaataaatatagtccgatgcagggatgaaacgaaaggcgccatgccttgctgtgttctttcgctgggagcatagtatgtcctggttcatgcaggggtagggccatcaaaatgccagctttgaaagggatgaaaatagagttttgtacagtagttggaagaatttaagaatgtagtaatgactatagtaactctgacagtcgacatggatctggaaattgattgtttgatcacttgtagaaatattacgatcataaatgaaattatttttaaaggtaactagaaaaagagacatcactgattatattctttaattcttagatggtgttcatttctatcgaagatgaagatgaagttggggtacggaaaacaagaaaaccattaatatataattaattaggttttaattattataaacttaaaaatagatttatataatattttaaaataatttctatatagaaaagaacggagccaggcccattctaacctgcagagacttaagactttcactaaccgtgtggactttgaggctttgactagaaaaggaagttcattttcatactctcacatataatgatggatggcatctccagataccttaaatcaaacttggtctgaggtaggagtacttgccagcaacctttcctccctgatatttattttccagagtcgcacagatatgcagctgtttcgcacatcacaggctcacagcactgcaaaaaaaagattcagggaaagcgtaaatgcctatcatcacgatcacactaaaataaggaatccataaagcctttaagattcttatggataaagcttgcaaagaaaagctttgctgacctccaatagcaaagacactcgtgcgccgagatgcaataaggtcgccaggacactgaaataaccatgaatagaaaatgccggtagtacttcatcattggagcgccacatcactaaacatttcattcccctcttttagaagcacataagaattataagttacattgaatgattgttcctagtttaatcgaccttataatacttgcgagaaattaagaatcgaagtgggacgaaaatatgcaccggtttaggatacagcagcatgcatatcttctgctggattcactatatggccgctgttgaaagaccatattgcttggggattatgcttgctcccctggaccactggcatttagcagcggggtcaactgctgttgcgcctcccaccggtgtcaccgccggcctacaccgcgcaaccggcgcgtcgatccccagacggagaagccaatgtggccccttcagtgtgtggcaacacgggggccatagagttcctgagaataaaaaagttgttagcaacttgaggggcctcatgggcagtagataaaacaagaaatgccagtgccttccccttacatgtttgtggggacctgaatgcatcaaaatgagagcagattagagagaatccaaaggtgggctgcatgtgaatgtgattgtgcaaacaaagagtatcacttattatacatctaaagaaaacaagagtatctctttatctccccgttggaagaaattaggaaggataacacatgggtcattggctcattgacactaatctgtacaggaatattcatgcattcttttgcatctattatctggtgatgccaaatttttgcagaagcaagatcattggataaattatctcatgcagaaacatataagacattttaaaagaagaattcaaaattttctaatatgtgcccaaccaagccttgcatgctgttctatctgatttcattcccagcaagaaactaagcaaacgtggagtagcttaacggcctgggttcgatccctggttcctcaccttccctctctcttaaatacattgatactaagtccctccttagtatcccacaagaaaatcagcaaacatgctattactgtccgtcgtattagcattacaaagaattgatctttctagattgaagtaactgaggctcaactcttgaagcaagttcaagtcagcttgataagtatagaatatcctgacagatctttctgttgcttattttaattagagagaattataaatctaactagaacatcttacctcaagaacacacaattgtatgggattcaagttagacatagatccatatgtcagcaaaaccaatgcataaatatgcacaatgcaatcataagatatcaggtttgtcaaaataaatgcataaatatatactagctaaatgcaagagctttggatggaaggataaagatcaaaatggttcctttcccttttgcatcttccatgcctttttgnggtttttaagnngngatcgttccccccattnccctccagcagtaaaaaatgaagacaggacaaaaatcacaaggcccaacanggaaatttntnangnnnnnaaacagcatcctttttatttgttttcttttttnttgggaagccacagccaccatttttagaggagcccacaaaaggaatatgccaaggttggtgnnggggnnnntcaatatgagtataggtccctgtgttaaattttgtttccgtatgtttgctagcattctgtacgtgttacagcgtcggattaccttttatatgacgacagcatgctatagcctctctctagtagtctagttcctttcagtacccctttttgtgcccagcccaagtaataatgctaaaagagtgaacagcctgctgtctgcatagacaaccataaactgtaaattcagaactatgaaagttccctactctcgaaatgtcagaagtctctgatctttagacaatgttttatttttcaattccttagctgtagtaaaactaactgttggcacttggcagagcaatagttataacttgtgttaaaagaaaatgagtaacggatatgctactatttatagatattatgactataagtatttttaattttagataaaaagtaagtattcatttataataatgcatatacaagatgtcaggaactaaatgtgccaagcctctactaacatgtaataacgtaaattctgcaaggaagatatctgctacattagagagaaatgttctaaaaacacttctattactagatatatcacccacatgcatagattatatagataatattgttagtataatccttgttctagttagttatttggtttccttaggcagtaagctataggctgcagctgttactcggttgtcagacagctgctattagtggtagtagtcaattttgattttacctctagctggaacatagcagcagcagtattgtcggttcagcaaccgacctatccatgtactataaatatagctattgtgctaacataagtaagcttttcagctcattttcagtttcagtttcagctagactattgagtgtagttcagaagtgatcctaccaacaaatataggtgacaattaagctttgttggaagtttacaatatctgaactaatcgaggaatatgaatcgcgtgtgcggaactaataaccagaactatcgcaaaatttatagcaatcatgctatagctgaattttaattgcagaaaaggttagctttcccgtatgtcatattatcatgtgggaattgacatttgacatatacataagaaacgaatacatatctgttcatagttagagtaataataaactttactaatgtatgcacacacttcgttgttctgagggctagaggtgctcaaatatgcatgtacttagtacttaattcttattagtgtgctgttccttgtggtgcattataaaacaaaggagtaaaatcgttaaatcggtccaaagaatgcagaattcatgactctcatatccaattttccattggaagtttgaaaacttcactgtaactttcaggatgaccactagcaataggacttcccagaaaaatattttttgtcacaactatcttgttaactttgttgtcagttaatagtgtaatgagtaggacctccatagacccatgaaacattaaataacctatattgactatagtagaagttgaacattacatcttgttatttcaactactgtaactattaaggtatctagtgcatccataggccatagctcccaaattaatcatgaattatatccattaaggtatctagtgcatccataggccatagctcccaaattaatcatgaattatatccattactgggcattaagtccttagtaaagattattgagtaaagcttcctattcagttcaccattctaaaataaatgttaagggaatacaaaatgcataaagaccaggaactgttacctgaaatgaccagcctttgtagacttccacattttggccctctggggttgtgtacttccgcagttccacacagttcactgacaattatatcatgtatttgtgaactgaaactcggtttcttcgattaagctctgccctggagccttttgcacactcatcctcctcatcagtctcctcgcatcccctgcctcctcccatcgtcctgtttccgcataaagattggccaacaggacatagttccctgagttccatggttcaaggttaataagttctttcagtgccacctcagctatgctaatcccagaatgagcatggcatgcgcttagcagtgcaccccatatcgcagcattaggtctcattggcatcccttgaatcaatgcatatgcctcctcaagaaggccagatcttccaaataaatctaccatacaaccataatgctcaattactggctcaataccatgctctagctgcatgctctggaagatgtccctcccaacatccacagccccagcatgcgcacagcagccaagcacccccagaaatgtcacttcattgggcatctcaccgtgtgtcctcatctctcggtaaagctcaatgccctcaatcccatggccattcaatgaaaatcctgaaatcatggtgttccagctcaccacactccgctgtcgcattcccttgaatacctcccttgcactatgaacatcaccacacttgcaatacatatccatcactgcatttgcaacatgtactttcctgtctagcaacccactcttacgtgcatgctcatgtgcccatctccccaccccgacattccccaacctcccacagaccggcagcacagcagcaagggtcccatcatccggtgccacctccccctccctgaccatcctctcaaagcacaagaccgcaatgtcatccttcttgcaccaagcacaccccgcgatcataacattccaagaaaccacgctcctcctggagcgcctgtatctctgcatttcgtcgaacaggtggcgtgcggcaccaagatcatcagctcggaaacaggccgtgatgagtgtgttgtaggcgacggtgcacttgttcctctgcgtcatttcgtcaaacaggacgcgggcgtagtggagaggatatggcttgaggagcgcgagagagatggcgtgatgtgaaaggaaaccgaggcggagaagaagcgcgtggactgcggagaggagagaaagggacgatacgcaacctaggaggggcaggaacgagaggcggtcgggcgcgtggaggcggcggagagaggagaggagccggaacgcgagcggcggcgaggaggccgagagggccttgatggcggcgttgaggagaggcagcggaggcggcgcgtgaggcgggacgaggcggaggagcgggagagccggcggcggcggggaggagaggagcagcagcgcggcgagggagtggtggtgcggggacggcggcgacgacgggaggcagtgtcggacggcgaaggcgaggagctcgagcggccgccgccgcgcgggaggggagtggtgcaggaggtggaggaggcgccgctccgccgtgcgcgggtgccacccgtccggcgtcgtcaccgcggcggacagcgccggcggctcgccgtcgccggccatcgg

SEQ ID NO: 40659 - DNA, 4877 bp, Oryza sativa
gaaagcgaatgtggtaagtgcggcccatataataagtggacagttcggcctcttccaagccattttcttctccaaaatgccggctcaatttatcagcgagaaaggtatctccctcgtagtatttgtaatgcattgaaacaaatcaaaacaaacacccagcgatctgtacatcatttctccaaattattgcaaagtttctatcacaagttccttcatcagtttatctgttacataaacctagtatacaacttttgatcagcagcttacggcaacaagcttcagaactcagaggcacagaacatggagacatgggagaagcagtggtgatgatgccgtcagatctggagcttgctggcgaggtaccaggagtgcattgcaaggctaccgaacgccatgatgttggccagagacgacaggccatggatcatcccgaacttcttgttcatggccgccagcgttgggttcgtcctcgccacctccgcgttcttcgaaaacccgacctcgctgccgatgccgaggtctttctcgatcttgtgccgcctcatcatcatctgtagaaagaagcctaagtcaaaactcaaaactgtatattgataggtactacaaaagagcaccctgaagtgaagcaatgttggggctacaggatgtttgttttcagcaatcatcattcgctgcaacttgtcaagagcataacagaagacgaatgttgagcactgaatgatggctcacaaggtaggagcaatccaaactcaaattcaattgaagaataaaggtatatctcttactgttctgcagtaacaccctgcaaactgccggctcacacaaatgattcaagactatgcaaccgtaagaccaaaaacatggtgtttgactacattaagccagaaacttttctatgttagaactataaaggtttacttactttcccaattcccaaagctatattgctaagctgattggaaactaagataagagcaagtgcccctgtgtcaagcacttgcatagttgcatgttatttagccggtgctagtgcgtgctacctatggaaaccactaccaggttactacatatgttcattcctgaaaataaaatgcaacaaaaagtcatttattccttaggcctcactgtcgcacttcagtcggactttttaatcaacatgaattgatccacctatactttatcgccttcaaaaaaaaatctacattacattacattacatggacatttacttatcaagcttaaatttcatgcaatgcaagtagagttaggtgaaaagcaaaaatcgtaacataaagaaagcagaaaaatggtaaaaaagatttacctcagtggtcatgggcgtgaaaaccagaaggttggaaaggtcaaaaccaagggcggagatcaagaatccaagctgatagcgctcaatggtagatgccgtcttccaaggatgtagatacgcaaaagctgccactgatatagccgagcatactgatatcaacatgaagtaggctgggaacattttcccttgtagactcccaaactggtgccttggcaaataccttaaagaatacatcaaagcaatgtcagtagccttattctgaaatattttggagtaaacaacttgcacttggtggatcaataaccaaaatagatgctgcatttctggttttaggtgatattttttctgcaaaatcacaaagcagcatgtactatgtgggtataataatacaacactgaaggcgcatttgaacaactgaacagatgacagtgctttctgaaatgcacactacgtattactctgaaacatgcagcttacacaataatccaacttgcttgcaaaaggcaccatgaacattggtgaaaccatgaaagagttctgaaaagttctccaggccaaatgccaaaatggtgagctcaagcatgacagtcacagcaggtttaaagttttaataagagaatttaacatctcaaatctctccattatccaaataaccaaatatacagtaattccaagttagaaattagtgttccatcctataggttgtaaattgggattctgtgcttacaagcatataaacacgcaatctttactaaaatgaaatcctagaaccaaaagtaaaaaactggatgaacgtttgggcaaggatactattctagggtcaaacccaaactgctaggagcctaggaacaaccaaattagcattttgagcatggccaagacagcaagactatgcaagctctccgcttaaatttgacaaaatctgatactgtttacaacatagtaacacttacgaaaaatctaacagcaacaataatcgacgtgaaaacccaaaattccactaaaatggagctgatagatagggaagcgattagagagctctttacttgaacatgacgatgccgccgatgaaggtgacccagagcgcggcgccccaggcggtggcgaagcagaggacgtgcgccagcctcgccgccgcgaccccggcgccggagcggccggagccaccgaggagagcgtccggcgcgaagagcacgccggcggcgaggaaggacactgccgtgaggaaccgcgccgcccaccccatcgtgcccccaccctaccaggctagggttcggattccgagagattgaatggaggaagaagaagaagagagcaaatctgtgtgattggaaatgaaattgaactcaacttaagcacagagtgtgaaatgaaagactagtcaatggagtactagtgcttgcttgcaaggaaagttctggaagcttatctagaacgcattaagttataatatttcctcattaattttataggaagcaatttaagttaattgattgattctcataatccacacaaattaacaacaaagaaacagagctttacttgtacagtactatttctactcaatggcaattctctgaagtctgaagttccaagagaggagtcagcgtaggagaacttgtgttacatgtgacagaaggcttgacctttttaaactccttttagaaatgatgagttgaatgaacactgtattaggcaggaatttgctcagttgaacctcatttgtttgtctgttttgtcatgaccaaacaaacctatgggctatgggctttaggctgtgtttggatccaaacttcagtccttttccatcacatcaacatgtcatacacacacaacttttcagtcacatcatctccaatttcaaccaaaatccaaactttgcgctgaactagtcacttagaaaaatttctaccagaaacctgtgggcagttgggcctagaaaaaagagcaacacacggttttggaccaaacagaagaaatcaaagattcagaactgcacaagatttggagtacgacaagtataaacagtgaacagcactagcaaaagaactgaccctgttcgcagtagaacatgaggtcagacctgcagtactttggataacattacagatcacagtacttacaatgcaggtagtccatctgccaaaatcaactgtaaaaatggagtgtattttggacaacagaagaagaacaagtaatgaatgatcttatgtatttcttcagttcaattgtttgaacctgaatacttgatcaattccaaatttccaatagcaatgtgatgcctttccaattgctctctctacctttgtagagacagtggcagtggcaccaacaataacaatccacaaatcatcatcaacacccaaaagatacaattccaaatcttgttgaataatcctatgcttttaattgatgagagtggctttctttctatacccctagctgctcgagggcgatggtgacggtgtgcgtgagctcgccgatgatgaggcggtgctcgccgacggggatccttcggaccccgttccggtcggcgacgctgagcccgtcgcacacgtcgatgcccatctccaccctcgccgtcccgccggcgcccacgtgcaccttctcgaacgccaccagctgccgcaccggcgcgccgtggcccgccgccgcctccgccgcggacgacgccggcgccgcggcgtacacgagcaccgtgtgcgcgccgtcgcgttctcccacgttcctgacgtcgacgtgcaccggcatcctcagctcctcgcaccgcgcgtgcgcgacgcgcacggcggcggcgcggctgaggcgagccgtggcgttgagcgaggcggaggcggaggcggcggcgtggtgggcggagaggcggacggtgagctgcgacggcgcgtgggcgatggagtgggtgaaggaggtgtagctgaggccatggccgaaggggtggatggtcgggccggtgtagaagcggtaggtccggccggggtagcccttggccggattggcgcgcatcgccatgttcgtcatcggcaccttctgcaggtaatcttgcgggtaccatgtcaccggcagcttccctcctgcaggaacacacaacaaaccaaattccaaattaacttgattaagatacatatttttttctcgatttctattagtatgctttttaaattgctaaacgatgtattttgtacggaattttttatgctgatgttattttaaaatattagagaaacgtttaggggtcttctatcttcgcaggtggtggcctaaatgatctgggtttgaagtctcaacccttctaattatttgatattagatcattccataatattcgcgtcttttgttttaaaatatcagacatatacattttttaagtttgtaataaattaaaacttaagtaatcttgtgttaatgactttatcattttacgtaccatcatttttttatcttcgttagattcaaacaagactttaatctcctttttgaaaagattagtcaaatttcacaatcaatctccttttcattggaaactaggggcggatccacaatgggggcggag

SEQ ID NO: 40660 - DNA, 5302 bp, Oryza sativa
tagatccgcccctgttggaaagattataaaattttgatatttttgaagcactctgaatgaaaatgaaatgaaatgttgcttggattatgtactacctgggttgtggtggccgaagatgacgtcagcaatggcctgcccgccggcctggccggggtacccagcccacaggattccggcgatcttcgggtcgttctgcgcgacccaatggcgatggggccaccggacatgagcaccaggatcaccggccctttcgacgccttcgccaccgacgagatgagctccgcttgccggccagggaggaggaggctcgcgcggtccagcccctcggcctcgatcttctggtcgaggccggcgacgacgatggtcgcgtcggcgcggcgagcggcgtcgacggccgccgcgatcggctggccgcttcccgcgcacgccacgtcggtgcatcccggctggtgcgcggcccgcgcggcgtaccgggcgacgccctgcagcggcgttgtgtacctgcacggcttcccggcgtagttcccgatcatcgccaccgttgcctcggcgtgcgggcccacgacggcgacggcgcggcgcgccgtcgccggcgacagcggcagcgcccgcccgtcgttcttgaggaggacgatcccctgccgcgccgcctccaccgcgagctcctggtgcgccgccgtgcacacgtgctgcgggcccaggtgcccgaacggctgcgccgccgggtcgccgtcgaacatcccgagccgcatctgcaccgtgacggtgttcgtcaccgcggcatcaatgtcgccatcgccgaccttcccctgcgcgacggcgccctcggtgtactgcgccaagaacgggccgcagtcgaggtcgagccccgcccggagcgtcgccgcgacggcgtcctccctggtccgcgtgtagtgctggtcgctgtagaacacatcaaccgaatcgcagtcggagacgatgtagcctgcgagcccccaccggcggcggatggttccccggaggaacgccgcgtcggcgcaggtgggcacgccgttgacctggttgtaggagcacatgacgctggcggcgcggccgtcgacgacgcaggagcggaaggggacattgaaggtgtcctcgaggtcctggcgcgtcacgacggcgttgaagtggaagcggtcggtgccggaccagttgtcgaggtcgtaggcggtgaagtgcttgcagcaggcggcgagcttgaggcggccggaggagggttgctgctgctggaggccgcggacgtaggcggcggcgtagcgggcggcgacggcggggtcctcgccgggggtctcctggccgcggccccaccgcgggtcgcggaagatgttcacgttggggctccagaacgtcagccccgcctgaccgccgttgtacatcgcgcgaccctcgtcggacaccgcctgtgcgcatacgtacacgtacatgaatacagatatacgtatacagctgaagaaatacatgaattaataactctaatataaaacacacacataaatacatacatggattaataacaaaaggaatttgctagatttcagacatctaagaatttatactattttttcttgtcacctgaagtaaacattttggtatttggttagcttaaaattgcaatgtactaacatgtgccgttgtatttcattttgcctgtaattttttttttcgaattacatattacaacgcacgcacacccatccctatgaacgcacgcacataaactatttacgtaaaccctatctctacgagcattttcgaagactgggttgcattatatagttttacttaatttttgtttaagcttaaataattgtatagttctattaaaaaaatactttgttatgaatattttttttgactgaattattttgaataattaatagtagaggggatgagaatgatgagaaacctgaaaaccagatagtcctgactagtaaaaaaatactcctaaaatataaaaagaagaatctttctatggattgttcatcatgggcaggatgacaacgagtcatggttttgatcacagtggagcacgaatcacgaggcaggatcaaatatataattgactctcctgcaatcacatggccgtgtaccctatcgtgtactcaaccaagttactatgcaacactgcattcgcacgtgaattctcaaccgtgtgcttgtgctcacattcacgctcgtgatcgaattcctctgcaaatttcagaagatttttttttttaaaaaaatgtctgcaggttctctatctctttggaaacaagacatgcagagatcagatcagacacaggtccagcaacttgccctgaaggtccaatttgtgaccactgtttgggccttgaaggcctcaactactcctaatacagtactcttgtcttgctaatcttgagagagccataaatgaggcatctgaagatcttgttctgcaagtatactaccaactgcagctctacaaacaagtcaacaacctatggatcacattgtactggagcactactgatcaattgatcatagatcctagatcgacaaatggtttcactgaattgttgaactgccatacctaccaatgggtaattaggagtaaaatggccattatatgaattcaccatgacacggggagggctagcccgccgctcggctcgccgacgaaaactccattaaatttttaatattgttgaataattaaattgatgatagaatttctatagcaaatgatagttataatgaagtttgtttgagctaaaaaaaagtttttctagcttcgccactgccatgatatgaatggaattcaatatatatgtaataacaaaaaggcaaaaggccaaaaaggtttgatctaaagctaaagttaaagcttagcactgattatggtaaacaaaattcagtgcaaacaactttgccagaattttagtgatgaagagagaaggacatgctaaaatgagagaataaaggtgggcaatatgctatgactacaataacaagagcaacatatcataactctatccttatggactcttctgatgtaaatagttgctagctgcctcctacacttcaccttggccgttggttgcatcttgcatggccacctttcagaatgggcatcacctttaattaaggtgtaccaactttacacatttacacattgaaaaatattttcttaattagctaagataagatatcagaatggggctcaaaagttttagatttggctaggctggcttgcacatggctgcacccctgtatcttgcacaccattggccagcacactatataggacactaggaattccattatgtccttcctttttggacttggacacactagcaaggtgtgcatcactcttgggtcctaaagttttgtccattgatgataatgaacttctaaactaaatttaagtgcatgttattgttttgatcaaatattaggacatagtctatttctcaccaccagtttttggttatgaaaggtgcatgatgcatgcatgcttttacagggctaacaatggtaaaataacacaatgattaaggtagaatgtcacatcacagttagcctaatacatgcatgagatctagatatattcttcagtgtagagcagagcatagcatgtgcattgcttgcttgtcattttgctaagacagaccatgtacaaacacggtgccttaactcacaattagtgcctaacattatgtctagacgcaagctctaatgtcttatctacaaaaagataagtactacacacatataccatttgtgtgaagctaaattaacaaaaaaaatagctagtaaatgcatgcagagcaaatcagttcaccactagtaccaaaaacgccagtaaaatcaaacaaaccagaaacaaagtacccttgaaaggttaaaagcagtcacttgcaaaaaggccaaaagggcatatggatcattagccttttcttctttgtaatcacacatgttgtaggctccacacaaaaataataatacaactccagtgctctatccattccaccaaccatgatccagcagatgctattgctgggccagtgtcacagtgaccctctttgctcatgcagatatttaggccaactcataactgaataaaaacttgttcatgtaaaatttccacaaacttttatcttgcaaacattatgtgcttgaagtttgagaactgccatgcatacaaaaaggttttgttcactacatcttacacttgttcaccaaaaaataacattttctgttataaagattgaaaattttgtggacacgcatcattattaagcaaagtggtggcaaggatgctagtgctctatccaagtattatggaccgtgagatatgtgctttaagattcgtacccaaaatcattggcactaccaagtaaaaaactactcattctattccaaaataaaaacatttctagaatagtgataagtcaaatatttttaattttaactattaatagcaaaaaatcaaaaagatcattcatctaaaattgatgttattagatttactattaaataaactatcataatatgtaacttttcatttaaaatattttattggttaaagtagtattttaaagattgcgtggaagatttatattttagaagagagagagagagtataaaccatagaaaaaaaatagagaaggacagaacctgagacaagcgcgacgcacagtagcgagtgacacagacaaggacgccatggcgcgcacagacatgacgaagagaggcatcacatgcacgcacaacaacaaaaccgcgacaaaagcaaaagcgccgcgcacgccgcacgcgcgccgcggcgtcccgtgtccgcgccgcgcgcgcgccacggcgccggcgacggcgacaatgccggcgacacagtgttaagtgtggaacgtacctgcccgatgagctcccagagggtggcgttgaacgacgcggcggtgccgatgacctgcgggaacgcggtggcgccggggaacgcgccgccgaacctcaccccgggccccgtgtcggacacgccgtggagcgcctccgaccaccactcgtacccggcgacgcccagccgcggcacgccggcggcgttgttcaccagcagccgcaccttctcggcgcgcgtcagccgcgccaccaggtcgcgcgcccgcgcccgcgccggcagcgaccgcctgcagaacggcagcgtcgccgccggcccgcccgccgcgcacgcgaacgccgaccgcgccgcgacggggacgacgcccccgccgaccgccgccccggcgagcaccaggagcgggaggagcaggaggcgccgcattgtgga

SEQ ID NO: 40661 - DNA, 10446 bp, Oryza sativa
  unsure (1)..(10446): unsure at all n locations
ttaaaattcaatcaatgtctcgggtgccatgagtttctttcttcaattttgatcgtctgttttatttaattgttttaaaaaaaataaaaaacataagtcatgtatanaactatatattcatgttttataatctaataacaataaaaacactagtagtaaaaaaattttaaataaaacggatgatcaaagttggcacggaaaatttatggctgcatttattttgggatggaagaagtagtaaattgcagtcactgctgctggctagtcctagagaaaacttaaaaaaaaatcggtggctgccagtttgtgtgctgcgtgctggtggtgttttcattctcttgtgcatgtgagcatgtaactgtgtgtttgtacaatgagagaagtaataaatcattttttccctttctttttagtaatggtgtttgtactgaatgaaagttggtggtgatggatatttgtgatttgtgcttcaaaagtcagataaagaagtaaagcggtttcaaggacagggcacggctactttggagcaggtattgacgtactaggctctgtactgtactggtgtaaagactgcttttagaatttacaaaggtaattactgctatgattaacatctgaacatatccattagctttaactcccaaaacaagtaccttcaaatctagtagagatgaaaatagaggaactttcccatatgaaaagcacctaacaactttccctatctcctttcttcctctatcccttttaacctgaattttttttgttggtttatcttggaccgtccaatcaaagagtctatgattttattctagaatagaaacaatgttgaaacagaagatttagttcattaccacactagacaacaaacaagaatctataagttccaattaaggcctataaatatctctcagtgatcaccatgtcatcttgatcttttatttgtaaatgagagcatgcttttaatcataatctgctttttagcctctgtttggttctgttttggatttatgagagcaaaagagagagggcctgcttgcctttagcatcacatttgtgtaaagatgcattcatgccttggaaggaccaccttgcagaatggaaggatatttctccacacatatgtcatcagactaatctgttcacagtactcatgcaacaactcttccataaaaacaacgtggcctcattagcacaaagctacatgtttcataagcagaagcacaagctcaaatcctacatcaatcaaagaatgcgtttcaaacaagcccaaaatgttactgaaagcatcttaacgatgtactttgccaagtttcatttcacacaatatatattgactcttgcactcaccgttaatcttgttgagcagttggtaatccaatcttttttatggtcagttttagtgagcaaccaacttggaacggcgtactacgtatttcgccggcaagcagttgttcagtacttcaacgtacagatcaaaatgtcatgatttcacctaacacctttatacaaaccacagtccagtgaattacaaatgtttttaaatgcaatttcatcaggttgtacaaaatgttgaagaagttcattctgtcattaattaatatatttaatggcggcgcctatcatgcacctgatttgatcgccagcaagaagaggattagaactgagaataacttcgcttgaagaaatcggactagtaggttgatttaacaagctttgctggaagaactaatgacgtgtcagaattacttaccgtttagaccaatgcaaaggatacgaaaagcttcatcaaaatggtttccttgtacggaggtattgtttggcaactttgctgacatggattgataaatgagagcgaaatgagtgtgtcactgtcaaatcggattagatgagtagttcagctgcaaaggttaaaagcaagaggataaatacgatttcagaattcagatagcaccaaaaagagtaaccaaagtttgagtgttaatagatcatctgtgcacaaaacttgacgtctcttgcaggtctgcttgtgcttatcccttttcactctgtttaaagcttcttttctttttgtgaattcttgaatgttgatgaatgaaaggtcgagcaaacacttattcttattcgcaactaaatgcttccaaagaagaagcatcactctattttccctaatccctagtgatttctccactacactgtgcaacctatttctgatggcaaaagtactactatatattctaatgacaggcagaaagacaacatgcttattagtccttattcttttccttttcactttcatgatgtgtgaccaattgatggtgaactgttagtggctttcaaaagcatagcatgttatacatcactctgacacaactaggagaagggagaaagtgtgatgtccagatgctaatgggacatgtaccatttcacttcaagtattggctcctgtaaatggtcccttctactatccattatcccttatgccaatgccactatggcaccaccatccactagtaaggacagaagttagctccaagagttagtggtacaatgtatttatggagtagtgttgtgatgtcaaagcaagaaaactaccagggtacccacttcagtaagtatatctgtatatgatcttcctcctgaaaatgctgagcaactatttgtctgcaacagtagaaaagctaggtaattagactcactgtgaatagatatttttatgggtttagtcatgtaaattctgcatatgtagctccccaaatctctgcagaaaatatggagatgattccacatttccacttcccaaggcttttagtggcgttgttgcctcatgtgcatccacaattctgcatcacttctgttcatggacatacgcacaaaggtcaacttgcaagcatgcatcacccaactggaaccgaactggatggcttcagctcatggaattcagcagctgttgatgtaggggttggtgctgaggcagtgaggctatgctgcagaacatgtggtactgactgcatgtaggacaggatactgcatatactcatacagttgaagaagtaatgggagcaggaatgagtgaatggatggatgataggagtaccagactgcagtgtatctgttgggcaaattgagagtcatgggctctattgagtctctctgattggatgcagcacatcttgactgaattttgcatcagcaatgattgtgtgcaaggctctttctcccccaccagatgctgcgaaatgcatgtatatcttcaggaacagaaaagaaaatctttccctccattatccacccttgttttttttattgaattcatcattctacaattaaacactgaacagaacagcttgtgagtcatcaggattggttcaagacagatgtaatgaccagtgccttagctttcctcattgctgtcccattaaattcttcaaatcacccgtgatcttgatgccttcatatgctctgcaggggatgttaaccagtgctcttcttcgatacttgaaccttcctaatttttcacgaggctttttacagtctttgagtgaaggaggcaccatatcctagccgtccattccactcaatctaatggcctaggatctcccgcaaaagcaggtaccgaatgttgttgatggtgggagggcaattttgtactttcgcttgcaggaatcaagttggagcggagcaccatctgtccgatgcagtcgtctactcatcgactcctcaaatcgaacagaaaccgtataggcgaacacgggcacacggcgacgagcctgagacaaccgatgcggtggtcttccgggcggcagtgacctcgggggaggtgggccgatagggaacaccggcgacttcgtggttccctcccgtcagtgctcccgcttcctccctcctcccggttcgatcctgacggcgccgcattctagtccctcctacccattccaccagagcgaggacgggcatcgcaattcgcaagggcgccggcagctgcaaggtcaaatcgcgccagggcgattggctgctacgggctacggcgaggccaccaggaaacttgaagcagacaaagcttttcactcgagaagctcatctagagaagccaatataaatccacgaatttcagaggcctcgtgccaaggagttagaagtcctgcaaaccaggcatttgtttgcaagccaattgcatcattatgcgctgaaccacaactaattacagaaaggtttacaaaagagccttttcaagaacaatactccaactaaaaaggaacaaggagcttgaagaacagtcatcatcagaaagttctgaatacatgtctgacataaattcctaacaaatcctatattccacaaacaagatctaaataaccactgcgtaccacaccaaagaaggttcagagttccacacttccacttcatttgagtttcagaaggttcagagttccaggaactgaacttggcacttccacaatactgaacactcatacttcatgcgagctttgaagcacggcatatatactagcacaagacaaaccactatgcatgctatggacacgacatgactgtcaaagtgtggagctctggtgctgtgtggagttgggcagggcacgatgatcaagagcaaggggggagatagccgacagatgaaggcaacggcgccctgtggctgcagcagaaaggacaaagaatcggagacggccatgggagggagcaggggcaccctgccgcggggaggatagagacgctagcagaagaagcggggaggctggctttatgaagcagcgacgtcgtggatcgatggtcggcggcgagatagatgggtggaggcggcgctatagatgggtggccaacggcatcctggaggaaaggagaggccgcgccatctagggacgtgcgccggtgccaaagcaagtgaaaacaaaggatgcggagcggaggggaagaggacgaagaagaagacggagaagagacgataccacacgcgcagacgtgctattccgatcgtatcctttgtgaacggacggatggattgagttggtacctcctcaaagataggaaaaatactcatttttcacactgtattatgttatactagcaatgccttccctgattcatagctcgagttgttgtctcaagggatgaaactggttcggatagtttccgtccgtccggaccatttttcgaattcggatagtttcggtcggaactatccggaaattctcggattcggaaacgaattcggattttttttctcagaaacgaaaacgaatacagtaagggtactatccgttggaatcggaaataagtcggaaactatccggaatttttttcagatatccgcagacattgagtaaattttagaaaaaaacacgtatatatgcataactttttcatacgaaatcatatgaagacaaactttatatcaacattgtaaagctcggtgagatctacaactttcttattgactattttattatttgaggtcatttaagggtctaaatattcattataatataccatattaatttttacaaaatctcatatctaccatccaaacgacatctgatggagatgtgttacatatcaaagttgtagagctcaactggatctaccactttgtagtttataacatttgtatttgaaagcatttaaagcataaaataaatattgcaagtttcgaagatgcgaagtaaaataaacaacatctccaatttatacaatggcaagtaagttatacatctagtagaaggtcttgagaatagaaactgataatcatatttgcatatgaatctcttagaggaacaaccataaaaatcgattttcacatacggttgtgagaccgtctataaaattgacgatataaatattggagatgttgaactaaaataataagtgatatctcttcctcgatcaagaaactcaatttgaggggccttttatataccggtaaatattcactaccgtattcgttccgtctcgtattcgctccgtatttgtattcgataatatttgatttcatttccgtatccgacttttcgattccgattccaattccgaaaaaaatttatgaaaacaaatatgataaagctaatttccgtccgttttcgatttattttcatcctctcatggacaattaaattggaatcgagcttagtgttcattcctgtactcttcacttattcagtatttcagttcagtgttcttagtttcatctcaaccatttcgattttcgggtacaaattattcttcccatgcatgaatgacgcacaaaacaatcaacggtgtttggcgaatttcatctaaccggagcgacgagaagggaaatggagcgctcgaccttgccctccgcgctccgccaccggtcttcagcgccatcgccgaggtgggggctcgctcgatggccggaccaggtgctccgtgctcgaggatttacctcactggctgactgactcatcggagcgctcgccatcaacctcgccgccagcgccaccgtcgccactcgccggagcgccgccgccgtcggcgacccacgcgcccttttcaacgataatacgagatagtttgagggcttactcgaaaataatcatcagatgcttacgtggctttaatctcagccggctgtgttagatcaaacgggtgtaaagatgcacatgtaccttttttggattcaaaaatggaaattctgatagctaaaggactcgttcaaaaaatcacctccaacaactggccaacgttaatatcgaccgctagtgttcgatcggacggtcagcagagatagaggcccatcgacaaggcccacaatctcgtcgtgaatatggggccgcacgttgcctccggcctatgttggctagaactcgccgcagtacagcctaggcccattaattgaggcccaaatcatccctcacggcccatacattatgggccacaatttgctcctggcatgtggtggcccacaaattaatcccaacagcttgatgggcccatacaatatgggcctcacgccggcagcagctcaccggcgcatcccgaccagccatgggccatggcgctccactccggcgacgacttggatcccgtcgtttcttcgactcttcggcgagcttccggtctttcagtttcatatttcagatcagacaagttgagcgggtacggaattcaaatttgcagagggatatcaactagaagcaggaatcctcgatagataaaggataatgaagtttgtcaggtatatgttgtctgtttgtcagtatcattcaagattcagatcaggtagctcgacaaggtaaatctgagttcccctcaatcggctgtgaccctttcatatttatagggtgggtggacagagcttagctcttgtacaagtcgaattcatgacaaattcgttaagaacacatactctcttttcggataccaaaacaggatcatccggtttagcaggacatattaattttaactgttactctctccattttaggttataaaacgttttgactttagtaaaagtcaaactactttaaatttaactaattctataaaaaaagtaataatatttacaacactaacatagattcattaaatctataattgaataaatttcataatatatttgtctcgggttaaaaatactaatactttcttttctataaaattagttaaactaggagtagtttgattttaaccaaagttaaaacgtcatgtaacctaaaatggagggagtaactccttgtagtgacaatcaatacttatgttaatggttggcatgggcaacgattgtgtccaagactcattctccacccatcagccactgcttaggtgggatggaacccatgtatatcttgaggaagagaaaagtaaatccagctttgtttattacattgaattcatcttatccatttaaacactgaaaacaacggtctgtccgctgtcatcaggattggttcaggaaaaagctacgagagtgccctaacttttctccttgttatcccattacattgtttaatgagagaatatattctatctccctaagtttactccaattcaaggatttgccatcgattgtcttcctctataatatgtcatcaactttgtcaactttttctacaatatgctattgaggtggatactttttcaaataaaaaaaaaactaaaatgtcactcaagacatggctgtttggttgccgccgtagtttgcctcagtagctgtggctcaccatgcttggcttgccacagttgcctaagctttttgtgtctgaatgtgcttgccacaacaacagcgccgcagatgaggcgatgattttcagcgccacaggtgtggcgtgtttttgtactgggagcagtagtggcagccacagctttcacgggaaccaaacaccagccgcactctcgatctggcgtggcgcatgttggcaggaaccaaacaccggccaagctctccatggctgccgcaggtgtggcgtgccgcgcggaggcgggcaaccaaacaaccaaaccgtcggtgtgccatctgcgcccacggtaaagatgttattttccaggccaggattgtcgatcacaaccaaagcgagtttttgttcagacttcatactctttggcatatagaaactactggaatctgaaagcccaaaagctttcgtcattgcagagaggccacagtgaggggtgaagaaagcatgacgtttcttcttcgtgtgaagggagtgtctatgatcattgttcgtctctactactagcatataaagtagtatgcacctctttggctctttcttttttcttttttaatcaaagtgcgctcctgctttaacatcatggaatataatctttatacttaaactaattataatcacatcactaggcgctagctaatcatttgatttacttggaaattttggtgcatcaccattaacgagtttctctatggcaaccatactagattctttaattggatcatgcgtaaacaagttgcaacggctcattactgaggaggcaatacaaattttacatgtaaaagaagaatttattaacaaaacaaattacatattctgccaggaaactgtgagacgaatttattaagcctaattaatccgtcattaacgaatgtttaatttattgtagcaccacattgtcaaatcatggcgcaattaggcttaaaagattcgtctcgcaatttcctggtgaactgtgtaattattttttttgttttttttgtctatatttaatactccatgcatgtgtctagacattcaatgttacagcgtgaaaaattttgtttgggaactaaacagcccctaaacagggcctcataagagcaggtacaatagcaggctataagccagctgcaaacatattttaagaagataaataaggagagagaaaaagcagcgggctacagatttgtagccagatgtagcacggactccaagacgcggtgtgtgtacgacaggtgggaccatatattaatagtgtagtatgcaactattgtatgaatgggctattagattggctatagatgaattggagctaatagttggctatactattaaacttcacaatttttgacaatttgaccctttgcaaaaactatttttacaaatgaaccgctgccaaaacttatttcaaatctgacccttgtgctcaacgccaaatcatgtggcgctgaaattaaacacctcagcgccacgtcagctggcgctgaatgccgtgccacggcggatgggagactaagtcagcgtgccaacgtacattcagcgccatgctatttagcgctgaggtgtctaaattcagcgccacacgatttggcgttgagcaaaagggtcagatttaaaataagttttggcagtggttcatttgtaaaaatagtttttgcaaagggtcaaattgtcaaattttgtgattaaacttgctctaagaggacaggactatgatggtccatacatgccatcaaatgcacactcataaagtctgagttgtcagtgttcaaactgaaaaacatcacatggcaagctgtaagttattgcctacttcctactagtagtactggtagtaactgaaagctccaagcagcaacaatctcatatcgatcctctagctccctcgtcagattacaggggaaacgttcttgatcatcatctccctcgtcagcggctgcacgcaccaattaaggcctcactctgaggcgagtctttcttcctcacgcaccaaccctctgcttgcccacaagctctggttccttgcggtatgagctgattgaaacatcggattgctcagtggtcgtcatcttggcgtgcactgctgccattcccatcaatccagctccattcggcctcgcctttcatgtccagctagttcaccttgtatacatgaagagaacacctcatctgtgctggttacttcgtcttttcattgcccattgaccaaagaagctatcgaaaggtaaccccattaattcttccaattcttcagctt

SEQ ID NO: 40662 - DNA, 738 bp, Oryza sativa
agagaaacaagtgcaaaatctcaaggacataggtattgagattgttcgcaaatgtggtggccttcctcttgcaatcagagttattgctacagttttagcaagccaagaacaaacagagaatgaatggagacggatattggggaaaaatgcctggtccatgagcaaacttcctcgtgaattaagtggtgctttatatctgagttatgaagtgctgccgcaccaactgaagcaatgttttctttattgtgcacttttccctgaagatgcaagcattttgcgtgacgatcttactaggatgtgggttgctgaaggctttatagatgaggaaaaaggacaattactagaagatacagcagagagatattattatgagctgatccatcggaacttgctccaaccagatggtttatattttgaccacagcagctgcaagatgcatgatctcttaaggcaacttgcttcttatttgtcaagagaagaatgttttgttggagacccagagtcactagggactaatactatgtgcaaagtacggcgtatttcagttgtcactgagaaggacatagtggtgttacctagcatggacaaggatcaatataaagtgaggtgttttacaaacttatctgggaagtcagcaagaattgataattcacttttcgagagacttgtatgtcttcgcattttggatttgtctgactcacttgtacatgacatcccaggtgcgattggaaatttgat

SEQ ID NO: 40663 - DNA, 19488 bp, Oryza sativa
  unsure (1)..(19488): unsure at all n locations
tcaatgataaaaaattagaagggagatttgaccatcgtgcctgggtttgtgtctccaaggagtattctatggtttcccttttggcacaagttcttagtaatatgaaaattcattatgaaaaaaatgaatcagttgggaaccttcaaagcaaactcaaagcaggcattgcagacaagagttttttccttgtgttggatgatgtatggcactataaagcatgggaagatttactaagaactccactaaatgcggcagccacaggaataattctagtaactactcgagatgaaactattgctcgtgtaattggggtggaccgcactcatagagttgatttgatgtcagccgatataggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgaccnannnaatggtgctttatatctgagttatgaagtgctgccgcaccagctgaagcaatgttttctttattgtgcacttttccctgaagatgcaaccattttctgtggtgatcttactaggatgtgggtggctgaaggctttatagatgaggaagaaggacaattactagaagatacagcagagagatattatcatgagctgatccatcggaacttgctccaaccagatggtttatattttgaccacagcaggtgcaagatgcatgatctcttaaggcaacttgcttcttatttgtcaagagaagaatgttttgttggagacccagagtcactagggactaatactatgtgcaaagtacggcgtatttcagttgtcactgagaaggacatagtggtgttacctagcatggacaaggatcaatataaagtgaggtgttttacaaacttctctgggaagtcagcaagaattgataattcacttttcaagagacttgtatgtcttcgcattttggatttgtctgactcacttgtacatgacatcccaggtgcgattggaaatttgatttatctgcggttgctcgatcttgacaggacaaatatatgttctctcccagaggccattggctcccttcaaagccttcaaatattgaatttgcaggggtgtgaatctttgcgcagacttcctttggcaacaactcaactatgcaatttgaggcggcttggtcttgctggtactccaataaaccaggttccaaaagggataggaagactgaaatttctcaatgatttagaaggatttcctatcggtggtggaaatgacaataccaaaatacaagatggatggaatttggaagagttggctcatctttcacagttgaggtgtcttgatatgataaaattggagagagctactccttgcagcagtagagacccatttctactaacagagaaaaagcatctcaaagttctgaatctacactgcactgaacagacagatgaagcatattcagaggaaggcattagcaatgttgagaagatctttgagaagctagcacctccacacaacttagaagttcttgctattgtgaatttctttgggcgaaggttccccacctggcttggtactaaccatttgtcttcagtgaaatacgtgctcctcatagattgcaaatcttgtgtgcatcttcccccaatcggacagctaccaaacttgaaatacctaaaaattaatggagcaagtgcaatcaccaagattggacccgaatttgttggctgctgggagggtaatctcagatccacagaggcagttgctttccccaagctcgaatggttggtcattgaggatatgcccaactgggaggagtggtcctttgttgaagaagaagaagtgcaggaggaggaagcagctgcagcagccaaggaagggggagaggatggaattgctgcttcgaagcaaaagggggaggaagccccgtctccaactccaaggtcgtcgtggctgctgccttgtttgacgaagttggatctcgtgggctgccccaagctgagggctctcccaccacagcttggacagcaggccaccaacttgaaggacctccttataagagaagcagaatgcttgaagacggtggaagacctcccgttcctctctggtgccctttcaattggtggctgtgaaggcctggagagggtctccaaccttccccaagtgagagagctgtttctaaatgtctgccccaatttgaggcatgtcgaggagttgggtggtttggagcagctattgctggatgaaggtatgcaggagatctctcagctgtgggtcccaaggcttcaggagcaacaccgccaactccatggagatgagcatgagctggaggtcatcgagtggctgtgagacccaattaatttagatggcgcaaggtatgtacactaattgcttgggacatttcactggaataaactaatcattgggttgtacattcatgctgcccctctgctcttcagctgtatatatgcagctattctagcatttgatagtctccttagttgttcatgtcgtgtgcattgactgattgtttaatgatttatatgatttagttttattttcatttatgctgcatgtaagcatttcatcatggtcaagattttcataaaatggtggatatacattgacaaattcattagttgtccatttctttaatcctctcgtgatcttattaacatgcgtcctgtacatacggtgtattctagataaatgaattgtcctatatgtactacaacataatcatgtgcaatagtgttcctagctctgcagacaaagatagagattacttctactccaaaagaaaattgtatgggttatatcaccaaacaatgctatgatggcattgctatattcactatatgatagtagtaatatcacaaatgcatatatccatccaaggacttggggacaacataaatggtttagcatttggtacacaggctgcataagtgcacgactaaacataatggacttcgctaggccaagagataagtaatccttaattcagctcttgaatgtgctagctatgattggccgtgtacatccttcgggatgtagaggccgggttttatttaatccattatttaaaaatgcgctatctatgacgaagaccagatcacgtgcatttagccttcaagtctgcaagtgtgttctatgtcatatcaatgtgcacatttagtactcagtatcttataaaaacacaaatacacatgaattttcgcaagacattaggcaatagagtagtttttttagatttcacaaaaaataggtcaggcccaatgttacagattccttgcagcctgtgagcaggatattgaagatggaagggttgtgcccaacatctgttcctagtgtagggctcctaattaaggtttgtttggtgaaaaaacaaaagccacctaaatgtctttgtattggttcaaattgattaatatttttgttcgtattacatctgttataagcagaggatattgccgagcgacatgcctatgtatagtccctatgtgtcttttccttatactttttgtaattcacgtatgatgtttggtaagttcaattgtagaaaatagattgttgcaaaacggatgtcacttgtattttcttttccttaattaagttatttaattaccaaattgcttatgaatatacatccatgattaatttttgtgcgcttatttgtgttgtaggttaatcttgaagaatttgggctgcagtcacctgtaatctgtacttttgtctttacctagctactggtctttgaaatatattaaaaaaattaaaaaaacaaaaatatcaaaaaatgggaaaatgtcaaaaaaaaggttatattttctttagctcttgtaaaatacatcgtcatgttttcttagatgtgtgcgtttcttttctttttattttttttattgtaggtgtgtaggtaactccgcctatgtcatcttaggtttatctgaatgacatagccggtcccaagcccggaaaaaggaggaggggataatcttgtatagatgttggttgaaatgacgctctcctactatatagtagatcattgggatttttccgtacttttatcagattaatttcattttcaatgatggaatagttatggagacacttctagagactcatccagtcttattttcaatgacggaatagtctactgctaccaggtctttgaaagttttcttgaaactgcacctttgtcaggctactgcattttttttgtgatggaataattatgaaaacactttcagaggcacatacactctgtttctctgttggacgaacctgagttggaaaccagtttagtttgagctcatttcaaccccttctttcaccagaagcaattgggctaaacccaagcaccaatcattctcctgtcagtccttaatgacaagcctgcaggacaaggaaatcaatgaagatcactgaggcaaaaatatatttatcctcccatcatgatagaaactgattgtgctttgtgaattgtgatcgagaggagaggaaatggtggataaccttcctagtcattcctttgtactgacaatgtttcagtacttgaggaaatctcagtgatgatacctcgtattgacaatcaatacctgtgttaatagatggatacaacacatctttgactgaaatttgcatcggcaatgattgtgtccaaggctctttctccaccagctgctgcttatgtgggatggaacccatgtataacttgaggaagagaagtaaatccaacttttgtttatttcattgaattcatcctttttccttttgaacactgaaaataacagcttgtatgtctttaggattggttcaggaaaatgttattatgacagtgcactagcttttcaccttgttatcccattacattgttaaattaaccatggttttattgccttcgtattttctggacggggatgcaaaccagtgtcttcttggatacttgcatcttcctaatgttccgtgtaagctgatttccttattttgcatagtgtaatgtgttctactagcaacgatagggtttgagatattcggttttgacatttcatttgatggcatttgatcattatgttcaaagatgctcactactgatgctgtagagctcactcccccaaatctgcaaccttctcatggactctgaaattagaatcgaggtttgtgttcattcatgtacacaattgagctattcagtttgaattttcatctgaatcattctgtgttcatctacaacggacaaattattcttatcgtgactgatcaacgcagcacaaagcaaagcacagctatagcgcatccagcgatgagaagaaaaagggggaggaaaacgaggggtcctgtacctcggttgtgctcgaggttctccggcgccggcgacgtgggactcggcggcgatttacctcgtcggagcgctcgctcgcttgccgtcgtcgcatcaacggcaatataaacatataatgtctccctgactcgtggggccacttgagggcaagaacgcaagaacgacgcgtgtctctcctgcttgagaactaaccggcagccgctcgccggagctccctccggaaaccccaaatctcggcgcccgtatccagaggcggttcgtgtcccgttggttcttgggctcctatcctcgttcagatcagggaggctgttcagttcttgtttatccagcggggcgcagcgaaatttacagaggaatctcaatctccaaactggtaggaagagagtttggtcgatagaagttgagctcttgtttgttcgttggtctgcagagttcactagttcagataatcatatcatcaacaccatgaattgaaagagatgctgcactgctgtttattgtgttcactgtttaattcatagcatccatcaaacctgtatctgtttgggagaatgttcgatcaatgctacagttggaatcaaattcaactcaggaccaaattcgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataacactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccaattcaacttttgtccattttcagacggtattactcttgcatgatttaattggatatattgcttacgccaaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaaactagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacagggggaatcggaaagacaacacttgctcagaaagtattcaatgatgagaaattaaaacaaagcttcgacaaacatgcatggatctgtgtttctcaggactactccccagcctctgttttgggacaactacttagaaccatcgacgctcaatgcaaacaagaagaatcagttggcgagctacaaagcaagcttgaatcggctattaaagataagagttattttcttgtgttggatgatgtatggcagtctgatgtgtggaccaatctactacgaactccactgtatgctgcaacctcggaatagttttgataactactaggcaagatactgtcgctagagaaattggggttgaggaaccacatcatatcgaccaaatgtcaccggctgttggttgggagctactctggaagagcattaacattgaggacgagaaagaagtgcaaaatctgcgagacatagggattgagattgttcagaaatgtggtgggctacctcttgcaatcaaggttattgctagagttttggcaagcaaagataaagcagagaacgaatggaaaaagattttagctaattacgtttggtccatgtataaacttcctaaggaaataagaggtgctctatatctaagctacgatgatttaccacagcatttaaagcaatgttttctttattgtattgtatatcctgaagactggaccattcaccgtgattaccttatcaggttgtgggttgccgaaggctttgtagaagtgcacaaagatcaactactagaagatacagcagaagaatactactatgagctaataagtaggaatctcctccaaccggttgacacatcttttgatcagagcaaatgcaaaatgcatgatctcttaaggcaacttgcttgccatctatcaagagaagaatgttatattggagatccaacatcattggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaactgacaaaaagcatcttaaaagtctacatctatgctgcactgaaccgactgatgaagcatgctcagaggaaggcattagcaatgtcgagatgatctttgagcagctaagtcctccacgcaatttagaagatcttatgattgtattattctttgggcgaaggttccccacctggcttagtacatcccttttatcttcactgacatatttgaaactcaaagattgcaaatcttgtgtgcatcttccaccaattggacagctaccaacttgaaataccttagaattgatggagcaagtgcaatcaccaagattggacccgaatttgttggctgctgggagggtaatctcatatccacagagacagttgctttccctaggcttgaattattggctatcaaggatatgcccaactgggaggagtggtcctttgtcaaagaagaagagttgcaggaggagaaagcagctgcagcagcccaggaagggggaaaggatggaactgctgcttcgaagcaaaagggggaggaagccccgtctccaactccaaggtcgtcgtggctgctgccttgtttgaagcagttgcaacttgtggagtgccccaagctgagggctctcccaccacagcttggacagcaggccaccaacttgaaggagctcgatataagaagagcaagatgcttgaagatggtggaacacctcccattcctctctggtatactttttgttcaaagttgtcaaggcctggagataatctccaaccttccccaagtgagagagctacttgtaaatcattgcccgaatttgaggcatgttgagatgttgggtggtttggagcagctatggctgtcaaagaatatgcagaagatctcttcactgtgggtcccagggcttgaggagcaacatcgccagctccatggagatgagcataagttggaggtcaacgagtggttttaagagccaattaattagatggcacaaggtatgtacactaattggttgggatttttcactggaataaactaatcattgggttgtacatccatgcttcttctctgctcttcagctgtatgcaactactctagcatttgatagtctccttagttgttcatgttgtgtgaattgtgattgtttaataatttatatgatttagttcttttttcattgagtttttctcccggccttccttttgtagcacgcggtactggtactgtgaggtaccagtctccatccggccgttgattgctgaggggtacgatgggtatcacgtgtggtccaaatagcgtgtgtgtctcgatatctctcgctttcccttctccttctgcatctagcgctgccgcagggcacatgagaaaaaagtcgaggtgaaggtcgaccccatcggccgcaccgccgcaggcagacgcagcaagggcgatggcatccgcaatcgtcccagaatcgtggccgctgcagttgtcctcgccagcgccacaggagttgtcgctgccgcaggtgtcatcgctgcagccgtaggtgtcatcatcgcggtcacaggagtcgtctcggcgccgctgcaagggccgtggctgcagtggatctccaggaccccatccgcagcatggtcgcaggagtcgcagcgttgagaggaatggatgaggcgccgccgcgaaggggaaaacgatgggacaaggggaagacgccagcatcgagaccaacgaatgccgccgccgccgccgtcgtattgtccgccacgcgccgccgtcgggaggaagcctagggttttgctactctgcggcacttccccaaacaaaccaccgatccaaacatccttccaaacgcgaaaatacgattatacccttccactatggctcactcgtgcttgctaccccacgatcaagctggtaccctgaggtaccatgtaatcgtgaccattcgatatgccatcattaatggatgggattttagtaccttgcggtacaaaaagaatgaccggagcaatgctctttttcattagtgctgcatgtaaccatttcaccgtggtcaagattttcataaaatggtagatatagatcaacaaattaattagttgaccatatcttttatccactcatggtcttattaacatcctgtatggtatgttaaataagtgtatcgtcctataggtactacaacatgatcatatgcagtagtgtacaaagatttgaagacagagatagagactactgctactccaaaacaaaactgtatgggttatatcgccaaaaacatgctatgatggcattgctattcactatatgtcaataggaatatcatagatggatatatccatccaatgatttgtcccaacataaatggtttagcatttggttcataggctgcaaaagtgagggactaaacatattgggcttcgttaggccaagagataagtaacccttaatttgactcttgaatgtaccagctatgatgcagaccagcttacatgcatttagccttcaatttcacaagtgtgttctatatcagatcatgcatgtgtgcaaaagatagcatttactatcttgtaaaaacacatatacacatgaatttttgcaagacattagacctatagaataatttttttttacgacaaaaaataggttaggcccaatgttacagattccttgcgacctgttagcaggatattaaacatgaaagggttgtgcccaacatctgtttctactgtagggctcctaattaaggtttgtttagtgccaaaagtatccacctaaatgtctttgcattggttcaaattgattaatattttttttcatattctatcagttaaaataagcggaggatattaccgacatgcctatctgtatatgtgtcttttccttatactttttgtaatgcatgcctgatgtttggtaagttaattccacgaaatatgattgttgcgaaactgatagcacttatatttatttccttaattaagttattaaaactgatgtctgatgtataaagtatatatacatccgtgattaatttttgtgtgcttatttgttttgtaggttgttaatcttgaagagttggagtgcagtcattcctcagagaataaaatgaaaaaaaaatcacaaaacatgaaaatttaaaacaaaaaaaaaacaaaagcatcaaaaaaaggggaaatgtcaaaaattgaaaaaaaaagcattttctttagctattgtaaaatacatcttcatataatttgttatatttgcttgcgtttgttttcttttaaaactttttttattgtaggtgtgtaggtaactccgcctatgtcatcttaaggcgtaactaaatgacatagccggtcccaagcccggaaaaaggaggaggggatataatcttgtatacttctatattgaaatgatgctctgctgctaaatacatcatttgatattttcttggaagtttctgcacttttatcaagctaatttcatcttcagtaatggatcagaatagttatggagagtcatccactctgtttaattgttcaacaaatctgattctagactattttagtttgacctcattacagtccagttttccagtaaaagcaatttggatgaacacatgcatcagttcattctcctctgtcggtctgtcctacatccttcagttatcagtgccagatcaatgatcacaagagttgatattttggagaccacaaatgcacaagtctgtttgttggaggctttagtatttttcatgatcaaaactggtgcagaaaacatctgttatcacatatcacgctatttaggttcagaacataattatgaagcacatgatcaacaaataaaaatgatgaatttaaattcatgaaaaatggaattggcaaaaaccagaaaaacagagaggcgtgcttgatgtcctgacaagaatgatttccagcgatggtcagtaattactgaagtacattgctctagtgaatctttacataatcacttcacctccatgcaagtttcttgactggaaaaaggtaaacatggaacagaataacaaactgcacctggagggggctactttatttttatttttttttgaaagataccttaaagcggatactgaactggactgaaattgccactgaatgttcgatcacattaagcctggcaggaaagcggagttctcaacaaacagagttggacaggaaatggtccagcagcaatgcaaacaagcaatgctgatccgggtaggaatgggcgagttcaagtcgttgtgtcacgcagggttcttcttccccgaggcgaagatcaagggacactggaagtggagcaagacgattaaggtcgtcgaaagcgagacgctcggcagcgctacctatggtaagaataggaagatcttacaatcgaattcagggcgttcaggtaaacactagacaaatcccaatcgccaaatccacagcatcctaaacgaaaatcaacagtgtttctcacagcaatgatctgaacgaaattcatcttcacatgcatatatatcacccatggccagcacccccacacatacatatcttattcaacaaaattacaagcagttccctgataaagttgcatattacaccaacaggttctgcaacttccatgcagctcattatcagaacatcaaacttctattgagcaggaatgaatgaatggatcaatgggtagatggtaggagtaccatactgactgtgtgtattgttaggaaaccgccggcccatgaaggcccggctcggttacccactaattaggcccatcactaaatatggaaggtggaagagggaatggctataaatagaggagtagagaggaggattgtacacttgagaatgcaatggatgaatgagaaaggatgccacaccctcatatcttgtgtctccacttttgtagaattacgcaatccctcttggactatctcggtacatttagtctccctgatggttacagcccaccttaactgaattttacatcagcaatgattgtgtgcaaggccctctttcctccaccagatgatgctttatgaccacaaaatccatgtatatcttgatgaacagaaaagaaaatcattccttccattatccaacatcgttttttattgagtccatccttttccatttaaacgctgaacagaacagcttgttactctgtcatcaggattggttcaggaatcaggagagatattatgacaaataccctagcttttccccttgttgtcccgtcatattgttgaattaactgtagttttgatgggatgctaaaaagtgccccttttggatacttcaaccttcctaatattccatgtaagctgttttcctaatttttcgcattgtaatctgctctactagcaatggcttatgtgctacatctcctgtacaggattcagaactcgagttcttgccacaaaatggttactgtacacacaaatctggctaaaattgtaaatggaaaatttcaaatgccaactgcaattaacagcagattgagttgcaattaactctcctatgctttagagttcacccccaaatcatcaaccctcttatatggactctgaaatcagaatcgagttttgtgttcagttattgcagttcagtgctctagtttcatctcaactgttccgagtaattaacaactggactagaaattattcttcccctgtactgaaactcactcactgactcatcgaagcgctcatacactctttgatgggccatacactttgggcctcgttttgctcctgccctgtgcagctgtgctgacgggccgcatgtccccgtagtatggaaaaagtacaccgaaggtccctcaacttgtcatcgagttacaaaattgtcccccacgtcccttaactaatcaaaaccggtcacaataggtcctttggtgtttttgactccggttttatcctatgtggcaactgactcagcatgggacccacgtgggtcccacatgtcagcatcttattccttcctctctctactgccctttccaatcccccttccacgggcgacgggcgtgcgcgggacggagaggcggggcgcgggcggctgggcacggcgtggccggcggccgaccggaaagaactgagcggcggcggcgggggaggagctaggcgcgagggcggtcgcggtggagccggtgccatcctcgcctcgcctcccgcacgcgcgcgtgtgcgtgcgcctcgccacaccnccgccgcctaccgcgcgctcgcagccgccactgccgagcaaggcgaaggcgccatggcggcgctcacgcaggcactcccgtccgtggcacccgtgccgccgccgtcgtgatctctctcctcatcgtcatctagttccaaggaaggatttggtctgtgtctgtacatgactttttttttgttttgctcgggtagcttggccattgttagtgaattgatggtgaaaataaaaaagagtttattgggtaggtctggtgttgccgccaacgccgtcccgcgaccaggcagcggcagcaatcggagacgaccacgctgcggcgacaaaacagaggggaacacgcagcggggaacggaggggaacatgtcgatctggccgatgtcaaggttggtgggtaccagcgtggggttcacccgctcgacggcctggtactgcatcaggctctgcagcttggtggtggagacaatccagaaggtgtcgccggcgttgatctggtactgcataggcgcgtatgcattgggcgagtgggaggggcacccacactggagcggcacaagcagcggctgccccgccgctcgcgcgcaacccctccccccaccgaccgcgtgacgcccctcccccgtcgccgcttcgtgggtctcgtcccctccctcccccacgcacccgtccgtctcgcgcgacgccatcaccgctgacgccctcctcctctcccgcctcgcagaacgcagagcagagaagtgagagagagagagagagatgaggaagggagagaagaggggaaaagagagagaaggctgacgtggccacactgacatgtgggatccacgcgggtcctacgctaactcagccgccatgtcggacaaaaccagggtcaaaaccaccgaaggatgtaaagtgaacggttttgttagttgagggatgcccgctatttggttttgtggttggaggatgattttgtatctcgatgacaaattgagggacctttggtgtactttttcccccatagtatcgtccaggcccacaaattaaatggaatcccttgctggaccatataacatgggcctacgtcgcttccggcgtacgcccattaatcggcccgaccgcaagagcgatagtctcctggatgagagaatccgccgccatggcagccgctcgccggagctccgccgactggccacggagctcctctccggcgaagatttgcatcacgtaggttcttcgagtcttccctttccataatgtgctttggctctttcatcttcttctctctgtctcacagatcagacaagttgcgcatgataccaaattagagatgctgtactgctgagtaaacttcagatactattgtgttaccaaaaattatcccgggaaagcaacacctgaattcttttgatatcaacacatatctgtttgggacaatgttagatcagtgctcctgttgatgtcacaatccaattggatgctttctaggagtaaaatgctttctaggagtaaatgttctgtgcaatattgagttcaacacttcaatcaaaccagatggtttcagatcagaggtattctaaggcatagttatcaacaacacaaacttgcagaaggactatcaaactggaggaaataaattttggtcaaatagaaagaagtcatgaaaacaagtactcatctaagcaattactccagtaattatgtataatattctatgagaaatagttacaatggcacagactccaagagtttttgaagacttcgtgatatgttcatcagccataaattctagaattagaatgcgacatgactagcaagatccaaattctccaagaatgctctgtccttgtctctattgcccggctccttcacactgcagatgcaaagcagagtgaactgattggggtctggatggtcgggtgtgatcccattctctagactctttgagataacaaagatttgctctttgtcacctttaatctccttcttgagaagtactagaagcatctcagttgcctgcagcttagtagggttcaacgtggagaggaagatctgcaagaaccagataggcatcagccatgagtaccatgaagttttgccgtgaatggtaagctgattagaatcttatatagtcatatatatttacctttcttagttttctatgtaataagtgataatagaagaattttgttgttgctgagtgtgagtgcagtaacaacatcaggttcttagaaagccctcatccaacttcacatattctactccgtattatttatagacatttagaaggggctaatctctaaaattctgtaagactttgaggtgacaaacttcatgagctgacctagaattgaaccgattacttctgcacttcactaatgtaccacaagtgttacagtacagtcaagagaaaactcaaccttcagactttcggttccaactgtgtttttgcctttttctgtaaaaggaacaacatcattatgaaccattgtgtcatacataccacaaacgtacagtatctagattttatcatgagagtgcccgtaatatgttgattcttgttcattcttgagctagaaaatactaacagctttggatggcaatctctgcattgcttgactgaacttttgcaagctcctgaatcacaggaggtagctgacagatactgtgtgtaccgcaacatggtgcaccacatcgccggggagttcaccacattgcttgacctggaaggatgtcttcttccaggtcaggattatcggtcagagacaaaccaccagtttcttcatagttcagaattacatagaaactactaaactctgaaaggtgaaagctttaaaagctttaaaccacagcgaggggtgaggaaggcatgacgcttatcttcgtgtgctgcaaccccagctgcggtcacagatggagggagtacgtggcatgcaaaggcagtagagatttgcgttatgccatgaattggtctatgtttactttgtcaacaagagtatgagatgccatgatcctatgacagaggaaacaaaactgaagcatgtgtggccttccttctctatctgtttttttttctaattcaagggcgcagctagttgactagttccacatcatggaatcttgaagccaacagtaaagtaatcacatagaagtaaactgtagatcaatcacatggaaataaactgtgaactaatcacatcgactagacaagtggacaagcacaaaacgttgggttgtggagcatagacaagtggacaataactcaaaattgggtcagcggtattaacgtgggaaagataaaagaaaagagtggttcagcacttgtctagtctgaatgttcagctagctat

SEQ ID NO: 40664 - DNA, 24735 bp, Oryza sativa
  unsure (1)..(24735): unsure at all n locations
attgatccttctagttaaccttctgaatcattcaagttttacatcggtataatgagcatacacttcacctcttattttcatctcccctttttgcagttgtagcagcacaatcagtggttctctcttgatgactggctcataatgttctgaaatcctttctacagttggcgtatccactgagtttcttttgatcttcactaatctgagtctgtcgagtatctaaagtagatgggtcagagcaaacttctagcttgtgcaagatgaatgctactatactattgatccttgttatgtgacttatgtcttttcatgctgaattatcactccataaggtaagatttgcatgcaatatacttgagtaaaacccctcaacttgtttccggttacttctttctcctcatttacctttaacccaagaagcttacccgaaatgtaaccccattattccagttctttagcttcagtatgctaacttgctcaaaactcatggcaaaacaacttattaaaaaccttaccgaaatgtaaccccattattctagatactctgaaactgattgaacttttgtccattttcagatcgtgtaattctcataagtaatttacttagaaattttggtgcatcaccatcaacgagtttctctatggcaaccatattgggttctttgattggatcatgcgtaaacaagttgcaaggcatcattacagaggaggcaatactaattttaggtgtagaagaagaactcaaaaaactgcagaaaagaatgaaacaaatacagtgctttctcagtgatgctgagcgaaggggaatggaagactcagcagtacacaattgggtttcttggctaaaagatgctatgtatgatgctgatgacattatcgatttggctagttttgaaggaagcaagctattaaatggccattcttcttcaccaagaaaaacaactgcatgcggtgggctttcacctctctcttgcttttccaatattcaggttcgccatgagattggtgataaaattagaagtctgaaccggaaattagcggaaatagaaaaggataaaatatttgcaacacttaagaatgcacaaccagctgataaaggttcaacatcagaactgagaaaaacatctcacattgttgaacccaaccttgtggggaaagagatattaaaagtttctagaaatttggtgtgccacgtgcttgcacacaaggaaaagaaggcttacaagcttgctattgttggaacagggggaatcggaaagacaacacttgctcagaaattattcaatgatcagaaattaaaaggaagcttcaacaaacatgcttggatttgtgtttctcaggactactccccgtcctctgttttgagacaactacttagaaccatggaggttcagcacagacaggaagaatcagttggcgagctccaaagcaagcttgaattggctattaaagataagagttattttcttgtgttggacgatgtatggcagcatgatgtatggaccaatctactacgaactccactgcatgctgcaacctcaggaataattttgataactactcggcaagatattgtcgctagggaaattggggttgagaaacagcatcgtgttgaccaaatgtcaccagctgatggttgggagctactctggaagagcattagcattcaggatgaaaaagaagtgcaaaatctgcgagacatagggatcaagattattcagaaatgtggtggtctacctcttgcaatcaaggttattgctagagttttggcaagcaaagataaaacagagaacgaatggaaaaggattttagataaaaatgtttggtccatggctaaacttcctaaagaaataagaggtgctctatatctaagctatgatgatttaccacaacatttaaagcaatgttttctttattgtattgtatttcctgaagactggaccattcatcgtgattaccttattaggatgtgggttgccgaaggctttgtagaagtgcacaaagatcaattacttgaagatacagcagaagaatactactatgagctaataagtaggaatctcctccaaccagttaacacatcttttgataagagccaatgcaaaatgcatgatctcttaaggcaacttgcttgttatatatcaagagaagaatgctatattggagatccaacatcatgtgtggataataacatgtgtaaactgcgacgcattttagttatcaccgagaaagatatggttgtcatacctagcatgggtaaggaggagattaagttgagaacttttagaacccaacaacatccagttggaattgagaacacaatttttatgagatttatgtatcttcgtgttttggatttatctgacttacttgtggaaaaaataccagattgtattggacatttaattcatctacatttacttgatcttgatagaacctgcatatcttgtcttccagagtctattggtgctctaaaaaatctccaaatgttacacttgcataggtgtaaatctttgcacagtttgcctactgcaatcactcagttatataatttaagacggcttgatatagttgagacaccaataaatcaggtcccaaaagggataggaagactaaaatttctcaatgatttagaaggattccctgtcagtggtggaagtgacaatgctaaaatgcaagatggatggaatttggaagagttggctgatctttcaaagttgagacggcttattatgataaacttggaaagaggtactcctcacagtggtgtagacccatttctgctaacagagaaaaagtatctcaaagttctgaatctatggtgcactgaacagacagatgaagcatattcagaggaaaatgctagcaacgttgagaacatcttcgagatgctaacacctccacacaacttacgagatcttgttattgggtatttctttggttgtagattccccacctggcttggtactacccatttgccttcagtgaaatccatgatcctcgcaaattgcaaatcctgtgtgcaccttccaccaatcggacagctaccaaacttgaactacttgaaaattattggagcaagtgcaatcaccaagattggacccgaattcgttggctgcagggaaggtaatctcatatccacagaggcagttgctttccccaagctcgaaatgttgatcatcaaggatatgcccaactgggaggagtggtcctttgttgaacaagaagaagaagaggtgcaggaggaggaagcagttgcagcagccaaggaagggggagaggatggaactgttgcttcgaagcaaaaggggaaagtagccctgtctccaaggtcatcgtggctgatgccttgtttgaggaggttggatctttgggactgccccaagctgagggctctcccaccacagcttggacagaccaacttgaaggagctccttataagatacacaagttgattgaagacggtggaggacctcccgttcctctctggtttacttttagttgaaagatgtgaagacctagagaggatctccaaccttccccaagtgagagagttgtttttaaattgttgcccgaatttgaggcatgttgaggagttgggcggtttggagcagctatggctggatgaaggtatgcacgagatctctcagcagtgggtccctgggcttcaggagctacactgcaagctccatggagatgagcatgagctggtggtcaacgagtagctctaagacccaattaatttagatggtgcaaggtatgtacactaattgcttgggatttttcactggaatatactaatctttgggttgtacattcatgctgctcctctgctcttcagctgtatgcatctattctagcatttgatagtctccttagttgttcatgttgtgtgcattgactgattgtttaatcacttatatgatttagtatttatttcattactgctgcacgtaaccatttcaccgtggtcaagattttcataaaatggtggatatacatcgacaaatttgttagttgtccatatcttttatcctctcatgatcttattaacatgcatcctgcacatacggtgtattctagataaatgtattgtcctatatgtactacaacataatcatgtgcagtagtgttcctagctctgcagacatagatagagattactgctactccaaaagaaaattgtatgggttatatcaccaaacaatgctatgatggcattgctatattcactatatgccagtagtaatatcacatatgcatatatccattcaaggatttggggacaacataaaggcaaaatttgccactggacacgcaaaaaaacgtgtaattggctgagagacaccgcgaaaacgtgacatggctgatggacactacaaaaaatgtgtaattggctgtaggacactcgtcgcattattttattatttccgggtcaaaacaggtgagatatttttctaaatgcccggattgccccttctctttccttctttaaacaccggtgggtcccatgtgtcatggacagtgtatgtttaatctaatttataataggtttttaaccacctggccccacgcgtcatggactaatttttgtaacaccctgaaaatttgaccaacaaaaatcaaagttccaaaaatatggaccttcaaaaactttttaaataaattgcatcatgctgattttgttcacctatttcatcggattttaatttcggagttcatagatcacgaataaagaatagttaattaggaataaaccctaaaattagattggcaagagaaataattaagatataatttaaaataaagattatgtgaggatagaaataaataaaacattatcacgaccatatttatatcaattaaatttaaatgtgatggaataagaattaactctaattaaattccaataaattatatataaaaataaaatatgggtaatgataatctaggttagagcaacacaaatattgtgtaaacttgatttgtgcaaaaattataaatattgggacaagatttgaataggaaaaacaaccaaataggaaaaacagaaaaaaattcactattcattgcgctgtaagtgttcgatcgcgttccctagccctaacccctcctctgccgcacgcgcctggccgccatcacgtcgccgctgtcgcccgtcgcgtcgtcgccttgcgccccgtgccgccgcgcgccgtcgccgtcgctgccgcgccgccttgcgccccgtgccgccgcgtgcgccgtcgccgtcgccgttccgtcgccgcgcgtgcgtctcatcgcctcgcgcctcgcgccgccgtcgccgctgtcgcccgtcccgtcgccgcgccgtcgtcctgtcgccgtcgcgtcgccgcctcgtgccccgcgcccgcgcgccgcccgcccgtcgcgtcgccgcctcgcgccccgcgctgctgccgcgccgcatcgtcgtcgcatcgccgtcgtcgtcgcaccgagccccgtgtcacgccgcgctgcccgcccgtcgccatcgccgcctgccgcgccgcgcgccgcctgtcacgtcgccataaggctgcccgccccgctccacgccctataaagcccgacccctcctcttctccaccccacacacatccccttcatctttcctcctctccctctcccccttccccacgcgccgccgtcgtcgtgccgccgcgccgccgccttcgagccgccgcgctgcgccgcgacttgcgccgccgtcgccatcgtcgccgccgctgcccccccacctcgcgtccaccgccgccgccgcccgggtgggcaaggagccgagagagagagagggagaaaggagccgggagggagagaagagagtaaaaaaaaagaaagaaaagaaaagagaaaagaaagaaaaggaaaaagggaaaagaaaaagaaagaaaaagaaagaaagaggaagaaaataaataggcatttgagtaaaatttagaggtttagaaaatttaaaataattagaatttaatcgtggattaattatagtcgtaaaattgcgaaatttaattatattttggtagcctctatgagtaatcaatttgcggtaggaatttagatttatttaagaactaaaataaaggtgttgaattcttaggaaaattacttaggagacacaaaatgtcttaggttgaggaatagttctatttcgcgaataatatagtggatataacaatcgactctcgtgctcgctttttgatttggtctttattggattttatttgaattcggaattcaaatcaattcttcgcacgtacttgtagagcccgagggagttgcggatccgagcgaaggtcaagacccgcaagactttgagcaaggcaagtcatcactattctttgagcatattgatcccgattgcaaaatttattttgtttacaaataagattggatgtgatgatgaacattccacttgtgaactatgccatgccttgattattgttcatctttaaatctttgtaaccataaatacgtatgagtccctagtcaactatgacacttgcttagaaatgctactctagatttatgcatgctcatactttattaaatgctatatgcttgggcaattacctttgggaagttaattgagatgcggcatgtggagacatgagcgccacattgccatgatatgatgacatgaattatgaaaataggaatgaaattaaacacttgttttagactggggcggacggtaatattgggtgatatctgggaaaggctagtaccgtccccggtcaattaaggaccgagccatgaagttaagcatgaaacgaccctgtacaaccacacttctcgtatggggatagacctagcggagtaaatagctgagcggaggcagtatccttgcatagtggtttcttgatgtttgaggatggggctctacagtggtaccgccattggtaggactgccatatgataatttagacataattataacttaatgcatgtgcgtgagtcttcccttcccgggtgcgccagaactcctctcgctgctagaaactgtgtacgcctagagtgcatgaggatgaaaagttcatagagcggatactgccgatgccaggttatcgaaaagctttgccgtgacacgtctcatgtgttgggacgaggctcatgtgttgggcagtcgcggagtgcgggtaaagtgtacatccactgtagtgtgagtaaaacaaatctattcgaatagccgtgctcgcagttattgagcaccgggacatgtattacacttagctagactctaaattcttaacttgtgtggaatgggatattgcatgatgatttttatgctgttggagccacttcctgagaggagggaaggtggacatcctcagaaaaccatgacaactcaatggcgggaagctatccttgggatcacaatggatggtggacagcaccatcgttgtttaaatatgaacactggtactaaaatttgctcagtcaatgctaggtcttaggcttgtgaaaagaattacaaaacttgctttgcgcaaaagaaccatagccatcctttgaaatacccctatcatgtgcattgttgatgtgatggcttgctgagtacggttggtactcacccttgcaaatataaacttaatcagaggccggagatgaagcttcggaggatccctgtgcctattaccaggagggtgatgaagacgatggtgctcaataggtcttagttacggtcgttgcctgtggcaatggcgtgccgctgccttaactctgctgccttatctacctctgtttttgggatgtactccggaccgctcggttcgatgatttaagactatgcctgcgggcttatgatgtaataatttgcactagactctcgtgtatgtgcatatggtatttcagctataaactcgtgtgtaccagactacttgatccagggaaatggtactgtttacacgattgattcctgttataaaaacgggggtccacaatttttttctaattagtagggtgattgctatttgctaatcataagtggggcccatatctctctcctatccttcttcttcttcctcacgcacgcgccagagtagaggaacggcgcgcggccggcgcgacgacctgagccaggacggctcggcgtgcagcagaaaaagcggcggcgctccgccatggtctcaccgccggagctcgtcccttacttgaccagagacgggacaaagacgggacggagaagcgcgggtgggtcaggatggccgtcgatgccttggctgccgtcttgtccgcggatggggtaaacgaagataccaaggaaggtctcatcgatgccctcatagccggcgatctgggccccatcatgaacacgctcatcgcagctgttcccagatctggtatgggtcctcaaggacgccggcaatctgctgcatggcggcaaccgtgcaggtgcgaggctgcccagctcgctcgtagatggtccggccaggcgccatcccgacgctcgcgcgagttcaccgtgggagacgactagaggatgagagaggcagtggcatccgcgccggaggccgtgggaaagttgctcgtgtgatgcaaggacgacgacactgtacatgggcccacatgtcggctgcatcgagaagagaggggcattcctgtcattttgaaaattttcttccctctttcggcatggaaattataaaataatgtcttcggtgtcctacaaccaattacacaacttttgtagtgtccatcggcaatgccaagttttacagtgtcccttagccaattactcgatttttgagtgtcctgtagcaaattttgcccaacataaatggtttagcatttggtatacaggctacataagtgcacgaccaaacataatggacttcgttagaccaagagataagtactccttaattcagctcttgaatgtgctagctatgattggctgtgtacatccttcgggatgcagaggccgggttttatttaatccattatgtaaaaatgtgctatctatgatgaagaccagctcacgcgcatttagccttcaagtctgcaagtgtgttcttgtcatatcaatgtgcacatttagcattcactatcttataaaaacacaaatacacatgaattttcgcaagacattaggcctatagagtagttttttagatttgacaaaaaataggtcaggcccaatgttacagattcagagattccttgcagcctgtgagcaggatattgaagatggaagggttgtgcccaacatctgttcctagtgtagggctcctaattaagttttgtttggtgaaaaacaaaagccacctaaatgtctttgtatgtgtcttttccttatactttttgtaatgcacgtctgatgtttggtaagttcaattgcagaaaatagattgttgcaaaacgaacgtcacttgtattttcttttccttaattaagttatttaattaccaaattgcttatgtatatacatccatgattaattttttttttgcggggaacatccatgattaatttgtgtgcgcttatttgtgttgtaggttaatcttgaaggatttggccgggctgcggtcacctgtaatctgtatttttatctttacctagctactggtctttgaaatattaaaaaaataaaaaaacatgaaaattaaaaaatatatatcaaaaaatgggaaaatgtaaaaaaaaggttatattttctttaactcttgtaaaatacattgtcatgttttcttagatgtgtgtgtttcttttctttttaattgttttattgtaggagtgtatgtaactccgcctatgtcatcttaagtttatctaaatgatatagccggtcccaagcccggaaaaaggaggagggtataatcttgtatagatgttggttgaaatgatgctctcctgctacatagtggatcattgggatttttttgtacttttatcatattattttcattttcaatgatggaatagttatggagacacttctgtagactcatccagtcttattgctctgttggacacatctgattctaaactaagcttgaccagaccaccagatctgagagttacgttgcaaattgagatagacaagtaggtaaaggaaattcagtgccaggcatgacaagaggcagggcaccccagataaggtgtgcaacgagacattcgagtctctgagctcatatatgcccaaagtcctgaacaactcgatacaattttgctacaagatcaaatcataacggctagatcaaggtaagttctatttttatgtcggtttggccgatctagctaatgaattgacaaaatataagtacagttacatacccactaatcaataaagacatccccatgctaaaacaagtatgaaagaaatgtgcatatccctcagtatctaaaagaaaatagttttaagttttagcctataagtttatcccacaaagattatttttacagtgaggttcactagatctctttaatactactttatatttttctccctccttctcttttttttctcctcattaatagaatacaatgttcttttagcctcctacttaatctatctttgatagctaaaactacattgttttagaaacggagggagtatgtgagtgacaggttacaacttacaacaatcattgtctgatgtgtcacttgcttcggttcacaataggctgtgaactttatgtgttgcttcggtttgttgttcccctattgttttgttgctagctgctatgcttgtcatcagttcctgtgatgaacgtggcggtctgaaactctgtaagcctgcaggtctcactctctgtctctcctcattcctgagtcctgacagcctgtggcccatttctgcatttagtcctaattaatgaatttacctagccagttgacaccatcaggagggaaaaatactgaagactctgtgaaccctgcaatctagtagtttacatgtttattcaaatgagcaaatattcaactccctcatggactctgaaataagaattgagttttgcattcatttcttgtgctcttcagttattcagttcagttctatatagtgtcaggactatcatctgaactgtttcgggttcatgaacaataactgttaagtccatctaataagttcagttattcttcccctgaatgactaatgcagcaaagcaaagcaatgctgaatcgcatccagtttatcttaatttgggttcctgtgcacacaatttgggtgaacttgtaaagttcaaatgccaaatgtgattagaagcacatttagttagttgctgatggaggtgtatagggcttttgtatgtatggattgtggtaaggcttgtcagaagttgtaattcctacctccagtttcagatacatggcagaatttcacctgatggcatttgatcgttatgttcagagatgctcagttgctcactactgatgctgtagagctcactcccccaaatttgcaaccctctcatgaactctgaaattagaatcgaggtttgtgttcattcctgtacacacttgagctattcagttccaattttcatctgaatcgttctgtgttcatctacaaagcaaagcacatctagagcgcatccagcgatgagaagagaaaaggggaggaaaacgagaggttcgccccaagatccggccgagcctcgtcgaacagcttcgcgctccgccacctatctccggcgccgacgacgtggggctcggcggggatttacctcgtcagagagctcgttcgcttgccgtcgtcgcatcaacggcaatgcaaacatataatgtctccctgactcgtggggcccacttgagggcaagaacgcaacaatgacgcgtgtctctcctgcttgagaactaaccagcagccgctcgccggagctcctgccggaaaccccaaatctcggcgcccgtatccggaggcggttcgtgtcccgttggttcttggagacttggactcctatcctcgttcagatcaggggcgctgttcagttcttgtttatccagcagggcgcaccgaaatttgcagaggaatctcaatctccaaactggtaggaagagattttggtcgatagaagtagagttcttgtttgttctttggtctgtagagttcactagttcagataatcatgtcatcaacaccatgaattgaaagagatgctgtactgctgtttattgtgtttactgtttaattcgtagtatccatcaaacctgtatctgtttgggagaatgttcgatcaaattcaactcatgaccaaattcgtgttaggcaaatattcacattcaatctgttacttcctccgttttacaatgtaagtcattatagtatttttcatattcatattagttttaatgaatctagatagatatatatgtctagattcattaacatcaactaggaaggaagcccgcgcatatgcgcgggcaatttatttattgtctataaaaagaatattaaaagaagccctatcacactatattcactgtaagaaatagatcatagattttgatagtactaaatgataagaatgtgtatcatatccaaacaaaaaatcactttgttccggttatatgtaaattcgcctatcacccctacttattattattgtcttggaaatatgagtatctttttaatagatagaattgtagttatacctaaaagtaaacccaatacaccattaatgccagaaaaagttaaatctccacatcatacccaagtgcctatgtctcacatgtgtccaaatctatatataaatatttaaaagtactgcttctaccaattaataggataaaaccgtttaacttatataagaatgcctctctaacgatcgggtgaagccgactatagccgttaaggtttttctttaatgccttaattcatggtctcgtattgatatagtcgtgctcctcaagtaggccagttaagctctattttcaatggtaacctgtaaaatcggaccacctcaaccgaataatgcatactcctgcatagtttactacaacgtagccaattgagattcatgcttggcaccctttagggaatgagtgaaaaaagatggaggtaatgaaaaaaaaggtttttttgtgtcttgagttgatttaatgtatagagtagacataatgtgtttatgatgttaatcaatggtactaaattttagtagtaaagacatattgtttaaaaaagattagtatggatcattcgactatctaatatcttcagtggcgaggatcacataaaaaatatatgctctcacgatgatcatttgctaacatatggttttgatattttttttacttgtattatacatctaattcacctatgcatgtaagtagggtttaatatgcgttggaatttgtgctaatttgttaacactatttggatgagaccaacaaaaaatagatataatgtagttacgtgtatgttttttttttggggggggggggacagtagtctctcgtacatacgtttgtttttcttttttttggacaaaattttttctaatgtagggatagggtgtacgcatgtgtactcccagtgtgcttctgcacatatttatatgagttcatatgattgtcttttaaattattagtaaaaagaatactttcgagaaaatcaatgggaagagagtggagcaaagggtggcgtaaggcagttgcatatggcatggcttgttttaccacctcagtaggagtagttgctacatttatataccctcaatttgggaaaatcttagagctggaaagaaagagaaaactaccagatgggacggataatatacacactcttttttttctttttatatctcttatctacatacttacgtaggagttgtgtacgtacgtatgcacagaactatacggtttttagcacatagggattagtttagtatatctaatttaatggttgaaaataatggatcattgatttaattgtaaactgatggataaatattttacttttttatataattncccccccccncccccccccccccccccnnnctaagtggcattttaggagtatttgtagaagtgtaggaatagtattaatnataggtgnaangcccccccccnnttgtagtccactattgtttgtagtatattgtttttatattctatttacctataatttgttgatggttgcgcacttagtatcaccctttatcttcggtgttggatgacacacgtgctcattagatatcagctatcgtttggtgcattgtgcatggatatctcgtaagtaatattatttagcgatttgtggacaatggcttgtatatagaattatatatggagataagtgaggacatatgttcgatattttaggttatgattaaccaagaatattgtatactacatatgtttagtaccctaagtaacaaatttaagattgtgttctaaagtgcttatcagattggctactctcttatttatattgaacatgtttcccgaaattgctaaacatgtttcctgaaattgctaaacaatatattatatggtgcatgttttgcaaatactttttatataaaagtttttttttagaaagatcaactaaatttatttttgctttttaatatttaatacaaaattaaacatgtgctaatgacttgcattattccaagtgcctacataaactcacccaataagcttgatctaacgaagtttaaagtaggagataaaggacaacgacacgatgtaaaaataatatatttgatatttaatttctaataatatataaataaagaaaaaacagtacataataaatttactaacctcattttaatatattagttttttttacagtatggaatgagtaatttttgagggtgctatttataactgggttttttcattttcaaaacgcaggtctaatagtgtacttcctccgtataaccttgtaagactttctagcattgctcacattcatttagatgttaatgaatctagacatatatgtgtttagatttattaacatctatatgtatataggcaatgctagaaagttttacattgtgaagcggagagggtacatgttatgtttttttctttttccgggggtacgtacgtgtgtgtgtttttttctatatagtattcgtatgtgactgggtacgtacatattttctttttgtcaaatagtgtacgtgttatggtttttttttcttctccgccggcatgagaagtgaaagaaaagcgtacacacacaaaggggaaacggaggtcagatggatacgtggatagtacgtacgctacggagggatcatacttgcgttggacggatggatcgagattttgatttccttttaagataaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttaaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttttagtatataatagaagatagatagataatagatagatagatagatagatagatagatagatagatagatagaagatagatagatatgaatgtgggaaatgatagaatgccttatattgtgaaacggagggagtaatacgtttaactgcagttctcaacatctctcgatcgacgagcaagctgtggctgctgctgcaattcggcctgcaattcaagtgcagcaatatgttgtgtgcaatttgtgcattagtgcacaagttgagaatggtaatattatttcactcggaagagatggaacagttgtgaaatgcagaaccactcggttcagagaatagtcctggacaaaaggacagaaaatggtccaatggtgacaattgatcatttttacagtgaatggtgagcaactgatcagcatcgaccatggtgaagctgaacctgataagtcgacagcactaggggtgatgatcctagccacccataaatcctttcttgtatatttcctaacatatataagtcagcaagtcaaatgttcttatcgttttctttagtcgatggttcatcgattctgacatcaagacaagaagccaacatactgctagccatgttcctttcctcttggctcacatacggccatttgaatggattagattcagaaataatacaatatctcgtctttctttcttaattacttacatgagttggccggtgcgcaactctgccgccggctaccgcctgctgcgcagagatgcaagtgggtagtcccgctacccgtataaaaacccgcttgctagtatatttttcgtatggtagtacgaaatttagaagaaaaaatgaactagaagtaggataagcgggacaaaaaaaaaagcccgcttgcccggcccgcttgcatccctatgctgcgcgccaggttgagctcctcggccgcgagcgtgccccgggtccactacgctgcagctctccctccgctcgcgccttccttcgtgcccgatagatgcgaccgcgccctctggactccctcacccacctccgtgccccacgccggtcaggcggccaacacgcgcctcctccgccattgtcgacgtttgatgtcgcgattccggtatttgcatagtatggggatcgttggtactaggatatacgcgagactgaggtaaaagagatggggacgaggatttttatataggttcgggcccctgaattgtcaggtaacaaccctacatcctgttggccgaagccggtattactcttattcaccataatcacaccagtataatatgtggggtagcctatctaattgttgtcgacatggcggtctgaaggtctgactcgtagtcgacaacagggtaatcttcctcctcgaatccgtgcccggcgagatcagagatagcgctttcgtctctcccgacagtatccggagacaccgtaggggactagccatgcttatccctgaagttgatatccaacgtcttgtcttggcgtatgttggcttgtatgttgtggcttctgttgttccgtgtcccctctcctcctagggggccttgtatttatacccataggtgtctccttgtcctagtagaactagggaaaccaatatggatatagtccgagtaatccttgtcgtttccatgtagaactctggttgtctttccttatccagaactccctccatatctgaagtcagtttccgtattagacatggtatgtggtgggtcctgccgagatgtagtcgactactattaggtatgtggtatccataaccctgatagtagcccctgacttcaatgcaaatgaacgaattcatattctcgaccactgaccatggagtaactgttatcgagctcaagtgaccattctcggtgagttcagagataacgttagacttcctttatcagcctcgtgcgggcacctaaagggtttgtctcagtccatctccaacgtcaaccaagaaagtacagaacattcgactaagtctcccgtcttgctgtaatcgagaatttggattgaagtcaagaaattttatctcggcgggtacaccatctcttcaatccgtattccttgccgagatccaccaactgttctcgagcgatcgagaaggcgtagaatctgcgacggagccttgtcaacatttgtcgtactcgccttagtcgatcttggtgtagaaccatagagacatggagtcttccacaacgtcgaatagaattttcctgaaatcaatactcagaaaagaatatcaaatagaaatagcccccgggcgaacgctcaaagggtgacatgttatagtatgtatggaaaactgaaaatgagttaaatttacagaccaatgttttgtatatgagcgccttctctcttaccgacttcgatcagtcagtttgttgagtcatacactctccctagcccccagccttgtcgtcggagaatcgttctcggaggagaaggctcttggacccttgacctgccttggttgaacaagcactaattctagcccccagtcgtgaagttggaaaatccaatttccgattacacggcttggttaatacgcacggcgagaactcttacacgaccagatcttacgtggtcttttgtctctacaggatccgacaaggccttatcggctctaggcgcccccagccaaagttcccttaggttcctcggaggccttgtcaagacggcgtaaagggacatgaggataggtttcaatgctaggtgtcgtcatggtaagggatctctaggtaaaacacttagcaatattgtgtatctgatatcaactttgttcgagtagaggtaatgggagaatcgctacaccgttggtcaaaaaccagttgtagccccaactcgaccacttgaaacaaaggtagtgggagaatcgctacaccgctggtcgaggaccaggtagtagtcgtaactcgaccacttaaaagtggaaatagtgggagaatcgctacacctctggtcgataaccaggtagtagtcttaactcgaccactagaagtaaatgtacgagagatcgctacgattaactggttgagaaccagtgagtaggtgtctctcgaccatttggagttggtacgagggccgttatgctaccggtcgaagactagtcgtagctgtccctcaactatccgaagtcatctgaagtcgtggtgcgaggaccgttacgctattaccatagttgtacctcgaccatcaggatttaaggcacgagagatcgctacgtcctactggtttgagaaccatgagtagaattatctctcgagcaccaatggaagctgcggtgcgagagattgctacggtttacaggttcgagaaccagcgagcgagtagaattatctctcgaacaccaatggaagtttgcggtgcgagagattgctacgtacttgttcgagaaccagcgagcgagtagaattacctctcgagcaccaatggaggcgctagagttggtttattacatgtgcatctcatgtggccagcatgactcacatacccaacttatagcatatccggatgtccgttcgcaatcatgtcgggtgatcaagccgacgacgttcgcgaggaattatccgttaacaaccttttctcgagtagctcagccatggctggtgtcgcgaccgagaaaattaccttttcccgaacgctagtgtattaatccccgtcccaggaaaagccggggtacaccacacaaacatgaaacaaaaggcacatctttattatatcgataatatttacattattacaaaggcacttcaggcatgacaaacaaaaataaacagcagcggactagcgggcctacggctccatcttcacaggcgctcaactggggtataagccaggactccacctaagacttcttctccaaagcttctgttactgaagggggaaagattgagcaagaatgagtacaaccacagtactcagcaagtcacaccggaaatgcataattaatgcaagggggtacaaggggataataatataggggttaagttttgcagtaaacagcatttaaaagtcatttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaatcattccacattttagttattaagcaggttttaagaatttaaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgactttgtccatctccatccgtgtacttttgtttataaccagactgagccacaaactaagccttacccacttgacatgtggaagtacggtagtgctttgcaacagaggcccgaagaccgaggtgctgctaacaaaaccatgcaccccgagcccagcctaaaaccattttgagggttttgaatagagggagaggtgtgcatccaattccacaataatccaaccattccatagtgtccaagtgacatgaatattcccaaagtctagagttataaaaccacctaatgttgcctagttaatcagcgaagcatctacctaaattcatactagtggaaccatgaatagagtatccactagctggggttttgtttattctagggtgaacaaggtaataataacaatagcaataataatgtcataacgaaggtaaataggcatggctaaataaaacagtgataacgcgggaatttaaataaagcggtaatgcattaatttaaatcaaaataattttataaactgggattcaatatgctcaagaataatgtgacttgccttgctcaaagagaacggccttccgaaccttcggcgacgatcgcgaaccacgcttcgggaacctccggaacgacagaagctacgcgaagcacacaagcaaagctacaagcctataaagaagcaataacaatacataaaaagaaagcacacggttctttaggttataataaacattaggagacttgaacgggtcgattcagagttcgtatgaccaagatatgatcatccgaagtttaatgctgttatatggagatttgcggattattataattaggctttgcaactataaaacatgtgaaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaactgaggcgagtagccgacaaacggactccactagacaccacgcgggctgcacacgtggaaaccacgtggctaccgagcgggcacactaacacggacactacacggtcacttcccgcacacgtgaacgactaccgacaccggtacacgggtaccggggtcgacaaccgcacaacgggtacggggcgacaacgaaaggacaaggacggggcagcgagaggacggatccttaccaccacacgacgaggcgagggaacgacaacgacgaacgggcgcggcggaggcggccgggaacgacggagacgaacggcgaggggacgacttcggtggcgatccttggacaaaggcgagacgcggccggcacgaggcttgacgacgcggagccgaggacgaagacgacgatggggctgctgcacacttgacgaaacgcgggcggcgaacgcgatcggcttgacggagggacgaacgccacgacgatgaggacgacgagaggacgacgacgacgacgaccggggccggcgaggagacgacgagggcagccggcggcagctgcatggagacggggacgacggggaacgcgccgctgcgaatccgacgacggaggcggcgccgcgagacgacgagccggcgaggacgaatgatgacgacgacgacgaacaccggcggtgttcgggtggaggggaggcgaggccgagggcgaccttgccgctatgatgccggaggtggtggtggcgcagcgagccgacgagccggggaggaggaaggggcggccgaagggacgccggcgacgacgaggatggagaggccggcgcaatgcttgacgacgcggtctccggacgaatcagagggcaggccggggtggaggtcgacgcggcgacgccgagggaggagacggcgcggccggcccacacctgagcggcgcggcaggggcggctggaggcagtacagtggcggcaacgccactggacgacggcgggaacgcgcctccggcagtcaccgcgcgaaacggagggcaggctgtcgtaggctctccagaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatggttacacatagcaaacacaactaagatgaaagaaacttaagacttacaacaacttaataattacataggccgaccgcccaaatagacttattagagaacagcggaagcttgactacccaaacacaagcacaccgactaagggtataccccattaagttctcatcctagaagaagcaatcggaacccgcatcactcaaagactaagactaaacctgcaaacaaaaggttatatcaaacagcaagagtcagtacattaaacaagttaatgtactggcaagcacaagtcaatcctaccatactacatgtaaagcatatattcaaaggaagacaatatgtagctcaatttcagcataaagcaagttttgtttcgcaattcttttgtaaagaagttgatgcttcaattaacaaaacaagttttaagttttaacattaagtttatcataattccatcataatcaatctcttgttgtcatccttgaacaacaagtcataatatatcatcacactcacacaactcaacacgttttatcaatttcaaatcaagtcacatgttcacattttaaatcataaagcctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagaatctagccttacaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcataattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtataaaatcacattttacacattttagttcgcaaatacccatcatattcattttattccagcaaaggttcaagtatcaaaatcacattttaattatagatggaatgaacatttgcatatttctaagcatggctaagcaagtaattgcacatagagcatatataaacccatttgagcacaaagagtgtactctaaccatttctaggggtgttcaaacagcaagagggatnncaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccactccttcaccgattatgcaattatctagataaaggacacgatatccaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatactttggtaaagtgatttttactagattagacttcataggagtgtgaagttgtgttttctaagactaacacatttggtttcacaatttttggagttataatgatttctttatgcattttacaagttataacgtgttattggtgtatagtgttttatatgttcatgacttttgagttataggttcagaacatgctacttcctgtataagttgaataaaaggaataatttggttatctaaaacatttttagttcacatgtttatggtctttactagtatggttcatattttataaactagagatgctctaatctaaactagcaatatattatattaacctagaaattgttatatgagctaagttcttctaagttttagtggatgaggatggaactatggcttcactggcaatcaagttt

SEQ ID NO: 40665 - DNA, 9162 bp, Oryza sativa
tatggcttcactggtcaatcaagttttaatttaggtttaattagacctaaagtgtatatatatacttatacatgtttatgtattaattaaacaacactatgtgtttaaattcttatttcactaagttaaggttttgatcaatgttctctacagaaggtgccaaattttattttactatgttgaagataactatttgctggttctatagaaactttgttcatttcatttggactaaaatgaattttctacaagttttacaaattaatggctgctctatgttagtaaatccttatatgaatatttagagacttttactacacagcaagtatataatattatttcataacttggaaatacttgtgttagtgatcctacataacttaagtttattcaaattgaagctaaattgggttctacatgaatttctaaagtttagcttatctaaaactagtcattttaaagataatagttttagaggcttttaatgcaaagtaagtaattacttttatttcacttaatcagagattgtatgatgatgaatgatgaatctgtagaatttgattttgtttcaaaatgagttgaaatgaattttctatgtattttataagtttgtacatgttttatgcatgacttatcttagataaatcttagagacattatttgtacagtaagtgtcaagttttatattcctggaataaagttcataacttcaagaatctacagaaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgatgtttctaggaatcaacccgcagtcctaggcccatatgtcagttactaacattttgcgcaaaaacctctggtttctcgggaaatagatcccgcagtcccctagttttaggtttgtatgcaaaacaatgcttgagttttagtttatttacagattattactggtcctacttgtaagtgactgttccagttgttaatacatccctgggagtctttaaatttcaaaagccatgcccttgctctggacagagcagagcagcagcacagccgtgagcttcacagcatcaccagtggcgaacaatggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcatgtgggttttgaggctcgatttaatcgtgcatgcgtatgataaggactctagggactactaggaggctcaccaagaatcaaacgcggctcggcgaagtcttggcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcggcggcggccagagcacgacggtgttccgagttgacgcggtcgcgttcccggagattggctgcactaaaagaggcgttcttggtggcgttagagacggcattgagagggaattacagaacgcttattgaacggaaatggagctcaccggatttcgacggcgtcgaggacttatctcaccggcgccggagttggcacccccgttcccggcgaatctgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgttttcttttagttgtctgcttcaaccgattaatttgagatatcaacatgagtgttaacatgttaccaaattacagaggacaagtttgtgctaatcactgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccatatgttatcacccaagattaactataggtttgtttagtgaaataattcttttagattatgctcatgggatctattatggaatgcaagaccaaaactccaaatgcacaaagaactcgagcctaggcatgcattatgtacatgtatgcttgatgacatttctagtctaatgttgggaatgaaaaggttttattttgttctcaaattttaatcatgcaatggtttaagttgatcatcacctaaattaaaacggaaatttttggctctcgaaatttggagaagttaacctctaactattttgacaagaaatcttaagtcctaaaatttcgggtatgttacacaggccgggggagaggaggcggctgcaacaccggggaaggcgacggcacggccggccggcgcacggtcgaggagggagaggcggtggaggcgcccggcgcggaggaaagagaagggcgacggcggggaggtggctagggaccacgggagaatgcgggagggggctaaaactggagaacggatcgagggggttccattttataggagaggagagggagccgggcacgggagagggcggaacggcgacgggaaacacggccggcggccatggaaagcggccggggaagacgcgggcgttcccggcgattgggggcacgattcaagggggaaattggggggaattgaagaggattcaatggggattaaaacccccgaatcaattttggaattagccaaatgaatcagcggatttgagggaggaacggcgctagggttcacgggagagggaggaggccggctgggggaggaagacgacgtcctggcgcgtgggccccacgcgggcgcgcggtcagcacgtgtgcaacgcacgtgcgcgggaggggagcggctcaggcaggggcgcggcgtgggccgggcagccggcccaggaggagaggaggggaggggtggcccggggagagagggaggaggagggagtgggccggggaaggagggagggcggcccaagagagagagagagggggaaggaaaaagagagggaggagggaaggacttcggccgcgggccggggggagagagggaggactttgggccagacttggcccaaaggaggaaggaggattatttttaggtttttctttttaataaactttgataattgtttttgttgcttaataattattttcggtgctctgaaaattcaagtaaaatttgagggctccttttagaccaaagagaatttaacaaaaattctccgggccacatttgaatttttcttgtacgtattttagtgtttgccaatttcttttcgaattttaaataaattctattattccttttagagaatgatttttaattcgggatgaatttatcaggacgtgacagctggtgctatgagataggtcatcggtcttcgttggtaggttgggcgcgacgattctgcatttgtcgagatcgttctcaataatggggtgtactcgaccacaacctactcgagtgctcaattgttcctgaaaaatattttctagaaggcaagaaatatagcagagaatatcgagtatgtactcaaaaaactgcataaatcttctagtattatcaggatataacgagcagatgtaaatatcaggcattacgtgaaccgtaaacaagcttgatttgtacaaaataaaatagagcgagcccccggcattaaaccgtagtcggtttaacatcagggacactcgcacaacagatattgtacaaaaagcatgctctaggtaaacataattgatctgacaatatctgaaaataggtacggtaaattgtatataaaatattgcgtacctttgtagatatatgccggatatatctacggaataagtagatcaattaaattaattattccactaattaccttaattttccttggccggtcaatgcacagaccgtagctctgtacataccaatatgcatccgtatgcataggcatgtatgtgtacagcgtacaggggtgctggtcacggtagagtgcatccgatgcatgcgaggtgaagtcgggatctcgtcggaagacatactccggtcgggttagatcttcccacagccgaagttatcgagcagcttgttgttggagaatccatctcttaaacccatctcgtcgaaatcctgaagcaccaaaatccccctacctggcgcgcctctgtcaacgtttgatgtcgcgattccggtatttgcatagtatggggatcgttgatactaggatatacgcgagactgaggtaaaagagatggggacgaggatttttatacaggttcgggcctctgaattgtcaggtaataaccctacatcctgttggccgaagccggtattactcttattcaccataatcacaccagtacaatatgtgggatagcctatctaattgttgtcgacatggcggtctgaaggtctgactcgtagtcggcaacagggtagtcttcttcctcgaatccgtgcccggcaagatcagagatagcgctttcgtctctcctgacagtatccggagacaccgtatggggttagccgtgcttatccttgaagtcgatatccgacgtcttgtcttggcgtatgttggcttgtatgttgtggcttctgttgttccgtgttgtccgtgtcccctctcctcctagggggccttgtatttatatccataggtgtccccttgtccaaatagaactagggaaaccaatatggatatagtccgagtggtacttgtcgtttccatgtagaactctggttgtctttccttatccaaaactccctccatatctgaagtcagtttccgtataagacatggtatgtggtgggtcctgccgagatatagtcgactactattaggtatgtggtatccataaccctgacagtcgcccatgtaaccctagccgcgcgtgcgtgtgtgctgtggggaagcggcacgcgggcgtgtattggtaaataacagtggcagataagtcttccctctctaaatttatttttttattttcttctaaatctattcctcacagtgtgaatacaatagggctagacggccacttcgattttgaaaaagagggtcaaatgaacaaagttaaaaatatagggtcaaatttatagttagactttaaaatagagtgaaaaaaagcaattgtctctttgtcgttttccatatatatggtcgcaaacatttcagggctagcccagccttggctggccaatcaaagtttctacaattctctctcagttctatcttggtatatcagatcctcatcatcaagagatatttttcttaaccagcagaaaaaaattcgtccccatcttcgaatttggacgaaatacattgaaatgcttttaaatttagcattaataatatcttcaaatctgtccaaaaaacaacatcggtagtgtgcacttagaatcagtggagaatggacaagaggctagaaaacaacccaatggttagcattgatcataatgaagtgtcaagtatatatatggaagttagagttatatcagatataattgatttctatcatagtcttactagtcttacttatttttaatcttttcttatttctacctaagcatatattctacatatacaattgccctgaggcccaatacaacaaatccaatattcacaatatatgtcctcccattctattcaacacgaacctgagcctcatatgtcgacatgatagggttgatgaacatatatactacttcctccgttttataatgtaagaatgttataatgtcgacattatagcattccccatattcatattgatgttaatgaatctaaatagatatatatgtctagattcgttaacatcaatatgaatgtgaaaaatgctaaaatgacttacattgtgaaacggaaggagtattagacatgctttttaccctctctagtggtcgccaccctccccagccttttccttttttctttctcacttttgtaatctcttagccttcacggctattatacagtattttcctctcctttaatacaaacacaccatgctggggtttaaaaaaagacagtgatagagtattttgttgaacttagtcacccataattccagctacatttatcatcatagaaggaactttcatgcatatgctgccataagtcaataagtcaacgtttttatcgttttgtacaatggttcatcgatgctgacacctgacatcgataccggccggcaacaacaaactgattgcaactagaagggaaaatattagaaacaagaagctttagctttgttcacctacctactataccatcacgagctttaataccgggtagcaaaccttcccatatttatatatgcgatttcattcatataatatatactccctccgtattttaatgtatgacgccgttgactttttgacaaacgtttgacctttcgtcttattcaaaaaatttatgtaattataatttattttattgtgacttgatttatcatcaaatgttctctaagcatgacatacgtatttttatatttgcataaaattttttaataagacgagtggtcaaacgttggttaaaaagtcgacggcgttatatattaaaatatggagagagtataagccaatggatgcatggctttgtcatgtggatgagatttagctctccctcatctcacctcaggcccgtcaactcgtctcaggctactaaatagtagtgtagtaccttacacgaacttcacaaatctcacagccatctcctgtcctctttgtgcaaccgcatgagagcccagcaaatctcgtacagtatatggaatcaccaggagtgcgctgatcatcgtcttcctcacgatgggggatgccatggttagctgcacaaaaggcatctctccagtgaggtgagcctccctcacgacatacgtccacttgaacattttttttgttcttgtttaaaattatgtgtagcgattatacttgtgttcttgtatagcaattctacaaaactaaaggtactatttgattcaacaaaacctgcgaacagtatccaaaggggggcaaaattgaaggggaaaataaggggttgtatgcacgatgagtttttcttctttttgcacaatttacaattgtacgatgctttggtatagtaggagagcctagccgttcaaaagcatcttgcataaacagaaacttttaaacaaactacccttgctaaggctcatcagtacgctgatcaaatgtactcggtaagggatgcatggatattttcaagtggagctaatcatcatcttcacggttgctttgagaaccatatgactaagccttatcatcaagtatacagacaatcgacatgccttttaagaacttttttttgggtcatgcctgataacttctaccttacgtactacattatttgtgtaaggcacaatcacatggagttggtggcattatgctctcatgagaacattaaatttcatcaacttacatagtacggactatttacttccaagttgtgctccttgcatccttgattaatgggaacaactcagctcatggaatctcaaagtaaatggatcacattgccaactaatattagcaatatattactcctacatctcatgtcttgtcctgttcaatacacctaggcacttgacaattggtgacagttgcagttttccatgttgctaattactcccttagaggggtacatcagagtcaacacaatggaaggggaaaaactaaaaaagcatcggcgactttgtagacttgtatgcagtcttcatactttataatgtctcattgtacgttcttgatgtgatgcaagaccggtttctctctagtgtccagccatccctctgcttaatacagagttcatctctcttaacattgaaaaaaaatagagttcttctctcttcctagctcttctcttgatttgtccatgttgaccatgtcgccgaagatccatgatcaacgtggccatttctgttcttattgaagtttttttactgaagagatcttgttgttgggagttgggacttgggagggaccaatttttctgaacatatagcactctccttcagtccttctgcagcactctgaccaatggcatgataatttgtatccatatttccggttatttctcttattctctggttcatatggcgtaaccttaatttcttcttttccattgatgtgttttacttctaaccattggttgcaccagctttctattaatgaacttgcaattcacctgttcttttatttttcttctctttgcaggtgatctcaggttttatcttggtggtttcctgctgaaccttctgctatcgatccatcgaaaaatctagtgagttgatagttgcaggaaactgatgctatcaatccgttgaaaaatcaa

SEQ ID NO: 40666 - DNA, 14571 bp, Oryza sativa
cttgctgtgataccggtattttcttgctgctgctttaatttgttgtatgcaaatttggtgattcatgtggattcgccaatttagtcacaaacatgtgattcacggcacaaggaaaaataccgttagtagaggtaccagtgaccaagtttggtttagggtttcgggttcagccattctagctctacatctatataatgtgcatacacttcacctttcttttctttcctccctttgttgcagttgtagaagcgtggtctatggtttcctcttgctgctggactcataatcttctgctgtatatatattctgtactttggctcattcaatcaattgtgtttggtcttcactaatctcactcaattgagatttgaagtggatgtgttggtcatgcaaactggttacgagatgatggctagcaactatttttcgagatgaagagggaattttgttaataattcagaataagagtacattcttcaggaactatttgctctatagaataaaaaaggaaatcaacatatcaatatcaacggcagaacgttttaaacattatgccaattgtgcaacctcatgagcaatgaattatgttttcctcatcatgatccggcaggacaattaaaccaggtaattgttcatcaaagtcgatgaggcaaactaagtaactttgcaatgtttgagcaatcaaacactaatattataggttgcttgatccaatcaacaggaagagctgaattattggttgccttgtctacacgttggccattcaacctgtatatgaggcctgcaaaattattattactatactttttttttctgctgaatgaaaacagtcagtaaggtaaattttgcttgcacacttcaaatatcgtattcttttctcttcatgatcttttgagacttcctttcaaacacatgagttttacaatattttcaaagaaattagttctattaccacagttcatgtgttccaaaaggaggctttacgggatgaaactagtagggaggtgtttctacatgacgttaattaccacaatgcgaagtcctgtcacgacttgtagaaatgttttttatgatactcgaagattgtctagactagtcatttcacactgatccaacagttggcattttttgaatcatattacgtcctatgcaaatactcactacatttctaaatatttgacaccattgactttttagcacatgtttaaccgttcgtcttattaaaaaacttttgtgaaatatataaaactatatgtatacatattagtatatctaacaatgaatcaaatgataggaaaagaattaataattacttaaattttttgaataaaacgaatgatcaaacatatttaaaaaagtcaactgcgtcaaatatttagaaacggagggagtaggtcttaaaaggaggcattacatttcaaacttgctattgtaagcatggcgacccaaaagacaactataatttttgaaataacgttatttggcacattttgaaattttaattacaaaatacaactgtaattttcacaaaatatgccaattctgttaacatcacttggcaaattttgtgaaccttctctaatttttcactatgttaacagaattggaattattgccagcctgcctttttttacattcatctggtattttggccttggtggatctccccgtttgtgtttgcctgatggcggcggtattagatgctttgattgtctcatgcatcaagaagttgcaggatatcattacagacaatgcaatactcgtgctaggagtagaagaagagctcagtgaactggtgagaaaaacagattacatacgatgttctcttaatgacgctgagacaacgaggttggatcatgaagcagttaataattggcttggacaactaagagatgttatgtatgatgtcgatgatattattgatttggctagatttaaaggaagcatcctactagctgaccatccttcatcatcatcaagcaaaccaacacgttgcaattgcccttcgtgtcattgtaatatttggacacgtcatgaggttgctgttaagattagaagcctgaacaaaaagatagcgaacatttcaaatgatgaactacttcaagatctcagacgtagaccgcatccgagaaatggttcgatatggacaccgataaaaacctccagcatagttgaacccaaccttgtgggtgaagaggtcatacttgcttgcagagaattggtggatttggttattgaaaataaggaaaagaaagattacaagcttggtattgtagggacaggaggagttggcaagacaacacttgctcagcaaatatataatgatgaaaaaataacagggaatttcgataaacatgcatgggtttgtgtttcaacagacagcacacaaacttctctattggaagaagttcttcggatcatgaaaattcgatatgggaaagcaaaatcagttgaagagctccaaaacaagctcaaatcagccattaaagagaagagttttttccttgtgctagatgatgtatgggaatctaatgcgtggactaattcacttcaaaaaccattgcatgctgcagccaaggggatagttatagtaactacgagaaatgaaaagtagctcaggaaattaaagtggaccatacccatcaagttcatttgatgtcagaaaatgtagatgggatctactttggaagacatgggcataaccgaagagaaacaagttcatcatctgcgggacatagggattgagattgttcaccaatgtggttatctcccactagcaataaagatcatcgccaaagttttaattagcaaagagaaaacaaatgatgaatggaaaaggatattgagcaacaattcgtggtccatgaataatcttcctgatgaactaagagctttatatctgagttacagtgagctatcacaccaactgaaacaatgttttctttattgtgctatatatcctgaacattcaaccattaaccgtgatgatcttactagtatgtgggtggctgaaggcttcattgatgagcagaaagaccaactactagaagatacagcagtagaatactacaatgagctgatccattggaacctccttcaactagacctttcatattttgacctaggtgggtgcaagatgcatggtctcttaaggcagcttgtttgctatttatcaagagaagaatgttttgttggagatccagaatcacaaaatggtaatacaatgagtaaaatgcgacgtgtttctgtggtgacagagaaggacacggtggtgttaccaagtatggataagaagcagtataaagtgaggacttacagaacttcatattccaagtcactgagagtttacaatccacttttcaagaggcttacatatctccgtgttttggatttgactggcacacttgtacagagcatcccaagtcacattggaaatttgattcatatgcgtttgattaatcttgatgggacaaacatatcttgtctcccagagtccgttggtaaccttcaaaatcttcaagtactgaacctgcaaaggtgtaaatctttgtacaggcttcctttggcaaccacgaaactatgcaatttaaggcggcttggtcttcttgatacaccaataaataaggttccaaaagggataggaagactgcaattccttaatgatttggaaggatttcctattggaagtgtaacttataataaaaaaatgcaagatggatggaatttggaagacttggctgatctttcacagttgaggcggcttgttatggtaaaactagaaagatgtactccttgcagcagtgaagattcatttctcctaacaaacaaagaacatctgaaagttctatatctagaatgcactgaaccaacaaatgaagcatgttcagatgaacatgttaaacatgttgagaatatctttgagcagctagtccctccacagaacttgaaagatctatctattctgagattccttggtcagaacttaccctcctagctttgtaatgtctatctgccttcactgaaatatttgatcctctctgattgcaaatattgcatacatcttccaccaatatggcagctacccaacttggaacgcctgaaaattgtgaaagcaactgcaattaccaagattggacccgaatttattgggcaatttccaagatccagggaagcagttgctttccccaagcttgaatggttgatcatcaatgatatgcccaactgggaggaatgggcctttattgaagaagatgagatatcacttgcagcaatgaacgaaggaggaggggatggaactgctgtggccgaagaggaggagatatcacttgcagcaatgaatgaaggaggagaggatggaaccactgtgacggaaaagggggaagcctcatttccaaggttgtgtgtgctgccctctttgaagaggttggacattgataactgccccaagctgagggctctcccacaacagcttggacacgaggccaccagtttgaaagagctctcccttgtagcagcaagctgcttgaagtcggtgaaggaccttccatccctatctggtttcctttctgtttgtagatgtgaaggcctggagagggttacagaacttcccaaagtgagaaagctgtttgtaagtgtttgtccaaatttgagctgtgttgaggagttaggcagtttggagcagctatggttggatgtgaatatggaggactcatcaccgtgggtgcatgggcttcgagagcagtaccgccacctggatgtctacacgtggcctagagagtgagatgtgaagacccaactaaaagacagtagattagtagagacacaaggtaagggcattggctctgtatttgttgatacatatttttattctatcgttatctaaaatagtggaaacatattttaatttcattccaactttgcatattttcagccaaaatcatgcatgtctaatgttattctcacctgtacactttacattcattgatgttgtacactttgcatcattcttagtaaggagatcatcatatatattagacaaaatgtcaaactttcggtagttgttatgattaatatttgtacctatattactgaccttgtcacctaaaactagtacagaaatccttaaaactttgtgttgtaattattctcaatgtccataaccagtacagaaacaagtgttatagcattttataatctattatatcctaaagtacattaaacctcctacaaacgcttctaagccatcacgtagcactcctacgaacactcctaagcctccacatgacattctaataaattaaagaaatttctaaaaattccgagaaaaacaaaaacatcttgtcatttatctttattaaatctggtgaacccatcatttacaaccattagatctagtcgtcaacccgtgcgttgtatgggttattaaaatatttaagaaattcaattgtacatgtggttgaatacatgggttaaaatgattattttgcttaaaaaaatgttggaatggcggcattcgggcatccggtctcttgtactttaccatgatttgacttggaaaacagtgagggaagtctccacggttcggatataatgatgattaatccaaaactaattaattaattcaattaaaaatactcaactacagtaccatgactatagctggccaaatgggtggcccggcccaacacgcacggccccactagtggcacgacccactaaggcacggcaactgtagcaggccgtgcacgtggcccataaaaaattgaaaattgagggaaaaataatatgaagttaaaaaatgaatgaagacaggacaaacgtgaggaaaatttaggaaatatacgaaatatattagaaaatatatggtaaaaataggataaaatatgaaaaaaaataaaaaaatatgagaaaaatatgggaaaaattagaaaattgtagggaaaataaatgggcagctgggccgtgctcgtgccgacccgtcaacaggcatgccgtgccgtgtaagcccatgggctaaggtgctggcccaagcacgacacggacaaatgggccatgccggcacagcacacagtccgcccaacatctgttcctagtgtagggctcctaattaattaaggtttgtttggtgaaacaaaaaagccacctaaatgtctttgtattggttcaaattgattaatagttttgttcgtgttctacctgttaaaagaagaagaggatattgctgatcggcatgcctatgtatagtccatgtgtgtcttttccttatgccttttgtaatgcacgtgtattgtttggtaagttcaattccagaaaatatgattgttgaaaaactgatagcacatatattttcttttccttaattaagttattaaattaccaaaatacttatgtatatatacatccatgattaatttctgtgtgcttatttattttgtaggttgttaatcttgaagaatttgggctgtgcagtcacttgtaatatgtatttttgttttacctagttattggtctttgaaatattaaaaaaattttatttttttaaaaaataaataaaacaaaaatatcaagaaagggaaaatgtcaaaaaaataaaaaatatattttctttagctcttgtaaaatatattgtcatgtttcgttagattttgcgtgtgtgtttcttttctttttatttttttttgtaggtgtgtaggtaactccgcctatgtcatcgtaggtataactaaatgacatagccggtccccagcccggaaaaaggaggaggggatagtttggtatagatgtgtgttgaaatgatgctccgttgctagatcattgggaattttctgcacttttattagattaatttcattttcagtgatggaataattgtggaaacatttctggagactcatccacccttattgctctgttggacaaatctgattctgaactatttaagctagcttgaccagaccaccaggtctaagagctgcgaattgacaagtaggtgaaggaaattcagtgccgaccatgacctgatgaggagcaaaaatttttttcaagtcttggagcccaaatgtgcctgaagtcctgaacaacaagatacaattttgctgcaggatcaaacaattttgctcctctcatttgtttcttgtctttacctagttgctggtctttggaagattacaaaaactgaaaaaaaaaagagtgaaaagaacacgaaaattacaaaaaaaaagtcaaaaaagggatacagatccaaaaatgaaaaaaaaaacgtgtttttgttttttgtcttgcacgtgtgtaggtagctcctcctatgccatcttgggtgtgcatctttaatggcattgctagttccaagcccgaaaaagagaaaattgcatatgtaccatcgcgtaaaattggcttcgtaaaaataccatcacttaaatgggcttcgctagaataacatcctgaactgagtacacttcgccactttaccattttcatcatttcttccattttaaatttattttatcatctttgcatctctttttggactgaaatacccctaagtcatcaacgctgaagcacttctggtcccaagcccggaaaaggagcagggggtaatagtgtatagacattaagtgaaacaatgcgctgctgctatctagagcagtgaaagttctcttgaaaatttctgcactcttgtcaagttaattgcatttttattgatggaatagtttactgaaaaacacttctagacactcatccactctggtgctctattgggcaattctgtttctaaactattttagcttgacctcattgcaaaccagttttcatgtgaaagcaatggaggcgaacacattcaccagttcgtcctcctctcattccctgcatcctgtttgagaattgagaattgtgaacactgcggtgtggaggctgcggttcgtcagaagtttaaattcctagatccagtttcagatacttagcagcatttcacctgatggcatttgatcgtaatgttcagagaatgttatctcctaatgctttggagttcactccccaaattttcaacactgtcatggactctgaaattagaatccagctgtgttgcgttcattactgtaagagctctttttttttttaaacctaagccagcattgctggttttatattaagagagggagaaactgtacagacaagagacatcgggcccgaaacccatacagctgcatggttaattatggggaaccgacatcacagaggaaaacatgggacctaactacactactaacaacaacggcggagcccaaacgcaagacatcattgccaagctaaacacaaaagtggcacaacagctccgacatcatagaagaggtgttatcgttgccgagctagccggccaagcaacccagcagcgccgacttcaccactgcagcgacattgaagccacggaagttgccaaagcgaaagcagctccgacatccacaatggacatcagccaagccatgaaagagccacttccttcacatggccagcaccaactctttggaagagaccgcaacacgtcatcgttgtcaagcgtcgccgcaccccagcagcgagcagctccgacttcctccgtagaaacaaccgaagagtgtgtcgcccaccacaagagcgaagcgaacccaagaggcttaggcctcgccaagcaccaaggaaagaaagcttttgaaccgaagagaccctcaatagtcatcgatgtaaaggaacttccccgaagcgacgcccccaaggaggacacgacgcgtaacgccgccgccgctcgtccgaagccggagcaaggttttcacttggagatttgtggggcaaatgggagagcacattgacaacgccttcaagaagggaaatggcgccaatgggtgcgtcgtcgtcatcgagccggccaaaggtacagcaaggctttcgccagcgtctgcacattacccacacaagcacccccacatcgacgaccaaacgatagtccaagatgactcacaagcattccaccctcgacgcatcctaccatcgcccacactcctctgctgcaccgaccagaaccggccaaggcggccaaggtactggtcgtcgaagctccccgctgccatcgcctccacgagcacccactccccgctatgccgctgccaccgtcgccacaagcgcccgcagccccgctgcacctcgtcaagacgccagtgggcgtagctggaggttgccactgcgccgacaagggcctcgcatccgcctcctcgcagcaccagacccccgccgtcgccggcctcccactgccgctctggcgagggcacactggtccccaccttggcagcacgccatcatccagccaggagggtggtggatctggccaagggccaccggatccgaccgcccccatcgccgggccgagggccaccgccgcctcgcggctgcctcgccgtcgtctcgcggctgcctcgccgtcgtctcgcggccaccccaccgccgtctcgcgtggccccccatcaccggccgagggcctcgccagccggggcccgcgtcctccctcgtgccgctcgatgcccctctccacctccgtcgcgacgctagcccgctggccgaaaccgtgggtgagggggccagatccggccacggaggcgccggatccgccgccccaaaccgatcggccgtctcaccttcggctgcgccgtcgtcggccttctccgtcctcctcacgcagaggacggttccaccgagctgtacgtttgggccttgccgccgccttcccggctcaccactggctttgccgccggcgagcttcggcggcggcgaggtggaggagggggatgagggtgtggcggcacgggtggctagggtttcgcccccgagccgcccgcgtgagagcgacgcgggggacgcgtcctcctttcatcttcctgtaagagctcttcagtcattcagtttagtgcacagactttttagggcccctttgaatcgcaggattgagaaaacataggaataggaaaaacgtaagattttgataggaatgtaagtgtaaaacagaagattgcaaaacgcaggaaaaacacaggaatgaccgtttgattgaatcgcaggaaaaacacaggaattagatgagagagatagactcgtaggaaagttaccaagaggttgaagctcttgctaaatttcctccaaaatctctttaggattgtccataggaatttcaaaggattgtatatgattcaatcctttgtttcgaagggcttcataggaaattttcctataggattgaaatcctccaaaattcctatgtttttcctccaattcaaagaggcgcttagtgtcatcgcaacaagttcatctaacaggtacaaaattgtcttcccctggatgacaaaatgcagcagaaagcaaagcaaaactgaattgcattcagcgacgggaaaagaaagggaggagtgagaggtgtcgcttacattctctggtctccggcacgaacgccgaggtgggggctcgctcgacggccgcgcgcgctaggagctcgaggatgacctcattggctcgtcggatcgcccgctcgcagcaacgcccggttcccttctccccatcgcctctcgctgaagctcctgccgtcgccgggtcgccgtcgctcgcaacgacaacaatacgagataactcgagggcctatacgaaaataaacccccagttcacacttcacaggcgtgtttaaatctcagccgcctatatcagatcgaacggtgcagagaggctgaggttttggatcgctcgaacgaagagattttttttttgacgcaaaaggtagagactaccttataaccattgcattaatggtggtcaaatcagataaaatctggtaaagccgaacaagagaacagaggggggagaagaaggaaaaaacagaaagaaaagacatgagaaaaaacagaggtacaagggagaaaaacaggaagaaagaaaaaaaaatacaagagatacatagatacaaaaggggagacaagatggttaagcgaatttgaccacccaagcagtaatgtgtgctcgaaggcaaggcttgaggcaacgaagagattttggtcgatagtagttgagttcatgttcctttgttggtctgtagcgctcagtgattcacatcatctcaagacatgaatcaacctattttttttagataatggataaaatccggcctctatatccaaaggaatcaacctatttctgtttgggagaatgttagaacaatgcttcccgttgaagtcgcaatccaactagaaatgctttttatatgcagcttgtagatagatgtgcagacaagattcagttcagcacttcagccaaactgtattcagacaagattctattatcaaaagacacaacagtagtccccacatgtgacatgtggaccaaaaggagtgaagtagtatattgtaggagtatttcaaaaactcccctgtagcctccccacttgggtctaattttattttacaggaaccgtaagcaaaccctaggattttgcttatacaaggtttacctaactataccattgatgatagagacacttacattcttgccctttcctaacccgccctgctccttcacactgcggaggcaaactttttttgaatgactcgcacgagattacaagattacaaccctggagggtcgtaaccaggaaaaagaaaaaaaaccccacccacacaccgacatcgccaacacacaagcccaggagaaggctagcaccggaccggccgccgctaagtatgaccgaccgccactaggccgacaaagggacactgacgagatcgccccataggggtgccaaaacgatgtcttcaagaagagaagtgacggaaaagccgctgccgccgtccgtcgggactcgaaggagccaagactaggctttcgcccggcaattacccttgggggatgaaacaacacgacaacaccctcaggagggagaacctcgttgttggttcgaccaaggccggactgagttttcacccgccgctcaccacctgcaaatccacggctgacgcactgatgccccaccaccatacaagctctgccgacctgtgggacccctgcactggtgtccccagtcggctagccttcgagcgccgaagatcgcgccacacccaccagcagattctcctcacacctaggtcgcctcctccaccgtcagccgcgcctctcgcgccaagccggcctcctccaccggacacgcctctcgcgccaatccggcctccctccatcggacgcgcctctcgcgccaatccggcctccctccatcggccgcgcttctcgtgccaagccggtcaccgacccctctaccaaacgatgtcgcgccggccaaatgtagccatctcccacgccctcgtcttgccgtccgaggccgccatgcctccggtgaccgtagtcatggccaccaccaccacagccactgctgttgaacgcaaagccacctcaccgtcctcatcctcacctcgcacctccacttgctgccgccagtgacccgcatccgccgacatcgccagcgcctccacaggctatcgcagaagatcccgccgccgccgggtcaccgtcgatcatgacgacaacaatacgagataactcgagggcctatatgaaaataaaccctcgattcacagtcacaggcatgcttaaatctaagccacctgtataagatcgagcggtgcagagaggctgaggttttggatcgctggaacgaagagattttggttgatagcagttgagttcgtgttcctttgttggtctgtactctgtagagttcagtgattcacatcatctcaagacctgaatcaacctatactatctctgtttgggagaatgttagatcaatgcttcccgttgaagtcgcaatccatatgctttctaaatggtaaatgcaagtagcttgtagatagatgtgcagacaagattcagttcagcacttcagccaaactgtatctgttggacaaatctgattctattatcaaaagatacaacagtactccccacatatggaccaaacacagtgaagtagtttcccagtaaaatcaattgggatagacacatgcaccagttcatccccctctcagtccttgcatcctgctgtttgagagttgagaattgagacacaagttaggcaaaggaaatcattcactgtttgttagcagtacgtacaaagtttggccagatacacaaaaacgcatgaaaacaagtatacttgtaaacaattactcctgtaaactccaatatttgatgagaaatatttctgtatgtttactcgtgaaacctgtccattggattcaacgctaaaagttttgatcccaagtatgcaacaggactggaaataagccccgaattctcatagaaacctctgccgttgtctctgtcaaccagctctttcacaatgcaaatgcatgcctaagcagagaactggttggcgtcaggaaggccaagtgagattctgttctccagacacttggagatactacaaagatttgatctttctcatcttttaatcgccttcttgagagagatcatctcagttgcctgcagcttctagaaaaaaaaaacaggtacaattcagcgaggagagggaaggtcagcaagaagcagataggacacagccatgttccagaaatcagttccaactgttagccttttttttttcctgtaaaagaaacaactgcgttaccactgtcatataggccagaacacaacatcagttagatcttactacggagctagtgcccttgtttggttgattcaggttcattcttgagctaaaaagtactaacagtttaggatggcaatgtcactgcattgcttgactgaacttgcaattccctgaatcacaggaggtagctggcagtagagctactgcgcgtaccataacgtggtgcaccacaccgcccggggatttcacccaggtgctccaggacgtcgccggcgaccccaccctgccccgcaccaagtccgtccggtgcgccgcctgcggccacggcgaagctgtcttcttccaggtcaggattatcgatcacaaccaaaccaactagtttattcagagttcagagttaatacaaaagatactcaactaacgcaagttctgcatattctcaaaaaaaataattctcggtttcggttcagatgccaactgtgattaacagaatgtgtagttgcagatggagtaataattcggggtatctttgtgaacattgcagtggagaggccgcgccaggggcaacgcccggttcccttctcctcatcgccggcggcagcggcggcggcgtctcgacatctcttcctcccttgtacaacgacacgacaacacgagataatacgagggcctaaacgaaaatcggcccacggattccgaggcgcgtctaatctcagccgcctgtatatgatcgaacggtgcagagagaggctgtggttttggatcgctggaacgaagaaattttggtcgatagcagttgagttcgtgttcctctgttggtctgtagcgttcaatgatgcagagatgccgtactgccgtttaagcttcagaacctattgatgttatacagtacagatacgagtaca

SEQ ID NO: 40667 - DNA, 3770 bp, Oryza sativa
  unsure (1)..(3770): unsure at all n locations
ttgggatttatcggcaacattactctttcagacatagatcatttattcaattgcgatttattagtttgaggggtttttttattccgataaattttcgttaccatattggcgcctgttcgttttcgctccgttttcggtttcgataatattcgattccgttttcgtatccgaggtttccgattccgattccgaaaaaaaatatgaaaacgaaaataataaagatggtttccgtccgtttccgtaccgttttcacccctagttaggggtgatgagcggtgccagttgccacccaaaatcctttgaagatgagatgcactactctgtttcaatcataactagcatggtggcccgcgcagatttcgcggtaattccgaatttttctgtaaattgtatttctatatagactctatgctcttcttccaatattatttatttttatttctgaatttttattatttctaattgtattcctatatggactctaaactcatctttcaatattctttaatttttaatttcgaatttcagttacttctaaattgtattcctatattgactttaaactcttcttcccatatttttcttaatttcaaattttagttatttgtaaattgtatgtttatacggactctaaactatacttttaattttattctgtttattccaaattttagttagtttaaaattccagtatggactctataatcaacttctaatattcctttttttaattctgaatttctattttttttcttaattgtatttctatatggactctatactctacttctaatattccttatttttaattccaaaattgtattatttcctaattgtatttctatatggactctatactccacttctaatattccttatttttaatttcgaatttctattatttcctaattgtatttttatatggactctatactccacttctaatattgcttatttttaattccgaatttcagtgatttgctaattgtatttctatattgactctatactctacttccaatattccttatttttaattccgaatttcagttatttgctaattgtatttctatactgactctatgctctacttctaatattccttatttttaattccgaatttcagttatttcctaattgtatttctatatggactctatactccatttctaatattccttattttttaattctgaatttcaactatttctaaattgtatttctatatagactctagtctcctcttctaatattacttattttttaattccgaatttcagttatttctaaattgtatttctacatggactctgctttttctttttctctgattaatgtgagaatttctaggccatgagagtgaacgtggaggcttctttttctatttctttaataatatgatagattttggaaagattctggtgacctcctgcaagttgctctgtggggaggttgctgcggctagggatgtcttaataaccatgcttgctgtatacatgtactaaaaacttctcctcacttaataatcggccagcgtacttttgccagacatatgaaaataaaatactttcagaaagatataaacaatgataactttgtaccagcatcatgtcatgtcaagaaatgacacaacagatttcactcctaatattttctttaatgagacatgggaatctttttattagcatgatggagaaaattatgtagcagaccctatatagacaatagaggaacggtggcttctggaatgtcaaaaccgatgaattgtcttttctgcaatttggcgaaaaacaaactcctaatgcacactgcgacagacagggcatatcacctaacagcatcttttgtcatgtccagcactgctaaaggctgtgaatactccaaactaaacgagctgcaccaatttcatatccgtcttctcctctctgccactgcataatctaggtccagtatatcaccaggaacgtgctcatcgtcttccttgcagccggtgatgctgtggctgtacgcacctaaggcctctggggactggggtgagtctttcttctttgccatatggacttaatatatcttctgctttcccttgttcaattcctgcttcctgtcatggttggagtcgatcgagacgttggctcactcagtcatcttcttcttgtactccagcagaagacgttgatccggctcatttcagcctcacacccagcaacacttcgccttccatgcttaagcaaaacctctcaacttgttgcccatttcttcttcgtcgttgcccgttgacccaagaagctgtctaaaggtaatcccattgttctagttctttcagatttaatatgttctagttctagttcttaccatccacatgatgccctcgccaagtcaccatgatatcatcatccaagatgaattggaactttgcacaccaaccaaataggggtagagggatcactgcactatatgaaatttacagcggttagtatcgaatatgattttatgaaataattgccttcttccgttcattttagtatgttagactgtgtattgtttgctgttaattagttagtcttattctcaccagtcctatatacaattatgtaattgtaaaagataaaccattctttagttgtagtcccatattaagagtagatacactacactacacagaaaaaaaacatacttctatgaatacctcacatgataagaatgtaatacttttagtgttggttatgtacctcatactgtgcatgatttgtccctagaactttagtttaagtatgataagctaattattgtattaatataaatggcaattcagtagttatacccatggatgtctattttatcaatacaaaagttttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatggctgtgatgctgaggcaaggaggatggaagagtcagcagttgacaattggcttggtcagctaagagaagttctatatgatattatgatgttgatgatattattgacttggctagatttaaggggagcattctactaactgatcatccttcatcgtcatcaaggaagtcaattgcttgcactggcctgtcaatttccacttgcttttctaatgttcaggcacgtcatgaggttgctgtgaagattagaagtctcaacaggaagatagaaaacatttcgaaggacagagtatttttgacactcaagagtacggttcctactggaagcagttcagtattgagagtgagaaaaagttcccacctacttgagcccaacattgttggcaaggagatcatacatgcctgcagaaaaatggtagatttagtgcttgaacataaggggagaaaactttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40668 - DNA, 1030 bp, Oryza sativa
ccttttcttctcccatccattgcagcgaggaggaacaaacagcctcatctccccacctcgactcgacaacaggaattcgacccgtcaccggcatcctcgccgcacggcacggcacttactcgtccatgccggaagtggaaccatctgtctttttttctttgcttttttttcttctcgactcatccatgatggaaccatctaccattctaccttgatttttcctctcatccttcttttcttctcttatttttttcttcaacttagtccatggcggaaccatctgccttttttttctcatccttctttctttcctttttcttttctctactcagtccatggcggaaccatccgcactgatttttcctctcactcctttcaatcacggtatcctctcattatcacaagatttatggcctcctccgtccatactaatcggcatcgcgtagagcaacgagcagttaatcgccggcggcgacggatcgagaaataacaacacagccaccgggcaccagctgaataaaggtcgtggcactagtagtggtaccgcggaagaacacacaggtggcgctggcggcaaggaatggcgtcagagaagatgccgtcgaagaacactcacgcggcggcgtgccagcgaagaatcgaggacgatggcgagtcaacaagcagttcagaagcaggggcgctcggcaaatcgattcttttttcccatcatgccccttttgattcaatggttggattttatttggtacctagcagtaccagtacctggagcgtaaaaactctcatatatattaggacagcaaattaaaccgtttgtttgtttgtttgtttgtttagaaaacatgagaaaaagattatggaattcaaactatgattgtatctacctaacgataataatccaatcaccacaatttcaccaaattttgattgtagaaaaagtataatatgtttagataacttgagacactgcttaattgaagtgcaaaaagtgaaaaatatgttaatagttcaactgtagggctgcaggaat

SEQ ID NO: 40669 - DNA, 704 bp, Oryza sativa
agtggatcccccagattttaaaagaatagacaaaaaaatacaatggtatttgcctttaccactgtaggcttgtgcatcgagagtcaggattagatcccctgtaaatgaaaagcatacaaaacgcaagagaagagagatggggcggagataagatttgtggtgttaaagcgtgaatgatagggagagaggccagagtcattgaatgcttctattttttaagcattctaagtcggttttttataggacaaactctccctcgtacattcgtggtgaacgttcccccacccccacacaccccccgttttcacaaaccgatgcctaacatgcttgcgtgcaaacatcgatagtgcgaagtttttgaatttgaaatgaagagctggaattcatgagcagaagtatcaagatttcgctgtacgaaaatataaatgcagagacgctcagggggtgctaaacaacaaaaactgaacgaatgcacgcatccccacgctgggctcactcttcccctgtttccgtgccaaagatgagcatccgaagcaaaagagcgtagcgcaagaggaaaggagtagacaaaaaccgacaagcttcacgtttcggattaatggcaccgaggcattttcccagcacccaggcgttcgactgacgccgacggggccaacggcatttacgcctagcaacaagcacacacagtgctgcttaccctacag

SEQ ID NO: 40670 - DNA, 725 bp, Oryza sativa
catcactatcgcatgatttttttagacattcatttttctattttatacatattccatcaaatgttcaaggtgcagtttatgtagcaagtgttgattaaaggcctactactgaataaatatagttgtacacttgcatgacactgggctatccattagtgagctttgaataagcgcaataattgtgaagtatattttctagtcattttcatgttggtatgatgagaaccataatggttgcaactcttgcagaattcggcaatatccgcagcagctgataaacttgcagagtgccaagaaacaattacaagcctaagcaagaaactgcaggcgctaaaatgtccagcaaatgcggatgctgtagacaaaagaaagtctgataacttgcacctgttagttgcaaatcagaattttagttctcccccatccatagaagcagcatgcaagaaagagaacgatgaacgtgttacaactgaaaagaaccttctacaggagcaagatgttggcactggccataaagttgataacaatggttcaacacaaatcgctcctcgtcccgtgatccccaagtcgccactaaccactgtttctgttgatatgaagaagaggaagaaaaagaagcagggtgggagcttgctgagtagactcatctttgggaagaaggcataaaacagctccttggctgctagcctgctacgctcctctgattaactgctagtgcatccagc

SEQ ID NO: 40671 - DNA, 708 bp, Oryza sativa
gccgcgctcgggttctccgcgcagggcacttcgcgcggttcacggcggtgagcaagctcgcgctccgctgcgcccggggctccgggacggacagcctctccgacgacggggcgcgccaggtggccgccgcgctgccgtccgcgcggctcgccaggctcaagctccgcggcctccggcagctctccgacgacgggctcgcgtcgctcgctggcgccacgccggtgatccgcaagctctccgtcgcgtcctgcagttttgggcccaaggccttcgtcgccgtcctccggtcgtgccccctcctcgaggacctctccgtcaagcgccttcgcggcctccctgacaccgccggcgccaccaccgccatcaccgaggagatcctcttcccgcccgcctcgtcgctgcggtcagtctgcctgaaagacctgtacagcgccctctgcttcgtgccgttggttgcctcgtcgccgaacctccggtcgctcaagatcttgaggtgctctggctcctgggacctcccattggaggtcatcgccgcgcgtgtacctggccttgttgagctccaccttgagaagctgcaggtgggtgaccgcggcctctccgctgtatcggcatgtgcaaaccttgaagtcctgtttcttgtcaagaccccagagtgtactgatgcaggcataatcagcgttgccgagaaatgtcacaaactgcgcaagc

SEQ ID NO: 40672 - DNA, 4884 bp, Oryza sativa
gcattttccttgaaccacggtcgttagcactctggcatgtttggaggacgaggtagcatctgagcctgcggcgtcttgccatccttcacgatgaacatagtgtccatcccccacaccacgtgacgatcaaaatggcaatgcatgaaccacacacctgatcaatgaacaatcaaaataaacacaaaaagaatatttaaaactgtacatgaagagctataatccgaaattaatctgaataattgatctcacctggattgtctgctcggaagcggattgcggcccagctggacttgggcacggagacagtgttctggaatggtgggtcgatgaggttgtaggtggctgggtccctgcgctcgtcgaaggttccggaccctcgtcccacgacgtagaaggtgaagccgtgcaggtgcatagggtggttctcgatggacaagtcctggaacaccacctccaccacagtgccatattccagcaccttcaccttggtgccacgcttcgttagcaagggcccgccgccgttgatgtcgccggtggggttgacgatgaccgtcagcttgttggggaagttctcctcgtacacgccgcggccggagccgtagtagtaggcgtcgaggacgtcgatagccgggttctggaagctaacattattgaggctcgccgcgaaccggttgccttggggtccctcgcacaatttatttgtcgcattgttagcgtcgcaagggagaaagttgatgtcaatgtcgatgagcatgtgctcgtccacctgctttggtacgtgcaccgggtggtcctggttgcctaatgacctgagctgcttgacgaacgccatcgccgcgtcctcgtccttgatggccggcagcaggacggggaattctggtggcccgaccggcctcgccacggcactgtccgtgtactccacgatggccgtggcggtgctattgttgaaacggatggtatcaaccggtaacgtgataaacgtcctcgcggccatgtaataccggctgttggatcccaaggtgcggttggccttgaggagcacgtccatggtctggcctggcgcgatcatgatgtagtcgacggtgatcggcttggtgtagcgggcgtcgatgccgaccacggtgagacggtgccccgcgatggcgaagaacatgtcgttggtgagccccgcgttgatgaccctaagcaggtacgtgttgccctgctgcacggccaccttgaacgtgtcgtccctggagcagagggggaacatgtccccgggctggccgttgatggtgttcgtgtcggacggctccacgtctccgccgatgcgcttcgccttgtcgagcacgtgctcaacgtcgtcattccaccactcacatgcacaacatcatatcatcataaacgattaaacgatggttcagatcaaaacacgtacttacgaagcattgcatcgcatcgcattgcaggatggaactaacattgttaaacaaaattgattaccgaggatgacgggtatctccttgtctagcttcctgaagaggaaggtggtgccgcgcttggggtggatgacgatggcgccgtggacggttgcgcggtcgaagtcgctgtgagcgtgccaccatagcgtgccttcctcctcgaacaggatcacctggtaggtgaagttgccgcccggccggatcgggcactgtgtgatgaactccggcccgtcagaccacgggttccgaggctggtccacaccgtgcctgcgccacagtaaaatcatccagaacgtacatcgtaagtttaatttcgagccaaggatcgatatataatgctcttcttctctgcagcaggtggggcaacggaccagtggatggtgatgtttttgttgccgttgttgtggacgttgacgatgatgaagtcgcccttgcgcgcgtagatggtcggcccggggaactgcccgttcacggtgaggatgctcttctcgtggcagagcctcgtgtagttggtctccgtaatctgcagatagcatcacgcatggttaaaagttaaaacttcgtgcattcatgctgcctgtacatcaacatatccatcacgctagaattcaagtagataatcacttacgaagaaatcgtagtggcgagtcttggctccatgagcggggttcactgcaagtgctaacaccaggcctgctagtaggaaccaaagcaatgcaggtatcttggctgttcccatctcgccgaacgcatacaattcaatcgccaacccaagcgtaagaacacacacagctaattgagattcgtgtgcgcagtgccgtaagctgctgctttgcctgagctgagatggccatctggccaatgtatttataggaaacgcatgcatgcatgaatatggtagttgtatgtatgcattgcatgctgctgtggcgatggtgtccagcctttggaccagccacggaaactgacgacgacatcttgaagttcaaagtatctctccagtctttcccggacatgcgcatccgtttcctgccctgcgtatttacataatcatcattagatgagttggttaacttaattaattgggcatatggagtagtcgaggttgttaacgaactgactaattaatcaacgcggaacgaaattgaccttgagcagagcaggcactcatccgtgtttcgtcgtaccctgaagcactcgattaaaggtctcactaggcacgtttgcatgcattcggcggctaggaagattgtcgattcgattatcatatattgagtaggtggttgtcgtgatttcgtcgtagcctagcgaggtaagtaattaagcatgcactcgatcaaagtctcaaagggcatggtttgcatgcgttcggtggccaggaagcttcttttttttaaaaaaaaaaaattaaagaaggcccgccaggaagattttgaaatagactatatcaaacacagaggcccttcttttgacacatctctggatcttaaaattgagtattcttaacttcaaaattacatggatgtatatttatgattacgtcaataatgtatggataaatcattgtttacattttaggtgcattttaaaattttaaatcactattgtcgacgtttgatgtcgtcattctggtatttgcatagtatggggatcgtcggtgctaggatatacgcgagactgagataaaagagatggagataaggatttttatataggttcgggcccctgagttgtcaggtaataaccctacatcctgttggtcggagccgatgatgctctttattcaccataatcacacccctacaatatgtagggtagcctatctaactgttgtcgacatggcggtctgaaggtctgactcgtattcgacaacagggtagccttcctcctcgaatccgtgtccggcgagatcagagatagcgctttcgtatctcctgacggtatccggagacaccgtaggggaatagccatgcttatccctgaagtcgatatccggcggcgtgtcttggcgtatgtaggcttgtatgttgattgtgttgggtgttgatgaggtggtcgtcccgatagtggtgatcgtgttgatcgtctcatggtgagtgtgtgtcctcctgtcctcctaggggggcttgtatttatacccataggttcccccttgtccaagtataactagggaaactaatatggatacaatccgagtagtccttgtcgtttccatgtagaactctggttctttcctcatcggaactcctcctatatccgaaggttgtttccgtataggacatggtatgtggtgggtcctgccgagatttagtcaactactattaggtatgtggtatccataaccatgacaactataatttaatatacaaactttaaatttatcgtggttttgagatttgaagttgtgccaaacaagatttaaatatctttctcatatttatttacaagttattggaaggaagttttcaaattgatctagtgcaaaagtgaagatacacaacaatacaaacgcaagattttttttatcaatatatttatgttactataatattatattaaaaaataattcaaattttcaacacgcgtttacacttacactaaaaaatcgtttcttgcacagtgaacaaatcaaaagccctgaaaattaactgtaatccactaaaaatatgtcaacgcaattttagtttttcctcacaaataaacaccgaaatttctatacatctatcgcaagattttttctttagagatcttgcaatttttttgaccattggatttttattgagattcatgctaggaacctcccagaaaaatgcaaacgcacgagagaagggagtcaacctcataacctcaaggtcacacgggttgttttcgtcggatttctcccgagttacagttaccagcacgggctctcgctcactactaggagaacgtttttccctactgtcaaatccgatttttgtgtgcaggtgggcggtccgcacccacccaggggtctgcgaaaattgtaatttttgtgtgcggcaacaaaaatccagaaaaaatgaaaaaaaaaaaatgaaaacctagaattcggcggtggcgccgccgcctcttccttgtcgtcgtcctcctcctcgtcatcctcgtctttggccgaggacgccactcccgtcctcgtcatcgtgggtggcggcctccgcaccgcccgccatcggctccgcgctcccctccggctgcaccgccgctgacgcccctcccctccaccggatctaggaaggggaggggaggggaggggagcgcttgcccgatcccgcgtgggggagagcggccggccgccaaatccgtgctcccgctggcctccgggctccccttcgaccgcaccgccgtcgacgcccctcccctccgccggatctggggagggaaggaagaggaggcgaggggagcc

SEQ ID NO: 40673 - DNA, 13110 bp, Oryza sativa
cccgggtttataagctcatcacgcgtgcagtccattaagaggaccacatggaaaaaatcgatttttccgtgcggttctcttaaatggactgcacgtgtaaatgagcttattttcccagacgggaacaccgttatggtccgtctgaaatctaaatgggtccatatccaggaaaatcattttttaagtagtgtcagcctcagatcgcttgccagccatctatcccattcactggcgtccgccgccgccgctatgctcctcctccctggccctgtggtcccgccgtccctctcaaccctcgtcctcccccacacctcatcggcatcttcttacgccaccgtcgccgcatccacatcctcggacaacaccacagcctcgtcctcattctccgtggaagactacctcgtgaacaggtgcaacctctacctcaatgtgtcgtgtcacaccggagctctccaccatcaggtcaccttccaggcccgacgccgtgcttgcattcctcgccgaagagctcgggctctctccgcccctcatcgccatcaccgtggctcgcgaccccaagattctcacctgcagtgtcgccagtgattgcagtttcagttcgaaatttctctaatttcggacccctccagcaaaatcaatatatcaattaaaattttcggactttatcaaatgtttgttgaattcggtcaaagtttattcaaatccagtcaaaatatgttataattttaataatttctgatctaaaaagtgccgaaaatcatgaaatttttgtaaatttcatcctaccgaaatcaccgaaattttggctgaaataaaaaatgcaaaccccgagcgtccccaagatactcaagccctgcgcagccgtgctcggcttcaccacattacagatggacctcatcgtggcgcgctgtagcgccgccttcttccgctcaccgacgctcctcgttaatgtccagttctggctcgggtacctccgcggctgcgtcgactgggaggcctcaccaacgacgacatcggctggttctgcgtctcctacgcctccaagctgctcgtggcagcaccagatgtagccaaggctgtcctagtgatcgccgacgagttcggggtgccgcgcaggatgcgaccattcaaggacgtcattgtcgcagcgttcctcttgaaaccggagcatctcgcctggaaggcggccttcttcagggacgagcagagctcgggtggacggaggcgcaggtgaagacggcggcagccaagataccgacggtgctgatgctgtccgtggagcggctgaggaagaactgggagttcctgaccaaggaggtcgggatggacgccgagcgcgtcgccaacttcccggtgatgctcagttaatacctggacgggaggctcgtgccgcgcgcggttccgggtggtcagcgtgctgcagggtgcaggcttggcggctgtggcgcggcagggatttcatcaacgtcgccaccatagtagaggaagacttcgtggccaaatttataaggcctttcttggttaaagactccaacttggacaaggtttatgaatcaaccatcgctgagaaagaattgaagaacagcaaaagcgtgcaaccatcaaaggctggagtgtaatacactgtgaagccaaggtatatgcaagctagatagctactgcttgtaggtgaattttgctccaatttactaactgttaatcttcatgtgtggtcataaaactctcaaagctcaaaacgctgcaattgctattgcgtgactgtgaccgtcactaaatgctggcaaatgacaatactaatcttccggaatgacagtacgttggcgtgctctaatcggcagcgtcctccgtgttgctcgatcacagcctaagtcaaatcagcttacgcttcggcctcgttttccgattctgcagcagaaaattctcttctttaatttacgcgagatttggagtatttgctagtatcatcgtgtgtggttgactgtccatatctgtattttgggaatcacggatgtcgccggcgcgatgcgagaagcgcgctctgtcgccgccgcggcgcaaaatccctcgcaagtgcaagcgcggccgcacggtcggcgccgttgccccaaatggtgccgcgccctggatggagtctccctgggcgtcactggatggagatatcatccgccttgtcgccgagcacgcgctggctggcgacgtggcggattacctccggctccgcgctgtttgccgccattggcggtccagcaccgtcagcccgcgcggccgcagcgtcgtggacccgcgcttccatccgcgccggtggatcttgttccccgagagccatggcctcttccctggccaccgcaagctccacgggagggttcgcttcttcaacgtctccacgggcgccttcgcgcgtctcctcctcccgttcttcccggatcacttcgtcatcgactcggtcgatggcctcctcctcttgcagcgggatcgggacagtgctatccgtatcctccaccctttcaccggtgacattgttgagttatcatccctggagaccctacggccgcaggttgagcccttcttcaccagcactgagttggcttatatgagagccatggagcgaaaagagatgggcatattctcatatttcaatcgtatttgcgctgctcttagcttcggccctgacggagtcatcactatcatgttcgttgttaccagagtacagcgcgttgcctttgccacctctgcggatcagcaatggaccttgtcaaattggcagaccaacctctcatggaaatacatggcattccagggcaagatttatgcagcatcaatatgggtaaacttctctccaaacagaattttcgtgatagacccaccccgggtggaggcgaatggctctgcttcgtctttttccctaccagaaccaaaattgtttgctacatgtccagtagaaaagctgtttgggttcgcttatctggtgaactgtgaatcagaggtcttgctgatcggtcacactgatcgctcgtactcgcaggccgtggtttacagacttgctgacattatcttgggaaggttcatcccgttaacaagatttggggactacaccattttcatggatgaaaggagcctgtgtgtctcctcgaaggctgttcctggcattgcagatggctctctcatctacaggcaccacgggaaattccttgcacaataccatgttagaagtggcaccctgtcgacagctgctgagggtagaatcgaggaaggctacagactggctccgtacagcctcatccaccatctttttgcttgctgtcttatgacttttggtaagtctcctggctatgctgttcttccatgcctagttcctgcatgattgctacgtgttccttgaccatctatttacttcttggatttgtaggaacaaaggacaactattttgctggaatacgacgaataaatggggctataaggcaaagtagcaaagcaggggtgactctcgaatgtactgtttcttattgtctctcaagctcaactgccagtatgaacaattatgttcttctcactctctctgtgctcttgctgatgcctagcgatctcagactttgtagccgctgtttagttaacaaagaaggtagcccgcgtatatgcgtgagtatgttatttaatgttgttttattttttttattatgaacgtttattatatggagacatcttatttaaggcaaaattgattatatagcatcaaaagtttacgtttttagatttatagcaccgaaagttcaccgtttactttaactaggaaggtggcccgcgcgtatgcacgggcacttgtattattgaaaagtaagatttttactgtttgttcaaaagttttatcttatagattaagggcaaactaaagttcggatattgttattttgtaataatttaagggttctatttttcttaaggtatcttaaaaatccattcacaaacttttgagtaggagatggattaagtacttacgacttttgaatcatatttttttctcgagtaaataataaactattgcttgtagttcttgagtaaataacaaatgaaaaatgtgagagcaagatacttaaaatttttgtgattaaatcatctaaaaaaggtgcatgatacagtaagaaagagagggaagcgtattcatggagaaaaagaagaaagggaaaaatggaaaaagggagggggaagagtaggtacctacgtatgtaggtgtgtaccgaaggtggagatgtgggacctcgtagtatttagtttgttctaagatcaatttaatccaatggtttataatattggaccgatcgatttaagtgaaaatcatactttgttttttttcttagaatttctaatattttctctaatttatttgagcaccacgtgacagcttatggtattttaagaaattttaatggacttaccacatgtaattagaatattaaccatataatatatatgtatgggatatatgttaatattcatttagctttgtccatgtttatatacatgtagagagaaattaaatatgttgctagcaagccattagatgtctaattaatagcaattaattttgacacctatttacaattgtttacattagctcttatatgttcatcttacgactttgattatgcgttgataaccaatttactgatcaccatgactcgcatgaaaaaaatatgtactacttagggtttagagtttaggacaactgaaattgatgaattatctgatttatgtgatagctatttgagattataaacaaataaattaacttctaaaaagttaaaaagttatttaagaaaagcaccatttaggaacttggaaagcgtggagcatgcaaacgaaaacccaaaagatggaatcaaggaaaatatagggccttaaactcccttataacacttttatcctagtaagagttctattgatattcgttaatattgtgctcacatttataatataatgatttcattcaattgtacgaacaaataatacaaaatctgaatacatcaaaacacaatacattataattattatgcaatcaactctcgattttggcttaaacagagctaagtgttcccacggtgcttaattcttctctcacggcatcacacctttaattttcttttcatgttattaacaaaatcggtagcactacaatggtcgtgatcacctgagatgcctcagacatgacattctgtcacacgtccgaaaggcaaaggtgtagacgtgcattatgcagcgggccaaaaagagaactttagacactttagttattaacaatagatccgatgatttaaataatgggtccactggttctagtgtaaatgtaaattagttaatatatattttaaattgttaatttaatgggtacacaatataatggtgtagattttattttaaaacaatttattatttgagaataatagtccaaagtaattaaaaaaatagatccaatgatttaaataatggatttatctgtttaagtgcatctatatattagttaatatagatcttaaatagtttatttaataggtacacaatataattatgtaaattttattttaaaatagtgcattatttgaaaataatagtacaaagtaatgagtacaccgatttaagtggaaactatcttattgatttactaggtaaacatataatatgttgtaaattttattttcaaagattatagagctaatttatttacgtgtgtttataaagagttatatgatggtatattctttgtttgtaaaattatgattattaaaaaatatatatcaattgtataaatagaaaaaataagaaaaaaaaggaaacaaaagggagggaggcgtacgtactacatacccatgtatgtacgtgacctacctatgcacgcataaagaggagaggtgggaccctggtcaaagaaaaaaaagaggagaggttgggcctatagtatttggtttattttaagatcatttttatctaacggtgtataatattggacccaccaatttaagtgaaaataaaggggtagatgttttgcttttttcttagaatttctaggattttctctaatttattagagcgccacgtgacatcttaagagcgtttgtaaaaagtttagtggaattttagtatataataatagatagatggcacccaaatctttcctctgttcctgtttagaggtttccgtcgctctctcccgttttccgttttctttcactgtgatggagtgtgcaatggctgagcgaatggaccatcttgcccatctctgattacgggatttgttttgatctcctgacaaaatgatcgaaccaaaaatcatcttgtcgtccgtccttggtggcgatgacctccctcgccctgattgttcttgccatccctgtcgcgcgtggcggtggcggctggcactactaaaaaatcgtttttctgtaccatgggttggtaggttccatgtgggccgcttgtggcggcgcctgcaaaaacggcccccctaggggcaggtcgatgagccgcatgcgaagatccattatcgcatgcggctgcttaagacagccgcatgcgataataggtctattttcgcatgcggccgtcttaaggggccgcatgtattagggcatgcggctgcttaagacggccgcatgtgaaaataggcccattatcgcatgcggtaatggatcttcgcatgcggctggcttaagggaccgcatgcgatgatcggccatatatgctcctccaggcccaagctcgaccatttgaaaacgaagctctctctctctcctaaagcaagcaccaattaggggggaggttttcaactcgaaatttttgcttgaactctatacgaaaggtgaataactctctctccttcatttggctccatttctgttatatttcgttggtggaaagtggagtttttttaatattttgacaaggtttgttctagctagtttttgcaaaatctagcttcaaaatatatgttttgatgggcaaattttgcatgtaatcacttgtacatactagttacatgtattgttgtaatttttttggagggacaaatgcatttaaacttttatatgaaatacctgtggtctatttttttatctgtaacttttttgtctttatataaatagatggatcggtcgtcatggatgtatgagatgcggagaacatagccgatatttattgaggaagcatctaaatttattgatcaggctaaggcacatgctttgagggagaatatgacaaagatcttttgtccgtgccgtcattgcaagaattagaaattgttggtagatcctagtgaaatattgggtcacataatggagtacggattcaccgccaactacaaggtttagacctttcacggggaattcgccgatcccgaagatgacgatgaagagttatgtttcgagatgaatgaggcagagaattttataatcgaagacatgtccagtgaaagaatggatgtcgatgtttccaccgatagtgatgattttgagggtggttttgatttagaggatatgctaagccatgttgaaccagaggtgctagcgggtaggtcacgaggattggagaattggcaggcattagagaaggcatcgaaggatcttctttacgacgaaacgaaaggatgtgataaggatttcacaatcttgcgttcagtgcttgaacttctaagattgaaggctaaacatggatggtcggacacaagttttaatgatctgatgagtttgttgcgtgtgttgcttcctaagcctaactttgtaccatcaaacacgtatcaagcgaagaaactcatatgtcctttatctcttggtgtagaaaagattcatgcttgtaaaaatcactgcatattataccgtaaagaatatgcggacttggaaagttgcccaacgtgtggcacaagtcggtataaaacagggaatgggcccatagattcagagtgtaccgatccagattctgataagagtaagcgcggaaagattccctcaatggtgatgtggtacctaccaattaaggaccgcctgaagcgtctgtactcaaacccgactgatgctgagttgatgagatggcatcaagagagccggaagatagatggtatgattcgatatcccgccgacgctcgccagtggaagacatttgatgcaaaacacccagaatttgctaaggatcccaggaatgtaaggtttgcgttgagcactgacggaatgaacccgtttggtgacttaagcagctcgcaaaacacatggccagtccttctcacaatgtataatctttcaacatggatatgtcagaaacgaaagtacattcttctcactatcctcatacaaggttcaaaccaacctggaatcaacatagatgttttccttgagcctttgatggaggacatggaggagctttggaaagaggggttacgactatgggatgagtttaagcgggagcacttcaatctacgtgcgatcatattcgttaccattaatgacctacatgcaaacttttcattatctgggcagattaaagggaagactagatgtctgatatgtttggagaaaacttcgtacaaatacctgatgtcgtctttgaagatagtgtacatgcggcatcgacaattcctaccacaaagacacatgtatcgtaagatggctagattgttcgataatacagtggagaatgacactgccccagcagcacgaggtggtacatacgtgtatgagataacaaagaagattaaggttgtatatggaaagggaaagaagaagacagtaaagaggaagaaagctgatggtgacaaagatactgcgtcgcctttcaagaagcactcaattttcttcaaatacttagattactggaaggacctagagattcgacatgcaattcatgctatgcacctcgagaagaacgtgtttgatagcaccattggcacattgctggacatcccgagtaagacgaaggatggattgaagtcacgtaacgaccttgtagatttggccatacggcatgaccttcacccagtagtgctgccaaatgggaagaccgagattcctcctgcttgttactcgttgacacttgaagagaaaaaaaccttctgtaaatgtttacaaggggttagagtgcctactggtttcgcatcgaacatcaggaagctagtatcagtgaaggatttgaccatttctgggatacaatgcacatgactgccataggttgttaacggtattcctaccaattgctataagggcagtcaaaccagtccataccaaggtggttataacaaagttgtgctactttttcaatcgaatttcgcagaaggtatttgatcctctagaattaggtccccttcagacatttgccgtcgagaccgtatgccagcttgagatgtatttccgaccatcatatttagatatgatggagcatttgatcgttcacatcgtccctcatattattgaacttggttccttatacttacatcagatgtgggcctatgagcgttacatgtcgatcctcaaaggctatgtacgcaatcgtgctcaccccgaaggatcaatgatagagggatacacaactgaagaggcagtcgagtgttgtatggactacataaaggatgctaatgccattgggattcctgttcatcgacatgaagggagattgtctggaaggggtattgttggtaggaagcagttcttcgataatgattacaaaaaggtgtccgcggcacacaacaatgttctttaacagctcgctatcgttgagccattcattgagcgacacctagaagaaatcaaagcctgcttcctagggcggtccaatgattgggtatcaagagagcacaagcatcactttcctctgtggttcaaagatctaaacctgccagttggtgattctgtggaggaacttactttacaaagactggcatgtgggccttcaagtattgtcaattcatggtaaggttacgacatcaatggatttaccttgagtacgactacgaaggacatgaaaagcaccgcacaaaacagtggaatctgtgtcgaaacgattgacacgagtggtgaaaataagtcgtattatgggaccatacaggaaatatgggaactggactatggcctgaatatccaaatcccagtgctccgttgtgaatgggttaaagacacaacaggggtttccgttgatgactacggggtaaccatagtcgatcacagtaaaacaggccacaaggatgatccatgggttttagcagagcgtgtggctcaagtgttttatgtgaaggacccttcggatgaaagaaaaactattgtcatatctggaaagcaacagatcgtcggcatcgacaacatcgaagaccccaatgattacaaccagttcgacgatgtaacattgtttactgatcttcctatgcgaattaagaaggttgagagtacaatcgataaagcgaatatgtcgtacgttcgagcagatggtgttgccaaggttatttagtcatagttattttgtaacctttagttgtcattgtgttccaaatgtacgtgcatgaatttaagtcccccttatgttgtactcattagcatgtaacatttggttacgagttttgagtgattttcatgagttttcttactgccaaaaatatttggaatttttgttgtaccgaaatattggaaaaaaatatatatgtacagtttatttagacgaaagaaaaaatatgagtttatttggtaaaaagatctttccatgcgggcgagttaagccagccgcatggaaatatctttttcgcatgtagccggcttaacggcccgcacggaaaaatgatctttccatacggctggcttaatggcccgcatggaaagatcagtttcgcatgcggccggcttaagtcgcccgcatggaaagatcatttttccatgcggccgcttaagccgaccgcatgcgatgatctgcccctatatatagggagcgcggggagccaaaattttctaagtcccggcgcccgcgaaccctagccgctaggctgccaaaattttctaagtccccagccccctcgtcgtcgccgccgccaagtcctccccgtcaccgccggctcctccccgaagtggtccccctcgccgtcaccgtcgccgccgccaggacctctcccccctcgccgcgtcgccgccgccaagtcgtccccgccaccgccggctcctccccgaagtcgcccctctcgccgtcgccgtcgtcgccgccgccaggatctctcccccctcgcgtgtcgtcgccgccaagtcctccccgccaccgccggcaatacctccccgccgccgccgcgccggctcctccggtccaaagtcccccggtaacatttcccttaaaaaaagaaatgtgaaatgtgcaattgtggattgtggattgtttaattgttgatcgtggattgtgaaatgtgcaattgtggattgtggattgtttaattttgagaatgtttaattgtggattattaaattgggacttatgttaaattgagatttatgtttaattgggactgatgttaaattgggacctatgttaaattgtgacttatgttaaattgagacttatgttaaatagagatttatgttcaattgggactgatgttaaattgggacttatgttaaattgagacttatgttaaattggaatttatgtcaaattgggacttatgttaaattgagatttatgtttaattgggacttatgttaaattgggacttatgttaaattgggacttacgtaattgggacttatgtaaaattatgttaaattgggacttatgtcaaatttttttacgtcaagttggaagatgtcgaacgataaggttccatcgaacgcaccaatagcgcctcaagaaggtaacgctcctcaaaaatccggtagcaacaagcagcctgacgcttctagtgaagaaacgtggtgcacaccaagtgacccgtttccaatggaaataacacaagtcgcccctcgcgatgatgatccggactacatacctatggaacaggccgtaagtgctgaaaatcgttagccatgtattatttcctaactatgatgtgacatgaatctaatggtgtagagagttacctattttctgcagatggtagtccgacgccgctcgaaacgtaaagccgctcggaacaggagagaggaagaagttgagatggacaccgctacgtctgcacctgaacatacggagacatctacaagtgcaggcgggagtgggaaaaaaagacgtggtgagagaagcaagaataaattacccaaggaaacatacaacgtgattgctctcgatcaggatgggaagcccgttgagccaccgatagtgcggtccaagtttagcaacgcctgtggtactctagtcaggacgcgttgtcccattaatgtcaagttgtgggaaacggtggacgacaacatcaagacacttctctggaatgagttgcagaagtattttgtgttccctcctggatcacaggtcagggggagagattacacacttaaaaagatgggagatcgatggcgacagtggaagtccgatctaaatcgggattatgttcagaagaatctcccaccgttcacggattatggacatatatcacaggctgactgggatacgtttgttgcggatcatataatagctgaagcattggctttgaggaaaaaaatgtctgagctcgcgaagaagaacagatatccccatagattggggtcgagcggatacgctggtcacgtcgatcaatggtgggagatcgagcaaagattttccgcggccggcaaacccctgctggtagaccccatggtggaacgtagcaagaactgggtttgggtgcgcagcacaggtaaagtctcggatgagggagacatactattcgagactccagacatagaagaagtgactactaatttgcagcagatagtcgagaaagaaagatcaggacagttcgtcccacggagggagcgagaccagctttactgcggcgttggggaccgccgaacactctggacgtgtaagtggtttgtcctcaaagatgagttggaagatagggtttccataagacgcaccagttataagaagagagacaaatacaaagaacaactatcagacaaaatctatgcgcaagtgaag

SEQ ID NO: 40674 - DNA, 36265 bp, Oryza sativa
gttggcagctgaaaacccgacagcctttccaaggttattccctaatggccaacaacccacacaatctgcacagcaagacaactaatgtacccagcagtgtaggctcagtgcagacaactcccttccctgtggatagtataactggaccaactccctgcagtctcgtcgtaccaatcggccgcgctggaaagactaaggaggttgcaatgggtttagcgatacccggacgtcaattccacaacacggcattccctgaggattacgcaagggtataggtcgccaaggtccatagcgaccacgtttccttggaactagacatacctgcacctgaggggattgaacttctcggtgatgcagtgaatcagtttatcttgtggcaccgcagagacataatcctaaccgcggccgttccagcagcaggatcttcaactccatcctcatcgcaggcaaggacagctgccgctcctgcaccaccgtcgcctcctgaaccaccgtcacctcgacatccggcgtcaccaccactgcttaggtcaccgcctcaccaacctaaaccactaccctccccttatcaatagcctgctctcccggccccgcaaccagttcaagcctctcccacctccctagctaaacagcatgctcccccggctccgccctcagttcaagcctctccacctacaccccaatctgctctggtagaacaagtgcacataccagaaggtaccacatccgaaccgaagtctaatcctttggaacctcgtcgtataattccaaagttgatatccacatacgacccaaaggagattgaaaaggataaggagaagttcatgttttcagctttcaggaattctgagaagagaaaagaacttgctcacatcttgtcagactcctagaagtcagtattagcagcccaagatgaagtgcaatcctggttatctgctgatgtgcttgacacttatgagtatggcaaagccattcttgccaacttatcttatgaacaagctaccatgggaaatgagggtaatgcacgaatggtatatgaaggcatctaggaaaggtctcagtttcataagcgtcgccatcccggaaggcgctttcatgagtggtcctaatgggatattttttatctctttccgagacctttacgccctctacaagctagataaaatggacgttaatctcgttgcggcgttctgtctgtaagtctgaactctttattacatgttacacgtatcattccaaacaaataaaccaaatcccatttcttctttgttcattgtacagtatgcaattccacgaagctgatagaactggagcaaaggttggatacgtcgatccaacaagaatatgcaaaacacaacacaccgtagagctgagagaggactgcgagcaattggttggcaagacccctgaagaaaaggaagaatatgtgaagacattgcacaagaggaagaagctagaagtagcaacatacttggcaatagcaatgttggcgcacaccgacaaagatttcttaatggccccctacgcgttcacgtaagctttctcttctttttgtttaattaatttatcttcttcggaattttctgtctccaataagcctatcttatatgcagagacaactacatattattccttgtatatcagaaagaccaattgatcatatcattggaccccgcacactatgacaaggagacatttatggaattcctcactattttgaatttgtaagtgataaacatttcattaatataaattgtttaggtcgatcgccagtcttctaactactgataaaacaattgttttcttcaaacagagcacacaagtactactgcaaaagaggtggaccagtacatattccatcccagaagaagttatccgtcaggactagctagccggtactatcaaatctataccaatacaactaattatcgaacaatacatatatactaaattatatctactgagatcggtcccccataattatatcgcagtgctacaaacaaccaccaggaaccaacttgtgcggttattacgtgtgtgagatgctcagagtaaatgggaggtacaaaacaatcggtaaccgagtaagtaaacgaactcttctctacacagaaacccatctagcacacacttctcattgagtaccattttattttcctttctgtgcgtagatccccgaaatcccatatattgcacaacgattcaacgacactacgatcttgaacgtggccgctgacctctaccgattcatccgcgcgatgtctgcaatacaagaggtctcttctatgacaaccagagtgaactcgcaatggacaacaaatttaaacctctcagagagtgggagaaagaacatatgcaatgacatgtacactacttatacatatgatgaaaaaactgtggcacctgtattatatatttcgtatgtaaattacgattgaatttatggttatgtattacatgtttgttactgcggcacttgtcttactattccgaaatatgataataaatccctcaataatttaatattaattacgagacacacctcactaaaaggctagaataaatattatttgagctattcggaaattgaatttcgcatacggtctacttaagacggccgcatgcgaaaatagatcttcgcatgcggtcttgttaagtcgaccgcatgggaaaatatatcttcgcatgcggcttcttaaatggaccataaagatctattttcgcatgcggccgtcttaagtgaccgcatgcgaagatcgatcttcgcatgcggctgggccggctgcatgcacaaatggtgatctttgcagaccatttcgcgcatgcggcccggccaaccgcatgtgaagatcgattccgcccggatgcaaaaacgctttctgtagtagtgtggcctcgccgtgcccatctcctctccctcctccgccggacgtccccgtcgccaccatcggtggcagtcgtctctgtccagccaatcattgcatgtcttgtctcaaaattctcaggttggatcagaacaccttacgtaagatagagattaaagtcacatgatatgtgaccttacttgatgttacaaaggagtacaagagaggttctatagttgggttagatgttgactcagaagaatactctgtcattgagatggagtgcgacatgtcagcctatctgtctatactttctacatagttggtacccactaaagctaaagctcaacatacaagcatgccacatcatcacccactagcaattgctattctagcccatttaaaatcctatacaagcatgccacatcttcactcactagcaattgcttttctaacctattttaaatcccatgcaaacatggcatatcatctacaatattatattatagagatcaaccagtatgtgtcaaatcatcttcctcacattattttctcaatatttcaactttcatcatttcgacaatatttaacatatactcatccgtgaatcccgcagcaaagcgtggggtatcacctagttatgaatgggggagctaccaggaagctagcttttggtataataaaaatgggtagactgtaaagcttactagtgatgctgaggccgagtttagttctcaaatttttctttaaatttttaactttttcatcacatcaaaactttcctacacacatagaagttttttcttcaaacttccagttttagtcaaacttccaattttagcgtggaattaaacacagcctgagttgcttagcctacaacggtgtacaagaattttgaagtttggcatgatagttgataggtctgaccgtctgaccacattaatgtcagcctattatgaataggggagctaccgcttttggtataataaaaatgggcagactgtaaagcttatttccaagtccacatgtacattgcaaggagaatgattttagagagcaattaatgggaaatacttgaagaaatacttctccagtgtttggcaagatgcttaggaagttatatggccggtaattggattatcactctaagaccaacagaggcgctgacccacctactacaaactgttagtaggagtccgcgcttccccactaccgcaggtcccctcgccgccgtcgttgccacaaggaggacacggcttcagctctaacgggcgccacatccgcactacccccgccgtggcgccaccactaccacaaggggagggagaaaaagaagggagagggcaccgatgacgactctgacgggtgccacgcgcgcggcgcccgtgtgagtgtgcacaagtgcgaggagacggtgatgacgcgcgggggaggcggcagtgcacggggggagattggagatggtggttttttttcggaaaagcccctttgtttttcatgtttacagtgctatccctataagcggaattttatcttcttcgcattgtatttctctaaaagacaaggagtttccagataaattacaacggggcgtcaagcgtgacatatgagatattacgtgcaaacgtgcggagctttttgcgaaacagccaaacacgtgcaaatctcctcgagaatgcaaaaaaaaaaattcaaaaaacgaagaaaatcaatgagggtaggatggttatcagctctcctattcagaataaatctattttgcctccttaatctcttgctctcgattgaattgcatccctcaaccgtaaaccgggtataatgcctcctccatcttacaaaaccaatgcaaattgattcctaaggagtttttctagatggttttattctacgtggcgcttaggtggcattctagatagaaataatactccccccgtttcaaaatataaggcacaattactttataaagttgtttcataatatgaggtgtgcatgcatgcatgtaattaattatcacattctctcccctaaattattattattttaaatcctacactcacaatatctttaattctattggttgcatgcattgtattagttggaatgattcataacaatgatgtgatattaattatttctgagtttttggattaagggtggttgtgcaccatattttggaatgaagggagtaataataataatagtgggtcccatattccgtgaaacatcttcctccctccgttttcatccacacccctccatagccccgagtcagcgactccggtgagtttgtggcactgctggtggcggctgcctcattgccgtctcctttctcaacacgttgacacgttgtggcgcaggccatccttgccatcatcccaccgcagcgtgcctcaccctgccaccgcaatctccttcctcacacgtgaccctgccactgctgtcgccgtcgatgcggcggttcagttggctccgtcgcccctgttttaaatcgtttattgttttcaatatccaatcaaaccatcatactctactgaaaatatatgaaaaagtgttcaatattgaatatatttaggttatttacttttgtagcagtgctgttatgaagacttacttccctataacattgttatatagttacttttaataccacgaagagttgcttctatctagcagtttagttatttctaacaccataaaaggttagttctgttttccagttaatttcctctaggagtgtaccaacttttaatattatgaagaattacttttaatactatgaatagttacttctattttctaaagagttacttcctatataaaataaattacttttatcgaaaacaataatctatatatatgtatacacatatggtttaccttggataaaaaagtcatgtatttacttgtgtcatggttatggatgctacatacctaataatagttgactaaactcggcatggcccatcacataccatgtcttatacggaatcatacctcgtatatagaaggagttccggataaggaaagacaaatagagttctatatagaaatgacaaggactacgtggattgtatccatattggtctccctaattctacttggacaaagggacatctatgagtataaatacaagaccccctagaaggataggggacaagccacaagatcaacaagacacaatatatacacaagccaacacacatcgccagatctcaacatcagagattagcctagacatacctcatctggtgcctacggaggccgccaaaaaggatctagcaccatctctgatctcgatgagttcatattcgaggaggaaaattaccctgtcgttgactacgagttggttatccatgccgccaagtcgacgacaactagataggttatcccgaattatgtacttgtgtgatccatatgagtaaggagcaacaccggtttcggccaataagagtagggctattacctgtcaaataaggggcctgaacctgtataaaatccatgtctccatctcttttacctcaatctcacatataccttggtatcaacaatccccatactatgcaaataccgtagtcacgatctcaaacgtcgacaacttgtgaatctacactttacctatgaagatatttcttttaacacatatatgtaattacttctaatgttataaaaagttacttccactatagagcttagttatttctaccatttgactaaattatttttaaatatttcaatagtttactcattttatcatatattttgagtagaacagaccttaaaaaataatatatggtttgaaatatataagtcaccaaaaattttaaatatactagtactacatagttacgaaaactcacatttgactctaagatcaaaaacgtggagataaatttagtactacgtacccgcgtatgtgatactttcatcggacgattttagcgggcgtcgtgccgtaagacgaaactgcactttcgatttacatttcccataatatttcatattaaaatttgaaagttcaaatagataaattttctttactactatgggtgaaaacttagcccgatcttggctgggctggcaacggaggcgttttcgagcgtcggattccctcttgagggagttgtcgtgtcgtcccaacatccctatgacgtctgccaggtgaaacccagtctcggttctcatttgagaccgcgatggacggcggcggcgatgcttctgttgatccactctctggagacgtcgtctaggtaacccctcgccgaaacttcctagacaactggagcaagctagctgtaaattccggtcctcttgtgtcggtgctatagtgctggccaaatgggccgggccaaggcgtgccgacccgagcacggcaccactgcagccgatctaggcacgacaccactgtagccagcccaggcacgacacggcacacccgctcgtgggccgtgccgtgcttggctgatgtctaagcccatgggccggcacagctcaagtacgagcacgacccgttggcccaccaaaattttccctatttttttcatatattttgtctattttctccgattttttctcattttctcccaatttttccatatattattttctatttcccactacttttcgtcatttttctaatattttcacatattttccttttttccctttaattttcctttttcatatttttttttcacattttttatttagttttcggtctcatattcaaattttgtgggccaaacgtgctaatgggcctacaccggcccgtgtgttatatttgggctcgtgccgtgcccgtggtcttcctgagccgtgcttaggccgaggccttagcatgtgggccggcacgagcacggcacggcctgttacaggagccgtgccttaacgggccgtgccgcccgtttggccaagtatatgacgccctaacttataagttgaccatgtcgaatggtctagagggagaacggttttatcttcttttttacactctttcccttaatcctaaagttgtaaatagagtacagttctgtgttagttttggacgatcccgactatagtcttttgttggtctagcggcggtcggtctgatactagctttctcctgggtctatgtattggagctgtcagtgtgtaggtggagattattttttttttctgattacgagcttacaaggttgtaatattgtaatttttttaatgctctgtcaatatgtagcattgtctgttgcgagtcgataaaaaacaaaaaactgcgtaattttcttccgccgcgtccagcatggcagccgcggcgccctcgtcggcgcggcgaatgtcgcacacgcagttcatcgagctcctccgccggcgcgcctcctgccctcgccacggcgaggccctccacgcctgggcgctcaagtccggcgccgcctcccacgcgcccgtcgccaactccctcatcaacttctactcctcgctcccccggcccctcctcgccgccgccttcgcggtgttcgacgatatccctcccgccgcccgcgacgtcacctcctggaactccctcctcaacccgctctccggccaccgcccgctcgacgcgctctcccgcttccgctccatgctctcctcctccaccgtccttccgtcgccccattccttcgctgccgccttcaccgccgccgcccgtgcggcctccgcgcccgccggcaccgcggcccacgctctcgcttgcaagatcccctctgccgtatccaatgtgtacgtgtgcaccagcctgctcaacatgtactgtaagctgggcattgtttctgatgctcgcagagtgttcgacggaatgcctcagcgcaactcattttcctggtccaccatggtggcaggttatgctgcagagaaatgctccgaggaggcattcgatctcttccgactaatgctcgaagagtgcccttctgagaaaagcgagtttgttgccacagcagttctcagcgcagttagtgtgccattgggtttgctgatgggggagcagatgcatggactgattgtgaaggatgggttgctggattttgtatctgtggaaaactcgcttgtcacgatgtatgcgaaggctgggtgtatgggtgctgcgtttcatgtgtttgagtcatcgagggagaggaattcgatcacttggtcggcgatgattactgggtatgcacaaaatggtgaggcagacagtgcagttagtatgttctcacagatgcatgctgctgggttcacaccaacagagttcacttttgttggggttctcaatgcaagtagtgatttgggagcattggcagtagggaagcaagcccacggtttgatggtgaagcttgggtttgaggttcagatatatgtgaagagtgcactggtggacatgtatgcaaaatgtggttgtattgctgacgcaaaagaagggtttgatcagttgtacgaggttgacattgtcctttggacagcgatggtttctgggcatgtgcagaatggggagcacgaggaagccctgacattgtatgccaggatggacaaggaaggtatcatccccagtaaatcgactatagctagtggtctgagagcatgtgctggcattgcagcactggaaccagggaaacaattgcacacgcaaatcgtgaaatatgggttaggtttgggggcccctgttggaagtgccttgtctacgatgtattcaaagtgtgggaaccttgaagatggcatgtctgtcttcagaaggattcctgatagggatgttattgcatggaactcaatcatttctggtttttcacaaaatgggtgtggcaatggtgcactggatctttttgaagaaatgaagatggagggcactatacctgataatataacattcattaatatattgtgtgcttgcagtcatatgggtctagttgacagaggatgggaatattttagtttaatgacaaaagattatggtttaactcctaggctggatcactatgcttgcatggttgatattcttagccgagcagggatgcttaaggaagcaaaggatttcatagagtccattactattgaccacggaacatgtttgtggcgtatagtactaggagcatgtcgctctttgcgagattttgatgtcggagcatatgctggtgaacggttgatggagttaggtaccggagattcctcagcatatatattgctgtcaaacatctatgcttcccagagaaaatggaatgatgttgaaagggtgaggcatttgatgagacttcgaggagttaacaaagatcctggatgtagctgggttgagcttaacagccgagttcatgtgtttgtagttggcgaacagcagcatcctgaagcagaaaatataaatgcacagctgagaaggctagctaaacacatgaaggatgaaggttaccactcatcatctaagttatcgtttgatgaagagctgggtccattggcagaatctcatgaagaagatcaactggaatggatatctgcagcttatagctgactttgtaaaggatatgaaaagtaagtactaattgtttttactggaaagtcagaggataaaagaaaaactgagatataaaaagtttgttgcagtacttttggcatctattagattatctaactcagtgtcaatgccagtaggaattattcatgttccccttctgttatggtatcacagaagtgctggttctgttgtgcattttttccctatattgtaaactatctaaccttaactttttcacatatatttcatttagactgccgtactagaaaaaaatgtgatttaaattacaaccctatgaaatgttaccatttgaaattttgaattacgaagttcaaaaatgatcaccacacaattttcgttgcagcagtagagcccttcttattattagtattatactttccttgggtttgtgtggcttgatttgggtctcatcttcagcgtatctcaacttgcttgtgagtaagtggcagagccaggaattttactctattttatttttggagaggaaaggggtgggtttgggggggggggggggggggtagcacttgatacagggctacatgtgtcatggtgttaggtgcattgcctttgaacctttccatgcttcagaatgacggatagatgggaaattagggatcttttcgatggcttgatgcggttagctggctgtgatagccagatgcctcaatggttggattgccacagtgggatgacaatatggcctttgttttttcttccattggcttctcttgactcctgtttgagtatatttatacaatatggttatgtaattggcatactagcgaaagttctgaggattcagatgtacccctgtggccctgtactgtacaccacgctactaacaccactggagtaaggtggttgttgtagagcccttcttactcacgtactatgtgcttctgaattttactgcaatttgtgtaactgacatgataacgcaacctgttcacacgtaccacatgtgtttgtgtgcaaaaaaattgatgcagaagctgtctttgtataacattttttagctttgttccctttgctcatgcatattagaaagtttaatcattttaatcattgtacttgaaaactccattaaaatgtctaattgtaaatatgccactactattgtggtgtggctgtctaagtgagagatttccattgtaataaaagaaattctgatttatcctatgtgattttacatgaaaacataatttcagaattttatgataataagatgactagcctgtatgcaatttgcaatttacattgctgtttcggtgtttcctattctaaatgttgttattgtgctagtcttgagttgtttttctcattactgtggttgtctattgatatgcaggcccaagaatcagcaaaacttataaagacagcttaattcggcagccatctctacatgtttgacaagttcttcatatgtgcccaaactaccaaagtatgaattagcatagcataaagaagatttcagttagttttcttacatctctatttaggagtgctaaccatgattttctgctttttcctatattacataacttcatgctgtcttaatccatcagctctggtgtgtacaccaggaatgaagaatgatggcgactttttgattagctgaatgggaaggctaaccatatgccttgtaacacctaaggaacttgttgagcaacttgaacacaacttcgctatgtggttaccactactatttccatagtggttggaaacttgaaatccatatgagtcatgtgttgaaaccaagatgataccagcataatgacttccaatggtcacgctgcagagctgcatcacaaaattacagcgagacattggatgatgtcccacaaaattgcacctgaaaaatgggaaggtcttactgcagatcgtgatgctttacttcggagttcaattttcctcagtgaaaataggtggctttgtaggctatattttggtgaagcaggaccataatgtaaatagcaattcagtggcagttatagacaaaaatctgcaagtggaaaattgacctggtaccttgggccagacactaggcagtaggtgtcataccaaggaaaatttctgttttaccagttcctagttatatcgtgtccagtcagcatattgtcagcttttgtcagctttcacaagtgaggaatatatgacacataattagtatggtgccactgaaacattttagcaaataacactatgccagcctgctctatagatactacaggtagtaccagagatatctgtttgatgcttttgtcattggtcatcgccactgtaccatcaatctgatctgtcatattctacagaagggggcagtctgattggccaatgcacactgcattattcttttcaagagactacgtccatgcatatctattcatgggtgcctcaagaacaatctattcccaccccatctactcttattgtaagttttgtaagttatccttgaacttctcaatattaagaaacaacaaaatctaaatagatagccacacataaaatcaaattaaggtgaatattccatatagaaaagatatggttaatttatgttaggcaatatgataatatattttattctattcgagtattcggagcagggcatttagttattttgctaaaatatttgcaggctaactgtcaagcatgcgggctgcctgtacctgagaggatgtgctgggtttttgtttcggtttgtttcagagggaagctaatctgtcagttgtttgtggcccagtgccggatgagcattgacgtgccttgaagcatgagttcgctctgagatgactgtagtgctatttcatgaataaagctcctgcttaccggttttgggaagaaaaagggtgctgaggcatactggttccatggtttgaactgatttctgaaaattcaacccgtacactaaatctcactggaagggccattgggggtgcatgacttgctaatgctagcatgccgcacagtatggagaaatcttggtggagaggaccacggccaggtctctctgtgtgacgtggtgaattgctagagaataatgaggtcaaaagtagcacatgaaactatgaagtgaatgttaacagatagcgaaaagatcaaccaaagtaaggtaactcgttgaatggttcaatcttatagccatttggagttaaaggtttcaactggtccaattcaaacttcaaaactttgttcaaatcagtatcatgtacttgagttctgcaccagctgataggcctccgatgtggttttcctaacaatgaactacaacagtgggaaaacacagacaagaatcagattgaagtgaacctcagactgttcgttgtttggatctcactgcatcgcgtattcccttgccatgttgaatgaattccagtcaagaatctgctctaccacggtgctacctgctatgaggtaacctgtattattcaactagagcttgtataaataatagaaatgaaaattacactgtttacacatacatgccatcctggtaccagtaattttgattaatttctacaattttatgttggtggatattgtaaatttatacaatattatgaagctacatatgaagataaattttctgatatacttttcacatggctaatgtttacaattttattgcagctactgatctatagggaggctggtttggaaagaaacaaataattaagttgaagctggcagaggttcaaggaaggcaaatcagaaggttactactgttcgtgatagatccaccacccaaaagtcgagtggcacccaaatctggcgcagaggacaacgatggatagattggccgctcagagttctctaaaaaaaaaaaaaaggttccaccgctcagcaatggagggcactaggagtaattgagaaatgacatagatgcaaaaatactacagtacttatctgtaatgtgtatgcaggagactgaacgagtatcagtaattcagtatcgaaagttgtcagctgatggaaatagtgattactccgtaataaacattattcacgctgctggtttgtggttgtggcttctctgaaaagtgaggaatgaaatatgcaggcgtttttttttgagggaaaccgagagatttatattaccaaaccagcagaatcgctggataccagccgttccagaccaggcgggcagcctgcccaggaagacacggtctggagattacaaccatacgcggcaagctcatgtgccaccttattacaactccggggcgagtagctaacagagaaggaatgaaaacagctcaaaattatatgtttaatctcaagaatcactcctcctaaggatgaaaggttaaaggaattatcctgaatcgcataccgaagcatcattgagtctgtttctagctcaattctggacatacccctttcactcgcagtcttgattgcagcagcacaggcaacaacttcagcatggaaggcgtcttgtagataagctgccggaccagctcctgcctgaaggactgcgccagtctgatccctgatcacaaaaccccatcctccctgcttcatgttactactgtatgctccgtcggtgttgattttcacaaagttcaggggtggccgtctccaaactgcacactctcctgttctggggcttttttcctttacattcatcctaacaaactctcctgcctgtgacataatcaggtgtgagagctcagctgggctccttggtattcctccttctcttacttcattcctctctttccaccactgccaaaggcaaactatggcacttgttcgttcaatttccgggcgacagtaaattgattgtaacacattctttcctgacgtttgctgctctagcatggatctcaactcttctaggtttaaagcttgccaaactttcttcactggcttgcacttaaagaaaagatgtccagcatcttcattataccggccacacatcacacatctagtatcgacatccatacctcgatgctgcaggttagcacgcaacgccagcgtgttgtggcacattctccacaagaagtgtttgatctttcctggaacacccagtttccagagcttcttccaaaaatcatcatccccactctcccaatttgagaccccagggcatccgtttctgctagctcttctctccatctccctttgcaccttgtaagctgatttgaccgtgaagcatcctctcgcatcaaagtgccacgccaaaacatcctccatttcaacatgcacaggaatggatttaatagctgcgacgtcctcttcccaaaaagtttgtgacagcaaatcttcatcccaagttccagtataagggtcaatcagttcctccacttttgtcacaaggttagcgcctctgggtgtcataggtttccttgaccatcccctcgggatccagggatccgcccagatgttaatcttcgatccatctcccatcctccatatcatcccattttgcaacactctgagacccttctgtatgcttctccaagtataggaaacatttgatgtctgctttggccggaaacagtcccccagagggaagtatttagctctaagaacccttgagcacagagagtcagggtcctgaatcaatctccatccttgcttggctagcatcgctaggttgaagatgtaaatgtccctgaaacctaagccccccatattttttggcaatgtcaatttattccaacttaaccaatgcatcttattgtccttctcctggttgctccaccagtacttcgctatcatcttgctaatctgatcgcacaaatcctttgtcaactcaaaacaccccattgcaaaggtgggaataatatgcaggcgttttggatgagaacggttcacaaagactgaaaaatatgaagagcttgtgtgttcttttgtgataattatatgaattattttgtaatgaatggctgaatagatgaatgatttgggataattatttgatggtacaaatgaatctataaagtagaaaattggatttaaaacagtattataagaaattcgtatatagaaagtttttctcaaaaaatagtactggttaggagttcaagaatcgtgccggttaattcattcatccattaaccagaaagaacaggcaatttgactcactgaagatagaacaaaagcttttgggtacaaattgagacaatgcagagaagttgaatttacaccgagtcaaagacaagtcttatgcaatttgggatcctgctgctgtgatgaacatcatgatgcaatttgagatacagggtaaaggtatgtctgatgcaatttacatataagaccagctctgttcatgtcagaggaaggacacagcgagcacacaccaagatccactggacagcaagtaaaaaggttatcaattgtattaaatttgatagcatccatgataaaacaagatttggtaaagaatagatgaagccacatggtttattgtgccatataggtacatcgagaatcgaagctatcctgtttatatagtacccgtgcaagaaaacacagcaagtcagcagctgagccaactgacctaaatagaagttcatggagcgctttgacaccgactgcacaccaaagattgctctcatatgccaccacttgtaaaacaacggtaatactaggtctagcgccattgaaaacaaatcattgcggagataaatctttagtacggcaagatagtatgattgctaaaatagtttttttttaacatccaaacaagtgcaattaatagatgctccttcgaacagccatcatattcactgggaatgttagaattggggaattgagttgttaaactaattatttagcttaaatccatggagtttcgattcacaaagcaacacattcatgtacttatgaagcaaaccgcccaaacataattcctgctccatgtttttattcaatcacttcctctcagacaacatcattttagagagatcacaaggatcatcacaacaagcaacacgatttattttttttctaggcagttgccttcatcatctctatgaccttcttgacagacggcctggccaacatgccatcgatccaagccttcacaagagggaactcatcgagcatagcagcatgaggggtggccagcaggtagtacgcagttgggaaatggctcagatccgcaaggctcaggaagtctccagctaagtacctgaacttgcacagacgctcttcatacacctgaaatgtcttcttgagcttctccagattctcttccacaaccttcgcatcggtttgtccaccgaaatacacagggaggatgaggcattggtagatgaccacggacatgggctcatcgaaatggtgtgactcagcttccagccacacatcaaccttggcagcgtcagaaaggttgtgctccttcaggagttcagagttgttcttacgaagcacgtacttcgaaattgcacgtgactctgttgaaacagtgtaaaattgtatggattaaaaataatcaagaacgaaaaaaaagtagtgaaagcattttttcccctcgagggaatgtcttctttctttgcattgttatctaatagttatgaatatttttttaaaaaatattttgataagatgatagatacatatgcgatatcataaattgatctatcttattaatttttttcataactattttggtaaatgcaagaaataaaacattccctcgcgaaaaaaaaacatctccgaaaaaaaagactttgcatggtgggaagaaaaaaaaatctcaccaaaaagaattaaatcaccatcctgaagagctgggacttgaccaaatggctgtatgagggggaaaaagagagaatggaatcatgaaaaatcaacatagtcgattgatccaaaagttcagacaaatggaagttattttgtccatgaaaattgatggaaaaaaaatggagagaacaagttgtaagaataacttacattacgtgaagtatgctctgggctcttgtgctcagcaattgagaaatcaatcggaacaacttcatattgttccccagcttcctccaaacacaccagtacgcgggctacattggtcgacattggcagcccatacaccttcattgccatctccctgtggaaaacctgattacgaatgaaatgaaaatgttggaagctatgaattggtgatagatgacagcttaagttgtgcctttatataggacgacatgaaagacaggaaaagtggggaagtgatcagtttcttcattaaaagtaaacttttgaaaagatctcacatgcccaaaatttatggaaacagtaagtgtgctaatgaagttaagtgctgctaaagatgcttaacttccaaagttagactactagaattattgaaaagtctatctgtgtgcgagagagataaaaataaatccaaccgttttgcaagatttatggagagaaaagagatataggacaaatacttccaaagataatttcgctccacaatttgatgaaaagtgtgtaacgcatgaaagagatagatgctaaatctactttatgtatggaaggatttaaggaaaaaagtaagaagtatagggtaaatttatttctatcaataaacttatttgctcccaaagaaagcctccttccaaagttagtccagaaactgaaaaaaaaatatagtaaatttcacaaaactatatatactttgatcaaattatcacaatttatagtgatgtatcacaaaactacatatttagcactaaatttatcacaaaactatagagttaaggtggagtatcgcaaaactacagatttaataacaaagttatcacaaaactacatattttagagtttaaatccttagcactagtgttatgtttgagttatacacgtgtaagttttatgattaaattatcactgaacctgtagttttgtgataattttattgctaaatctatagttttacgatactctaccttaaatctgtagttctatgtgaaatttagtgttaaatttgtagttttgtgatatatcactctaaatgtgtagttttgtgataatttggtcaaagtatatgtagttttgtgaaatctttactattataaaaattgaagatgtttttgccagtactttggtacgtcatctgcgtatgagtcagtttttaagttcgtttgcttttgaaaatacatatctgtatttgagtcaggttttaagttcgttcctttttggaaatacagaaggagtcatataagaaatctcttttttaaaaaaaactcgcatgctaacttgagatgatcggactcctaattgcaactcatgattttctagaaaactatatatccaagcgaattctcacaatgaattttaccttaactagattatatctctactctctgctattataaaaaatcaaatatgtttttgctagtactttggtacgtcatccgtgtataagttggtttttaagttcattcgctttttgaaatacatgtctgtatttgagttgattcttaagttcattcgtttttggaaatacagaaagagtcgtataagaaatctctttaaaaaaacacgcatgttaatttgagactatcagactcctaatcgcagctcatgattttaaaaaataatacatccaagcgagttgacatagtgaatttcaccttacctaaaccatataacaataatatgattaaaatagccttcacccgttgcaacgcacgggcatttttctagtttacttaaaaaaagagagaacttgtgtgtggtttttttagagggattgagagagagcgaagtcaactactccctccgtccctgataagtgcacttctactattcaaatttgtccaaaaaagagagcagtactatttttccctccaaccaactttcactctcaaccataactcatttaaggggcatctattttgttttcttaccctccatctcccttattgtgatgtaggagaaatcatatatcttctgtaaaaaaacaatgcttaaaaaaaattcttccaagagtgattttatataagagtgaagtgcacgagcggtccttaaacttatgtgggtgtgtcatctagatcccgaaactctcaaaatgcattttcggattctcgaacttgttttggagtgtcatatgagtccaaacgagctccaaccccttccatgcgctgatgtggcatgccatgatagttcatacgtgttagttggacacacgtgtcagccacatagaaaaaaatataagtagaaaaacatattttctcctctctaccttagaatttttatattttttctgtctacctaataggagaaaatatggtttttaattttattttgtatatatgcttgacatgtggattccactaacacgtaggtgtcactgtggcattgccacgtcagcgcatcgagtgggttagaatccgtttggacctatataacgcacatggcaagttcagggacctaaaaatgtattttagaagttcggggacctagatgatacccggcagaagtttagagaccgctaatatacttcactctttatataatgatccatgagtaagtaccatttttagtgtaaaaatggtgtctgtcagaacctcaagtacaaaggtaccaaactttacgttagaaaatatgccacctctaagtaaagatcgtaaaatttctcgtattgcaaacttgtatgaaaagtgaacatgtatgaaagagatatatgccaaatgacctttttcatgatttatgaagaaaagagtgaaatatagacgagcaaaatttcttatagacaaaaagttataaaccttattgcacatcagtactaaaactaaattgtgactatataaatttcaaatctgtaaaatgggctactacataaaacgacatggaagggagaaaaagtgggtaagtgatcagtttctccattaaaagtaaacctttgaaaagatctcccatgcccaaaatttatggaaacagtaagtgtgccaatgaagtaaagtgctgctaaagatactaacttccaaagttagactattataattattggaaaagtaactgtctgtgtgtgagagagaaaaataaatccaaccattttgcaagatatatggagaaaagaaagtgatataggataaatgcttccaaagataatttagctccacaatttgatggaactgaagtgagtaacgtatgaaacagatagatgctaaatctactttatgtatggaaggatttatagaaaaaagtaagcagtataggataaatatttttttatcaataaacttatttgcacccaaagaaagcctccttccaaagttgatccagaaacttaaaaaatgagaaacatatgtgtttttttcagagggagcaagtaaactactccctcagtccctaatactatttaaatttgtctaaaaaaatagagtagcgctatttttccctccaaacacctctcagtcccaaccataactcatttaattaggggcgtctattttatttccttctatcaaatctcccttattgtgatgtaggacaaatcacatatctttttttttaaaaaaaacaatgcttcaaagaaaacattcttccaagagtgattttatatatgatccatgcgtaggtaacatttttggtgtaaaaatggtgtctatcaacacttcaagaacagagataccaaattttatgttaaaaaatatggtatcattaagtaaagatcatgaaatttctcttattgccaacttgtatgataagtgaacatatatgaaaccgatataggccaaatgacccttttcataatttatggggaaaagtgtgaaatatagggccaataaaatttcttatagataaaaatttataaacctaattgcacttcagtactaaaacaaaattgcaactacataaaataaaaaagttggaattaattggtacccttatatatagggcgacataaaaggcagaaagagaggggggaggggggatgatcagtttctccattaaaagcaaacctttaaaaagatttcccatgcccaaaatttgcagaaacagtgtgccaactgccaatggagtaactcccaaagttagactacaagaactattgaaaaacaactatttgtgtgtgagagcgacggaatcaaccattttgcaacatttatggagaaaagaaagtgatataggataaatgcttccaaagatagttttgctccacaatttgatgaaaagtgagtaatgatgtatgagagatatagatgctaaatcaagtttacatatggaaggatttaaggaaaaaagatgataaatatttttttatcataaacttatttgcttccaagaaagactccttccaatgttaggccagaaactaaaaaaaagaaacatatatgtcaatgtttcttttcagagagagagagagagagagcaaatcaacttctctcagtctagtgtccaacgtgaccaccacacgcatttggattagtgggatccatactcgcataaatagtcactcatcctcagtgtatccatgatcgtagttgacacctttcaatatattaaccacgatatcgagtagtgagtaagagagatattcgatggaatagcttgttagttgatttcgaccaaagatatgccccatcaaaccattcgaaggtggcgaccaaatgtgttatatatctcaaaggacttattcaaacgctatattccacgatcatctcaattactcaaaacacttactcatgcttagctagttcccaggaaaaagcgactagcctggcactttcgtctgcaagcaattgatagcataacaagtatttaataaaattaaacacacaacaaggtaaatattacacaatagggttcataagcccttcatacatcacaaatatagtggcagaagtctcaacccatggtcagccaatagcccacaaggcaaccaactcagctactcactaccctcgccacccttggctggatagtagtaggacacatcaaagtcaccggtatccttacctaaaaatagcaacatgggtacaaatagtactccgcaagacttacacaatatataatattacaaaggaatatataagcttgtatatcaaaggaccataagggttcagattttgcacaaagcaagttttgttgagcaagtaataagttaaaactataagaatttgcaaaataacacaatctgaaatttatgtacaacaagtatataaatctgaatgtgaacaacaaatgagcacaacaggctctaaacatcgtccatggaccacccttgctcaagcaaccattagccacttatccaccaagattaaccgtgactaatacccaccatttatcccaggtttgatgctaacataaactgactaatacatcaagtgatcatcctgtaaccatgaacacggctattcgaatagtcttactcgatcaaatgcttcacacgcacataggtgtgaccttcaagtgattcaagctcataacatatcctttctcaagctcagccccaaccacctaaaccacgcataggccctcgataacttagccgtgggcatgtgcgtgtgactaagttaggattaccatcgtgggagataccccctaccaacctatgcacgcatgggtacctccaagggaaacatcccacacgaatgacgaatgggcatagataaccacaacttcactcggtactaagataagccatcccatgcctagcaagtggaagtacgtagggtgcttgaatatacatcaacatgttccgtccttggtgaccggacatggctacttgcatcggggaaaacactatcccatcatcgtcctatcacccgtccaagtcatgtatattctcaaatttaatcgaatgtcatattcttagtactcgtaattattctgggcatgaacaccaatcaactgatcagtttaggaagcacgatcgtttggtaatttctactatctatgtcccaaattagtggtcgctttgactttttacttgcaacgtttgaccattcattttatttaaaaaattagtgcaaatataaaaataggataagtcatattaaagtacttttgataataaagcaagtcacaaaatataaataataattccataagtttttgaataagaggaatggtcaaatcttacaaagaaaaactcaaaatgacaactattttgggtcagaggtacgtaagtatcctattttactgcttgtttctgaaaaactttacaatatgtgttgtcagtgtacgaagcaaataaaatgattgggctaaagttacttaattctctcaggtgtaggaaagtttcggagagctgcccatcatggaaaagctgtcgtggttaactggctctccttgctaatactaagtcaatagtaaaccacgctttattttgacttcttccatgcatgggttcgtttccatttcttatactacctccgtttaatgagcgaccatataacgacttcaaattatctgtgctttctagtggcgtttggctagccagactggagtggatatgatgcaaataaactgtattctctttgactatctacctagctagctatcacatatatatataatatacgtagtgtcatcataccaagaaaaccgcagttaagcatgtgaaacattttatcaatcgggtgagtttctctgaagaagctgccacggtgatgctgatgcctgcctatttatatatgcttttaaaatcaaggaaacaactaacgttcctatcacagtactatcactctttgatatcgtcgttaattatattagtacagcactacagctcctcttcttgaacaagcagcagatagctatcctggtccattcctagtgcatgcatgtctgcatgtcttggtcagcaagctcttgcctcgaacgtgtccatcgatgccaaggtgtgcacaagagtgcataatttgaattgtacacgtttcctgatttaagtgaaactaaatatataccgagtattaactgaccatgaccaagtttcaggtcaagtgatagcgacattataattcaagatcatctctcgatcctcagagtcagaagtcagaacactgcaggtctctctctgattctctcacttgcagcttggtcgccaagcaagtaattaagcacgaagcaagtgtgcagcttccagcttaattacctcagctgctcgcatgcatcctatataaagcctccagtaactgcaactccttcagcaaaagaaaaacattccgtagtcagttcgatcggtgctcatcaagtagctaagctatttaagcgagcattaataagacatacacactgtcacttacgtactagttgagctagctttgttaattcccctcgtgttaatttgattattagccatgggaggcaagaagaaatccggctctggtttctggtcgtcggcgtcttggttcgcgtgcttgggcgcctcaaaggcggcggccgcgggctccggctcgggcggccacgccgggtatgatgcggccggcgggatggttggggcggctaaacatttctccagttctcacaagataaactttggttaactgttaatggtgcatgttatcatgtttgtactttgtacataatagaattattatctgttcaattactgtagcacacatatgtgtatatatttaggattcataaggtcgttgttaatttgtaaaaagaagtgttcgattaagggccggtcaaataggtcctgaagtttctacttcgaataaaatagaaagagccaggtgaagatgtgaattgggctcttaaatccgaaatattgacttatggcaaacgattttgtttacccaggaactattgcgctgccgctgaccctgcctgagaaaatgcattctaaactgagtacagccatgggctcaagcctcagcaaattttctcttgcaacagctattacacaccaactagaatcattaaatttaaactcaattcaacagataagcaacatcatcgtacaacgcaacctacaactatatatacatcaactcaaataatcctccactactatgtatcaacaaatcttcataacaagccaacaaattatccacaactatgcatcaactcacaacaaaataattcaccataaatcaacaaatcgtatattaacttgaattcaacaaagatcacatcgagccaacagatccatcggtagaaactgttgcctcctcaccctcgggtccgtcagctgccatggcctggatccaccgattactatggccgccctaagcttctaaaaaaagaactatacgtttcatatagagagagtggtggttggggggggggggagggaggaaggggtagatcgaggagcgggcttgtggctgcggaggttggcacgtcctcaaatccaccagtgtggtcgacatcttcattaacgaggagcctcctatatatatgctagccccttgcgttcattctcggctccgagcgatcaaattctccaccagggaggccgtggctgctagatctagtgagcatggtcatcccttcacaggaaagggaaggggaagtggatggtgctcactattataaattggcataacgcgggcaacaagaacattttctcataggaggccagccgcgccgcttgtgactagataacataggccggtgaaaatggatctttttgctagcgggcaaccaattatctatgagaaatcattttcgttggtagattacttagcctagccacctatgatgattttgcaccaattttgaatttcaattaccattcattttttctctgcaaattttgaatttattattcagattacctactataaatagaatcaatggggatttgattaggcaacaatcaagatacaattgggatttcatgcgttacatatagaaattaataagatacaatatgtcataattaagacaagctattaatattgttatactccctccatattttaatgtatgacgtcgttgactttttaatcaactactcatcttattatcaaatgacttatctgtgactcatattatcaaatgactcatctgtgacgggtgacaagttttaacccatcagagatgacttatataccggtcagagatgggttatctgtgacgggtgtttcatccgtcacaggtgattttgtcatcagtgaccactaatcactgaccaagaccaaacccgttaaaggtgagggtttgggcccgtcagagatgacctggtccggcgtagtgaatagtcttggtccataattagagactcgtatttcttgtctgggtagaaatgatgtactgggaagatcttattatttggtcccactcgtagaaatgttgtattgggcaaatagtttgtattatttggtcccacacgtaagaaatgttgtattgggcaaatagtttgtacagtagtatctatgtcattaaattaatagtatagacatgatacacatatagtgtctactattgttagtgctctaagcagtctcctcttacgtttctgtcttgtccgaccaatgcaaacaaacaaaaaaaaaaccacactagtagtgtagcttcgtcacaaatcaagcatgctaagaaatcgatgtaaggtttacaatatgaaaaagaaaaggtcaaagcatgtgagctctataggaatcggtgagtttctctgaagaaggtgccacggtgatgaaacgaccatgtaactaacttccctatcactgtctgataaatagcttcttcttcaaaagcagctatccaggaacattcctaagcatgccatgattagcatgttgccagaagattaaaataaaaacagcttgtatatatgattgtatcaataaagacaaggaaaaaaaaaacgtcgacttatgtcaagatgtacagggggtaatacacaaaattcaaagtacacgtttcctgctttgggttaaatttaaactgatgaggaatacaatgaccatgaccatgtttcaggtcaagcgagagtgacatcaatgcacaacacggcacaaaatgcagaacacggcacaaccgtggactctctgactctctctcctcatttgcagcttggctgccaagaaagcttataggacccaggtcccagcatatgcatacctctgctccaagcctccaatgctatataaaagcctccagctgcaaactcttccaacagaacagcacaagaaacacaacgacacagtagctcatcaaagttgaaacaaactagcagaggaaatccggctccagtttgtggttcagttcatcgatcacacagtcgtttttgtagtaactgtttagtcatgggaggcaagaagaggaaatccggctccagtttgtggttggccgtggcgtcttggttcgcgcgattgggctcaaaggtggtggcgagctctggctccgccggtggccgcgcagggtatgatgcggctggcgagatggtcagggcggctaaacatttctccagcgctcataagataaactttggttgagtacaatagtactcaagtatcatgtttttgtacataatagatttatatatgtggttttcgctttgactttattgtagcacaagtgtacatgtatagtgacaatgcattagatttggggttaaaagttgtttgcttggagcacctgtaattaattgtttgctgtttaatggacaaataggtcctcaaattactacagtatttgtgataaatagaaaggcaccgatgaaaaacttaaatattataggatttcagatgcacttggggagcatcatcggagcgaggattgcgtgtttcacactgataaataaaacatttttccagacgagtgattgcccgattatacacccccatacaaaagatatcacgacattacgtaaaaaacctggcatatttcttctttttagaaatatagtacaaacgtacacatgtgcacactcctcttcaattcctggtttgtacaatttgtcacaaaactacatatttaaaaacttgttttataaaactatagatttaatatcttcatttatcacaaaactaaaggtttaatgtctttattatcacaaactacatattttagcattgttgaaacctatagttttgtgataatggagacactaaatctatagttttgtgataaatgaagatactaaatgtgtagttctgtgataaatgaaaacactaactctgtattttgtaataaatgaagacactaaatatatagttttgtgaaacaagttcttaaatctgtagttttgtgatatattgtgtaaagtatctgtagttttgtaataaacaaagatactaaatctgtagttttatgataagatcgtgtaaagtacatgtagttttataaaatttactctaatatcattgttatcaattgcagcagatacatatcaagttctccagaatttcctaagcaagtagtacaaccatagttcttcacaagtccagaacctggtgtgagacttgtcttaatccatggcttgacctcaaggcctaattcgcaagccattttggcaactatagcagctcccagcattacaattggattcgaatcccatgtttgcgattgtagccctatcaacctgcagtgataattcactcatgcctcccccgtaaaattcagcaaattaaccgacaaaacaccatgtttcctatcagcctgaagtaaacattcccgagttaggaataattaattatttgccactcttacaagtcgcaattaaagatttgtcattgatcccacgtattatagacacatgagaacccacaggttatatactgcgagtggcaaaaagttaaatgtccctgctaggaccaaatctgtattcctcagcttccttgtcactctaacttgaaaccgacaagccctgacaatactatgctcattggctgcccatggccaagcattgcagcttctgcctttataccatcaactcacccatcagaaacaccggccaaggccatctgtcatagtttgtgcgtaagtccatttctacaacgcgatttatacctctttaaaagaagataatggttcacttccatcaccacacttatcaataacatataactggccaaatgggtcatgccaagctaggccagagtatgactagagtatgactgtattgtaccagcccacgacacgacatggcacggcacactggcctgtgggttgtgctggcatggcacggttgtctacgggcaagcacgagcacgacctgtctggcccatctattttttctgtatatatttcctaattttccattttttcctatttttattagtcatatttttcctattttcccttaccttttcccatttcctccatatgtttactcattattttccatcctttttactacttttcctatttttccaccttcactatttctttttcgctttttatttttccacctcaaatttcaatttccataggtcatatgtacagttgggcctgtcattgacccacgagccgtaacagtagtcgtgctgtgatggcccagcacaacacggtgtcttcttgagctattcttgggccgtggccttggcacataggccgacatagcatagcctgctacaggtgtcgtgcctaacgaattgtactaaagcgggttgtgttgccagtggactcatgccgcattgggccaggccacctgtttggccagctatcggttctcatatgtactccttagagttaaaaggtaaaagaagagagtaacaagaatagcttttgtttgaagcaaataaaagtgggtagttacataaatgtattatttgattctagaataaatctaagagctttttgggcaattttaatttttcaatctcttttcatgattattaagatcagctaaaagtctacctacggttattgttaaaagtcaaagtacaaaattattatatatcgtcttaatatatagtaatgcagccatatacccatgttaagtcttgtgcggttaatcccatgaagaagggatcaaaggaaattgagggggataggtgtggaattaattctcctccaatccccttgttagtgagattaaccaaacaaagttttaacatgtaatatcatatgaagtttttaaatcctgtatcaaagtaagtacggcaattctgctaatcagggcaaaggatcccaccaccattgttaaacacaagtctgcccagatattcaaggttcacctgatgcaaaattccagatccaggtggaacaacaagctttttttttattaaaggtggaacgacaagctaagcatattactaaaagcagttgaagtgttgaaccccatttcaaaaatccgaaccgctgcttgctacgatgaaactctacctccatatctgcttggacagcattttctgatcttgctacatcaacttgtactgaatgatcaataagggcaatagaaatagcaatgtggcatatgtgtttgccggacctcacatccctcgtaggctaaggaatggtgaaagacacaaggttcacaatgttgtaacctcaagtggggtccacaaaaatagttttccctttttttcctccaccttcccccttctctctctcactctccctttcctcgaaaccgacgctctcctctccccctttcaccactctagccaccaccactgaaccgcccttccctctcttcccttcggcctcctcccttggcggcggttgaggagctccccgctggcacgaccgcgtggcaatgcaaggaagatcgagccaccccgccgcccaccacaaccgcccctccctcgcccgctccggccaccaccactctttctctccccttgtggcctccttccttggctaccccaaatccacgcagcggtggcggtcgaggaggacctggtggtgcgggcgacgagctcgctggcagcgtggccggatggggcagatcaagccgatgacgcccctcccctcactgcttcaggcaccatcgccccttcatctcccctccggtttcctcgctcagcgcccttactcctctcccctctccggcgcggatcgaagcaggtgggaggcgtgggcaaacgaggtccccggcgagggcaccttcgttggggtcagactcgtcgccacttcaccacctccgcacccctatccggcttttctcttcagtcagacacttttgtttcccccattctctctctctctctctctccacgcgcagatgaccactttttctgatcgagaactgctgcaagagtgggaggttctagtgaccaactatggtcacgcgaagccggtgaaggagcggtccccactcccctctctcctacacgcaagcaatttgtctatgtgaaccaacattgtcacacgttacgtatgtgccctgtgaatgacctaacaaggtccacaagtaccagaggattatttttgtttgggtcactgcctagtttgctatagcatccacaagcatggaatatatcattccacaaagatgcaagttcaaaaacattttctacaagttttaacaaaattacaaattttctgcaaatatatgtaaactcgttacattttatttattgcctatatattatgcattaatctatcttgtcaaattttttaaatttttttcaaaaccatttagttggcatgcatgcaataaacgggtggacatccacccggaagatttaaatccatctccgattcaacttgcttcattgtgctgttctcctagtccaggattttctcaacgtccttatcaatgatgaaagggccaactttgtcaaatttttgggaggtatgtgaagctatcaaaatttatgctacaaaatttgatacctcatagtatcttctgatatcctcaaatccacatcaaagggtaagcccagctcttctgagatattagaattctgcaccaagagataaacattgcccttgaattagggacttgggtataaaaaaaaatataggcaatacagacaacctgaaagataaagatgccccctgcctggtgataaaagctagccacctagtctggctgaacaggtagcttgcattgcgttgcttttcgactcggcacatgattctgtctcaagattgcattgcagctgcgcaatgcagcgtgcaacaacctggttttctgaccagagaagcttttgcttatgtgatgacagattccggccttgcctttcaagccacctggctggagatgtctagcaaaattccttcatgtttatgcctatagatttttttttttaaagaagatcatgcaacatcattcggtgttcataaaaagaacctctgcttcttgttcgtaaaggattggaaactgttttactattgcaaatcagaaataaattgtcgacagtttggcaaacacatctcatgtcgacagtttggtatacacaatgacaaaagcggaaagaaaaccatgtgttcgccataaaccacactcacactgtcagtcagacgtcagtgtccggccggctaacaatgccggcgtggccgagcaacgcccacagcacggtgatgaactcgccgccacggcggagcgccttggaatgcgccgtgacgttctccgacggcgcgaggtagacgacgagctccgcccagaaatcggcaagcaccctccagggcaactcctcgtcgccgccgagctcctccgccagctgccgcccgagcttggccgccttcctcagcgtcgcgttcgtgctcccgccgaggcacgtcgccgcgcgctcgtaccgcaccaccgcccctgcgaaccgcgcgagcaccctcgacacctcctccaccacgccctcgtacagctcctccgtccaggccgggtggtccggcaggagctccggcttcagcgccaccaggtaggcgcagtaccgcgacagccgtgtcgcgacgaccaccgtgtcgctgtctccgccgccgtcgccgtctccgtcgtcgtgtctcccgtgagcgccttctgatcgcatgatctcgagaagcctggtcgccacatgccataccaggatctgctcggagacgcttctctcgtcgccggcgtggtggcacgcccaggcgagcttgtcggcgacgccgttccgctgcaacgagagcacgccgtttcccaggtttccttggttcgtccttagcgtgtccacgacggccgtcttcaccgccgccggcacagtggccgacgacttggcgatccggtcaacctgccgggagacgcagccacagtagcacggacggagctgcaggatggacgtctgcccgaaccgatcgtcccagcgctgcattggcttgagcgggagaactcggccgacgttgcggcgagtccatggcgacttgcgccatgacggccggcgcgcgtactcgcagatggcggacaccttgatccagtcggagcggacgtaggtagcgatctcccacccctccgtgaacacgatggcgacgatgaaggagacggtgacgagcacgtcgaggccgacgatgatgtggaacacggtgtcgtggttctgcaggtactccctcaggttgtcgtagttgctggcgagcgtcgtgccgtggcacgtcatgtcgtgcacgatggcgccgccggcggcgaggcagctgacccacgtggcgaacacgagcatcgagttgagcaccgggaaccaccacccgctcgcgtagaagacggtgagcttggagtagaggaagtcggcgaggaaggacagctcggtctcgatcacccggaacacccgctcgtggctctcgccgaggaggccgtcgagcacgaacgccaccgaacggcgagagcccgcctcggcgatggggcacccgacgaaccgccggagctgcagcttgaacagggcgaacgagaggcatgtgtccttgatctgcgggttagaagcgacgagtggatcgccggaggagaacagccggcatatccggtccatggtgaccacatgcccggcgtcgacgcacaatggcggcggcgatgtccggccaatgcggtacccctgtggcctcgcctcgatttgcagcttctcctcgcccatcaccaacaacggaggagcttgcacgtcgtggtctccttggtcttgcccgtacagctgcttcatgtagtcggagatgaggtaggcgttaaggccgacggcgaacgagttcttggcgagctcggcggcaacgaggcggtggacgagcttggcgaggctgagcacccacagccacaggagcaccccggtgagctgtgggctcccggcggtgccgtcgctgctgacaatgaggaacgccacccagcccatcctcgccagctgctcgacggagggcctgaacttgctgctgccgctgccgttgccgatcgtggacgaggacgagcgggcggtgtcgatggtgttgcgcagcatctggaggaagacggtccaggcgaggaggagcgggacgcgcgcggcgtcccacttggcggcggcggagacggcgtaggagacgagcgggaggaagagcgtggaggccgcccagacgaagaggcggagcgccgggtggccggagcggcggcggtaggagctgagcacgacgaggagggcgaggaggacgatgctgacgatggccgccacctccgtgaggaggaggttgatgaggctgctggccatggcgaattggcgaccaactcgatcgagatagtaaaatcaatcaatctatctgagagtgatcgatcgagcagatgaaggagatggcatggacgcatgcatgcgtacgtgctatttggaaattggagttactgatgattaattaagatgccattgcagatggaggcgtcatgtgtgacagtggaaggttgcactacaagtcaagtaaaagacagcatatacagtttgtgtgaagaggtgaaattaaagtacaagatgaaagggtgttaattagagggtttttgttactgacagaccaatggagacgatatttgtcgcctcagaaaaagcacgaggctacctatcgtgttaacttcagctttgaactcatatatgtggcttggcgtgagatcgacaaaagaattgagagcatcttttgtataattcgtcaaagggattaaaaataaaaatatagcggattttttaggctagataaaatgggggatcca

SEQ ID NO: 40675 - DNA, 6966 bp, Oryza sativa
tcataatacttttagtgtgatttataatttatacatttgcataaattttttgaataagacgaatggtcaaacatgtgagaaaaagtcaacggtgtcatctattaaaaaacggagggagtatattactacacctccagaatgaacaagacacgtcttgattttttttaaaaaatctttaattgtcatgagttcaaacagtacaatagattgagtaatgtttttttcactgaatattctttaatgttaataaatataactctgcatgttttgcatggcaagctgtgaacctgaaatgaggctgatgtcatgattaattagtccgcatatttgcatgcccattttggtagtttagcatgtgtaaaaaaggtaaattatggacgatggtctgtatatatgaaaagggtaattaacattaattgattgtgtagagaggaatcgtgcgctgtttacagtttttcgtgtaaaaccttgtgaacaggaggaccgtggtcgtttctctctaccacgtgtacagcagcaggtcagctgggctgcatgcaggctttatgacttagggcatgtacaacccgtctcctcgccccgtctgtgtgttggtgattttgcaaaaaaaacccgtgcacgcgcagagacgggcagcccggcgcctcccgacgcgacgagttcatcccgttctcccaggtggagtcgacgcgagcccacgcgctgtagagcgccgtcatccccaggcgacgggcgaacggatcccgcgtgcggccgcgctcgcccacaaatttcccaggcaaccacgcgcgctgttctcccgcgctctgctcgcgacttgccccaaatttcttcgcccgcccatctgcgcggccgccatctgctcgccccccatctggtattctcgccggagttggtgcggcgggatgtccacgcccggcgcagcttggagaaggaatggatcgaggacattggatgcggcggcgacggccccaggccgaaccctaggtgtcggggcggcggcggcggctccctcattcggtcggggttcttttggtcacgctgtcgggctaccaccgccgccccgttctcgcggacacggtcgcgggtcagtagcggcagcgacgaccgtcccggctttctccattgatggttctgtcggaggtgacttcaccagctcaattggtccccatgcatcgtctcaaccttggtttgatgcggccggcggtgatccctcatctcctggatcatggtaaatccttgtttcattgctgattttgtagttgatattaggcattgtgaatctagataattttgtagttgatattaagcattgtgaatctgtaaatcccatactgttgtacctggatcccttttataccatattttaacaatgtccagaagtgattcattgaactctttgttagatattcaactgcataaatgattatcatacaaaatgaggcccatcaagacttctgtgtgccaacatattgtgactctttgtgtagattgtgtcttaatagagtaaaaatagcccatcaatgcttctgtgtcaactgatcattttaagctaatttcatattttaagctaatttcatgttaagcttctgtgccgaaatcattttaagctaattttaccttctaacccttcataaatacagccacaatagtactactactgcatctgaattttatttgtagatggaccatggaaaatttcatgttaattgcaatttcctgcagggaccaagatgtacgtccacctggtggtttcatgagctattttggaaatgaagcacagaactctcatttggttggtgcagttattcacatgagtcctctgaatcaggcacacaatggtagttcaccgcccgaagtggaaatattacatggcaatgacagtgttagaaccgagaagaggatcatgtggactccggacgaggatgttagagtgatgagcgcttggttagaacattcaaccgactttacctgtggtgcggataagggtggtgtccaatattggggtgaggttgtcgaaacgtacaacaaaactacccctccacttcgaagaagaaatgcgaagcaatgcaaggatagatggaacaagattaataaatggacagacctctttgaatgtgcttacgctaaggctcgtagagtatttacaagtggatattcggctgaaatgtggcttgatgcagcacacaagttctatgtggatgacaacaaagaatgcaaagacgtggttggaccttatatgctgacagaggtttggaaaatttgccgagatgtgccaaagtggaaaacatataatgaaaacctgaagaatgcacgtaaaaggaaagcattccatctggaaggagaatctgaggaaaatgaggacacttgtgatcagatgccacaacgaccaattggtcagaaggcagctaaaaaggcagctctagctgctaaaaatggcaagttaaagggttccagcagtagtgatgatggtcactcaaaggattctcctattgagctagacaaatttgatagatacagtaaattttaggaggcaaacaatgagaagcgtatgaagctattggacaggcaagagaagatagcttctgagaagctagaggccacaaaaattgcccaccttacagcacaagagtacaaagaaggaaagaagcttgataaagagacaaagatgatggagacttataacaacctcgtttcacaggatacaagttcaatgtccgatgaggaaaaggcacagcgagctatgatgatgaagtgtcttatgaaggccctttttcctgaaactgtttgagaaggtatttcttatctgtgtagttctgaaatttagcacttgtagttctgaaatttagcacttgtagtagccatatatgaacctcagccagttctggtatgaagatatgaagtttctgcttatttagtattctgtgacaaacttgttaaattctgaaattctgtgacaaacttgttaaatttagcacttgtagtagccatatatgaacctcagccatatatgttcagttttctgctcattcatgctttttttttctgaaattcagttttctgcatattcagtagccatatatgaacctcagccatatatgttcagtatcaatgttcagtatactggtagttttgccgtgttttcccttactcagtacccagccatatatgaacctcagccaaattcagttttctgcttattcagtacccatatatgttcagttctcccttactcagttttgctctataggccataatgtaaattctgaaattatggtatcctggtagtttcagtttcaggtatcctggtaattaaattctgaaatccaattaaatgtgaaactgcgcatgattttctaaatggtaatgacagtgctttgtgaacttgacactgtgtgtgtgaactgaaactgatcgcagaggatgatatttttagtgtgaactgaaactgaaactgtgtgtgtgaactgaaactgtgctttgtgaacttgaatgtgaactgaaactgcgcatgattttctgaattgtgtgtgtgaacttgaatgtgaatggaatggtcatctttttagtggtgccggagttgatcagttttctgaaattcaatgctgaacttgaatgtaaatgtgaatggtcatcttttaagtggtgctggagttgatcagttgatcagtttagccgctgtagtgcgacgttgatcctttttagtagcttgaatgtcccccttgaatgtaaatgtaaatgctgaatttgaatgtagcttgaatgctagtagttgatcagtttagtggtcccgatcagtttttgtaaatatgaatggtcatatttttttattctataaaacatcgttgttctgtgcgctcctctgtacactactccaccatccaaacacttgcatcaaacaaggtgtatcgtaactctttgaatggagccgcacgaagaagatgaagtcgaagatgccgaagagtttgaagaggtgttcaccgtggaagacttaatcgtagaggatgatatttttgaagaaatagtagcagagggattcaaggccgacatggacagagaagcatcgaagcatcgactgtacatcgccgacgtcgacagagtggaccaaggaggtacataccaaggaatcgagaacaaggtcatgatgatcttgttgctaattatttttccgcaaatctgctaattatttttccgcaaatcctatctacaccgatgacatgttccgtaggagatttaggatgaataagccattgttcctgcgtatcgtgcatgcacttagcgattggtccccttatttcacccaaagagtcgatgctattggtagaaatagtcattcaccacttcaaaagtgtacagcggccatcaggatgttagcttatggaacctcggctgatcaacttgatgaggtcttgaaaatagctgcaagcacttgtttggagattttgggaaaattcgctgaaggtgtgattgaaacatttggtgacgaatatctacggcctccaagaagcgatgaacttgaataaatcttacaagaaaatgaggctcgtggttttcctgggtgcatgggaagcatcgattacatgcattggccatggaagaattgtccgaaaggttgggcgggtcagtttacaagtggtaaacaaggtgttcctactatgatccttgaagcagtggcatcaaaaaatcttcgtatatggcatgctttctttggtaccgcggggtctcagaatgacattaacgttttaaacaagtcaccactgttaattcaagcaataaaaggggaatctcctacggtacactatactgtaattggaaatcaatatgacatgggttactatcttgccgataaaatatatccagaatgggcagtattcgtgaagacagttaatgcccctcaatcagcggaagataaaacattttcgttgaggcaagaaggggtgaggaaagatgtcgagtgtgcatttggtgttctgcaatcacgctttgatattgttcgtcgaccagcacgcttatggaagcaaggagacgttatcaacattatgcaagcttgtgttatccttcacaatatgatagttgaagatgagaaggactcagttagggatgtcttggatttgaatgaaaatccaagtgcgacgatagtgatcccaccagaagtgcgtacaaatgatgaccctaatccaagctttgcagaggcacttcgtagaaattcggctatcaaagctcgaccaacacataggcaacttaagaaggatctaatcgagcacatatggcaacgctacggaaacaaagaaaattagacaaaaagcattgtaactatatataatataattattatatatatggtttctaaaaattattgtaatcgcgtttctattatttaatcttcatatttattctatcaattagccacacaatggtacatacaaatacatttatagttgatctaagctacatgcaaagcattaaacagcttacagatggcccctctgtttgtgggttgtatgagctgtctttatatctatctgtatgagaatttcgagtttctgcagacgacccaccgtctgtgggttgtacatgcccttatgagaaagtggccgcgcgaccagctagtttgcgtgccttatgagtgcacgaaccacggaaccagctgatttaagaatctttgatgcatgttttgttttcgtcaccactattacaatacggttttttttcgtgatagttaaaataggttttaacaggctgtcaatagggtcaccagagaccaaaggccaaaaaaagaaacataattttcactgatcgatcaagttttctcgaaataaattgccggttacgttcagcatctccaattaattaaggtgcacgtacagatatctataaacgcgaatattagagaatggcctaatattaaataattagaaaatatgagactttgaactcaggtcgtttagctcaccatcttgtagagctagctagaatatccctaggtatttctagtacatatctcttggcactactacaaaatagggattcggtgctggttgggaaacccccttcagtgccggttttcctaatcggcaccatgaaggcgacacaaatcacaggagattaaagatgccggcttcaaaaccagcacctttgagacgcacacgaaccaaaaaaagatcggccgatgcatcaagccgtcaagccgatcccaaataatacctaaatcccaaaattgcatcaaatccatgaacacatgaactaaaatgcatcaaatccatgaacacatctagatcatattcaacaaattacagaggaaataatacaaaacacaaaggaggagggacaagaaggggaggggaagagatcgattcgcggcctccaaccgccatcctcctgccgctcgccgccaccgcatcgcccttccgccggccgcggcctccgcctccccttccgtcggatctggcggaggggagggtgcggccgccgctgccacctccgccggctagccgccaaccgcgggagagaagggagggagagagaggaaagggatggagagagagagaggacgcgagtggatgcatggatgaggagggaccgagggagttgaaccttatcgatcgcctcatgctggaggggcccaccggctcggctcaattcataagtgtcggtttttaatttaccgacacctataatatattaaaggtatcggttttttaagaaaaccaacacctatagaataggtgtcggttcttatttagagccgttttttgcgatttcaacccatggaagtgggaaaaggcttataggtgctggttttagcacttccggcacctatagtgccgacacatatttgatgttttatagctgtgggaggacggttaagttttctaaaaaaaaatttgcaggttacattgagcatctccaaaatattaatctctctaaacgtcgtgggagtgctggaaaattgggcgccacgtcatt

SEQ ID NO: 40676 - DNA, 13203 bp, Oryza sativa
gttcttccaccaccatcagatcgatgagaggacaacagacggtcaagatcttcccaacatatccccacacagccaaaaccctagcagcgctcgcggcccgctcgcatatggcctcatccgccgccacgctgctgtagccctctcacgggcggacggcgacgcatcggcgcacgcagccgggcgccggttccccgcctcacgcaacggagtgagggcatggcgtgcgtgcccctctctttccctccccttctcttcttctcactcttcttgcgccctcgcaggttttttcctccatcgtcatcggcccatcaatggcagttcgtcccacatcgattgccatattggcagcatcaatacatagcatcatctcgatggtctgcgagctcgagctcgagatgtggtatttacccatatcatgcgaatcatttgagccttccggatcccaactcctgaagcgtccagggcgtatctgtctccatcgttaggcgctgctgttgttcagacaagctgatctaccgtctctcctttcaaggtgaacacctatgcccactcttcccttccaaccccgtttcttctacttcaccctcactccatcattccccatttgcatgaatagttgaataccattttgttcagttacatagttcaagtcgtcattcattacttcgacaaacagtctgccgagttcatcaactcagctgctggggccatcaccgtctcctacgtcatgcagctactgactggtaccatctttatccatcattaaataaaaatctggatcgatctatgaatatcccctgatcctaattttgcatcttaatattgaatcaacaatttattttctaaacttgctgcagggaggatatgcataatgtgctttttacagagggacaatgttctaggtgtttgcaaaaaagcacgtgtgagggcacaaatccatactaaggcagatcgccaacttatactgtcaggacatatgtgttttggtactgttgctgctttcaaatttattggttaactgaacttaaagctgttttgcattgataatacttcactactgtttgacatattatattttcctacatggaagcaattgtacgaactagccgactgatatgttctatttttcaaattcagcatcgaaataaaaatagcatatgcttatgttaccatttttctattatgtggacaagtcatagcaaaaaaatgtgttgcaattctacataaagtcatatcattcaaatgggacatttcaaattgcatgctatgtaacgtcagaggagctcttatagataatgtacagacaatatgtgttttgaagctctttgtatttcaagcattaggtaggcttttagtcacttactgattagcatttttctttgtgtgtttgctctcactgcccacttagttcttaatgtagtttctagatgacttagatttggcactaatagaactagattttaagttaaatggatgatttatatgcaggaagatccgatttgcttcgatactctactatctacatgccattttcagtatttttgttgtacgactgctatacttatcctagcattgctatatatcattggaccaaatggattagatccttctttacacttttaattctcttagctgatagatcattgaatggttaatatgctcaattttgggttgcatgctaatatggtgtatatttgtctgcaggatattttttcccttccttttccctatcatccttctctattgtgagttataacttattatcttaattttagtcatccaggccttctgcaatacctattttgatggaattattgaagttttcataattatattcagctatctgtcttttaaaactgaattactagctatgagctcagaatagtcgcaaagtatttgccgttgaaaatagagatgatttcctatagcccactaaggagtgatggtaggatagatgtggctcttatgtatcccggtgattcaccttgaactataaaaagaatctttgtccagacaattaatgccacctatttgcatcaatgaatagtcagtttaaatgcattaattgggtaaactagctctttctatatgctacttaattagttttctcaaatatgtagagtaaattaccccatagttaaagttttccaatccaactatatgcccatccattttcttctcttaaatgcggaaaacacttttactagcactagcaccttaaaatttgagcaagaaaagttattttagcatcacaactgcgtggttgttcctttcaccgctgttgataacttgatatgacagagagataacagagctccccaagaggtgttataattttgactgaatgcaggataactgtagtatactttcctatgggattgtaaaattcattgcttaatttgtcaaccttcaaaccattgtcatcggcaagcatagactaatcttctttcttttattgttgtaggcctacttgggagggagttttcagcagtaatatatgccacacaaaccatatccgatatactttccatcagtgggggagagtagtttagatgttgggtgagtgcatttcattgttggagtgtaccagtgtaaaatgttctgaaattatttcgtaactaataaagcaaatttacaaccttctgttttgtatacaggttaatggtaattagtaagcctctttgatgtgttgtggctgttatgcttaattcaatgtttagtttgtagttctcttggaccttagagcaattatatattaattacctgggatttatgggctccaacagctacccaaaccagtccctaattcttctgtgcctccgaaaccatagagaaatgaagccagaagaagggaaggcttaggcgagaccagggttaccggagggtcctgtaaaaagaaaaccacggcaatctccttaaattcaaataaattttaaaaataatttaaaattttgataaattttatacagttttcgtacggtttgccacggcgcggttaccatggtaactctggccctggtggtttgggaaaccctgggcgaggcgcctccaattccaatcttgtcttcgcacgtgggacgagacgctgctcccgtaggaaagggcttccgcgtcgctagccaacgccgcctccggtccgccgtcatacacctgttgcgtccgctctaacagccggcgcagcctccactcatctcaccgtccccgtccacttcggccgctagcacaatatattgctctgtccatcgactgtctccatacgctatctgtctttcactactggagaaaccatctttgtctggtcggccaaaattcacaatagttccggttcattaaaaaaaccgggactaaaaatcatatttagccccggttgaaaagcccatagcattttatgatctttagtcccggttggtatctttttactcccggtaaaaagatgaagtggaaggatgaaagcatttggataatacccaggaggaggaggaggtgctgagcttgagctagctccaggatgagaggagggcgccgccctaggagcacggggagctccaagctaaaggcggggcttgtactgcttgtgcttcttcaaattttgcccagcagccccaagcttgtcttgaatcaacctcatgatgtaaggggcataatagattccctaagtgaaggtccccttggagatggcaatctcttgcatcataagagacacaatgtcgaactgacggccctgaatgatggcatcgatgacgtgccaatccgcccccataatgtcatcattgttgccaaggcgagggaggatggtagctctcacaatcctgttaaccacactggggatggtcctcaagccggcaaccttcccatgtgtgtaccgcactccatcttcataaaactgagagaggtagtctatggagagcggattgtgagtgtgctcctcatgcaagtcatcttcaaagttcaagcgaatattgaggagccgccggaattgcctcctagagatagaacactggagggtgtcggacatccacttcatctcactattgtctccagccacccacactgtagcataaaactgccggatcaaatcttcattgtagtcttgcttgagagtaacaatccgatcaatgctaacagtcttgaagagatcctgcaacccctcaaactctggacattgatgtctctccaagaaatccccttatgctctgcaaaagctttccctgcataaacttgctcatacacactcttctggaaagcggtgtgaaaacggggatccggggtgtcccgaggcctcaaaaactgatcatggtgcctcaagatggtatattgtgatggattcctcatgttcacaacaaactggatggagggatcaatgtgcatatatcatcacttccttcatcctcatcctctccacttctactgacatcatctccactttcctcctcactatccccctcaacattggcctcaacctcttcatcactttgagcgtactcatctccgctcgattcctcaggctcactcacgggattcggagtgggtgcacgacgatcatggcgagtgcggggaggcatcactgtcaaagagcaaaggatgatagatattagcaataattctagaaacaatttggagaggtgaaaatttgcctatatcctgtggaggggtggtcagaccacagccagtagggcggtcagaccgacgatatcaggccggtcagaccgcctgccggtggccggtcagaccgacgactgacggccggtcaaaccgcgcgcacacgccggtcagaccggcggctgacccacagtcagaccgcctgtgtctccgggcagacctcctcccacaagttcaagcatccaaaaattttcacatctactcatttgagtctaaaaattgctagaacaatattgcacaagagtggaactagaacatcaaagggttggacctatttcatcaagattggaataactacccatagccctagggtgaaatagattgatttgagagaatgcacaagagggagagtgatttaccggttggaggagttgaatcaaaccaagaaactaccctctattggtgcaaatcgaagaacacctcgtgcttcacctagagttccatgccatggatcaaaaactcaacaaaaacacaaactaatccatggaatagagagaggaagcggaggagaatcacttacggtgtaaccggagagaaatccgcggtcaaaccgaatggatttgatggagggaggtggctagggtttgggagaggagagatgagtttttttcgagttggggaagaagatggttgaatgggaggagattaggtcgggtaggggaagaagggagaagaaaaaggacaaaagtcctgggcccacctgccggccggtcagaccggtgtcacgcccggaaattcactaataattttcgaactaatttgtgcataaaatcctcgtccaggaatcagccgaggtacataaactgacaatttaatatacaaatccatcataataataacgttacatacttaaaaaaaaagaaaaacagcagcggaattaacggtctagcgatggcttcagctccactcccacaggcagctcaactggggtataagccaaacgtcttctccttctggatcctttttcttcaactgaggttgattgattattgcaagaatgagcatatgatatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgttgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctagcttgtggttggcacggttaatgtttcacaacagtagctcgcgaaccggtccttaattgccatgagcacaactctcaaaaccatgtgctcacaacccaccattatcaagttttagttggcaagtaattaattaaccaatcacgattgaccatcgtgaactatcattaagccataattaaataatagtgagtcataagttatcccaatagtgtgttaatgtttctaagcatggctaagcaatcataactaatatctagctgaaccaatatataaagcccaactagtcaagttataataacccaaggtatcaaggaataaagtaatcaagaacaaaagggttataacaaacaataggttaattccacccaatgacattcgaaaataaatgcaatagttgaatagaaacaatagctttaaacgggatcaacatgctcaaagggttgtttgggatctgtgtgacttgccttgcaataatcagtcttcaattaatcttctgaacactcccgacgcactcacgaaccttcgcaacgacggaaacgacaagctaacacgcaaaacgaagagaaagactaataaaaactaaataaacagtacaaaaacaagcataaacagtacatgtggatatttttaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggatatgaacacgtagaggacgacgagacgaacccaacggtactcaccctcgaaccaaacgacgaacgacgacggccggcgacgggtctagcggcggcttcggtcggcggtggcaccggagctgcggtggtcggcggcttcgggggtcaggcggccgggcttctccaccctcccgcgcacctaacggtggtgacggcgaccggcggcgacgacggaggcggcggcgcgacgcggatggagctcggccggcgacgatggcggggtggagcacgtggcggcggtgctacgaggcacgggagatcacgggagagggggcaaacgaaagaggaggacaagggggtcctatatatagccatggaaggccaggatcgagcccacaacgacgggaaaaactcgggaaagtttagatcttcgccggaaaaaggaaaggttgaaccgcgaaattggaaaggatttccatataaacttttggggatttcttggggacaaggaagaggagattgagaggattccattcccgcaaccaattcgaaaataagagcaacggagaggttggattttggaaggggatcggcggcaacagccaacaggcacggcacggctcggctctggctcagtccagagctggaagatgaacagtagcgcggggaaggaaagtagacttcttgccgggcttttcttttctcagcctgatttgaagagggagcaaaaccggactttggctgagagaagaagagaggatgcaggctcgggttgggccggcgtgggatgcacaacacgcgcgcgaggagggagagaagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtacttaaaaattataattagaccatttaatgattaatttaatatgtgggtaattactgaaatgctctttgtatgattaaaattaggaattgagctccgaaaaatccgagaatattgcagagagtataattaatcatggagaatttaatacaaattaaatccatccatgctttaaattaaggaaattttatttcccatatttaagttcacttgtaaattaatgaacgtttaatataaattctaataataatttattaaataatttataaatcccgaaacaaaaatcaggatgtgacaaccggccctatgtggccggtcagaccgctgcacctggatagtcaaaccacgcatatagcgtcggtcagactgccaggccccctggcggctgtgcacagcccttgcacaagccgacaacccccacacaataaaattcaataaaaaaattgatttttggagcaatttttgaaatgtgtgagtttaaatattgctaaccacccataatatttgaagattatgatgatttgcaacaaaactcacttaagtgctaggaggtgaccttttatggtctatacgggtttttgggcgaatttgattttcaaataacttttaaatgatttggtttttgaaataggtttgaataccaaaaacatttcaaaacttcttatctaccaactttgttttgaaacttttctcaaattccttctcaatctcattttggggataattctcattttggccaaaactaagaatctagtttcttcaaaagagggccaaaatgacattttcattcagaaatcatttttcttgcaatgtgaggcttagaaaacatataggaaaccttttgaaacattttccaagagatagttttcaaattacattgattttgcaaaagttttgacttatgttgacttaggcattttgaaaatactactagcaccactagttgatttgctcacatataaagggaagtagagcacatgcaagagtgcaaaactcccccttaatgtgacatgctccattttcgcaatgaagaaccaaatggcaacaaatccaaagcataagagcaaatgagagcaaatatacataaagcaaatgagagcaaatatacataatgcaaaaagaagcaaccatggtgcaccatctcaagccacattagagaaatatatgacatttaactcattcctcaacttgcaaaagcgggttttatcaagagacttagtaaatacgtcggctagttgatcctcggttcttatgtggctaatgactatgtcacacttggcaacatggtctcttaggaagtgatggcgtatgtcagtatgcttggttctagaatgttggaccgggttattggctatttttatggcactatcattgtcacataggagtggggttttggtgaaggatatgctatagtccacaatgtttgtttcatccaaagcaattgggcacaacaactacccgccgaaacatattccgccttggcggtagagagggctacagagttttgtttcttggatgaccatgacacaagggatctaccaagcatttggcaactaccggatgtgctctttctatccactttgcaaccggcataatccgaatcggaatagccaacaaggttaaacttagtaccttttgggtaccacaagccaatagtagaggaatgctttaaatatcttagaatccttttcacggccactaagtgacactccttaggagcggcttgaaaccatgcacacatgcaaacactaaacatgatatccggcctagatgcggtaaggtaaagcaagctaccaatcatggaacgataaagctttaaatctaccggtttacctccctcatcaaggtcaagatgcccgttggttgccataggtgtcttgatgggcttcgcatcctccaagccaaacctcttgagtagatccttgatgtacttggtttggctcacgaacgtcccattcttgagttgcttgatttgaagtccaaggaagaagctcaactctccaatcatggacatctcaaattccctaaacatcatatcaccaaattccttgcaaaatacctcattagtagaaccgaatatgatgtcatcaacataaatttgacacaaaaagaaatcatcaccaatgatttttgtgaaaagggtggtgtcaacttttccaattttgaaatcctttgacaaaagaaaatctctcaatctttcataccaagccctaggagcttgttttaaaccataaagaacttttgagagtttataaacatggttaggatttttaggatcttcaaaaccgggaggttgttaaacaaagacaagttcggcaatttcaccatttagaaaagcacttttcacatccatttgaaatagttttatatcaaagcatgatgcaaatgtaagaaggatgcgaatagcctcaagtcttgccacaggggcaaaagtttcaccaaagtccaaaccttcaattgtgtgaaaccttgtgccaccaaccttgctttgtttctcaccaccaacccgttctcatcttgtttgatcctaaagacccactttgtcccaatgacattgtggtctctaggtctatcaaccaaagtccacaccttgtttcttgcaaagttgttgagctcttcatgcatggcattcatccaatccggatcacaaagagcttcatctacatgttttggctcaagacaagaaacaaacaagtaatgttcacaaatcgaagcgacacgagatcgagtttgaacacccttactaatgtcacccaacacttggtcaattgggtgatccttggaaagagcggtgtgtatccttggtggcataggtggatcttgtgccttctcctcctccacttcaacttgagcttgacttggcgtagcggaagtagatggctcatcttgagtggaggtggatggtttgtcttccacttcaataggcttgacatctcctattgacatgttcttcatagctctcatcaagccttcatcacctacatcatccaaattctcgtgcccttcttaggagccattagtctcatcaaattgaacatcggcggtttcttacacaatacctttgttcttgttgtagacccggtatgccttgctatttgaggcataacctagaagaaaccctttatcacaccgactttcaaatttggttagtctaacactctttcgataaatataacacttgcaaccaaaaactcgaaaataggcaacattaggcttcctcccaacaattagctcacaggaagtctttttcaagagacgatgcaaataaagcctattggttgcatggcaagcgatgtttatggcttccgcccaaaaggaatcggaaacaccatattcattaagcatagtccttgccatctcaatcaatgtacgattttttctctccactacaccattttgttgaggtgagtaggtagcggaaagttcgtgtttaataccaagatcatcacaatagtcctcgatattggtattcttaaactcggaaccattgtcacttctaattttcacaagagtgcaactaaattcattttgggccctttttgcaaactttttgaaaagctcggcaacaatagacttatcatgcaaaaagaactcccaagtatagcgagaataatcatcaacaatcacaagccaatgactattaccaccaatgctcttataggttggtgggccaaacaaaatcatatgcaagagctccaatggtctagatgtagatatgatacttttagtaggatgagaacatgcaacttgcttgccggcttgacaagcactacaaagcttatctttctcaaacttcacatctttcaagaccacaactagatcacgttttgaaagtttgctcaattgattcatgccaacatgggctagcctcctatgccaaagccaacccaatgaagtttttgcaactaaacaagttttcaaatttgcttcactgaattgacatcaaccaaataaagatttccatatctaaaacctttgaacacacaagacttgtcaagaaggctagaaacaataacctcttgcgggaagaaagcacatgacaagccaagatcacaaatttgagcaaccgaaagcaaattgaaatttagagatttaacaagagagacattatcaattgacaaatcattggagatagcaattttacctaacccaattacctttcctttgctattgtctccaaaagtcactttctcttgttctttccctcctacttcaaatgtggtgaacatagccctatcaccagtcatatgttgagtgcatccactatcaagcacccaatggcttccatcggtgcggtagttcacctacaagagaagatcaagctcttttaggtacccaaacttgtttgggtccttggaggttagagaccaaaactttgggcacccaaatggcattctttttaccaccgagtataggagaacccacatatctagcaacaatgctaccatcatgagccttcctaagcatataatgagaatcaaacatgcatgtcttagaaggcttaccaccggggcaaccattcaccaaatgcccaacctcacggcacttggagcaatacttaccattgctcttgacaaaacgagtggcacggtgagaaggtttcttacccttatttggaatgaatccaagtccctccttgttaaggatgcaccgttgctcactcaaaattttgtcaagagtgttcttacccttgaagcacctctccaaactcttgttgagcttggccacttgctccttaagctcattgttctcaacaacaagtgaggcatcacaaatagaaatacaagagctagagctagagttaggcatatccacaagatcatcacaaaaggtagaaatgctagatgatgcaacataagcaatatggcaagtagcactatcatcaagcaaatcacaagatatgctaacatcaatgagagctccatgttgagtagtggaaaggaggttgtcatgagcttccttaagcttctcatgagaaatggtgagtctctcatgagaggtctttagctcctcatacaagacctctaaagaagcatgatccttctttagggccttgaacttgacaatctccttttcactataagcatgaagctcctcaaatatactcacaagtt

SEQ ID NO: 40677 - DNA, 4492 bp, Oryza sativa
gtggatcccccttatcacaatcatcatcactctcactatcactaagagatgttaccttagaggagctctttgccatgagacaaagtggagcgaagagtgatggagcctccttgatggcaacaacggccatcttcttcttcttggagcttgcatcatcaccaccttcttcctcggacccggatgaggtggagctctcctcatttgagtcccattccccgatgaaagcctcgatcttcttcccttccttcttaagcttcttcatgagcttgtagcctccactcttcttcttggatgacttgtctccatcatcatccttggaagggcacttggaagcaaagtgtcccttctcaccacactcaaaacacctcaagttggagagagtcttgttgggtcttctatttcttctcctatttgagttggagtcccttcctctctccattctccttcccaagagatcattgaactttctagcaagaaggaccatctcttcctccaagtcctcattgacttcattcaccttgctcttgctcttgtcttcaacttcggcttggagagcaatgcacttcttggagggtgaggcttcctccatctccttcttcttcaacttgtacatgtcattggtgttgatcttccccaagaggcttgcgggtgtcattcttgacatgtcgcagttgatgagcatggtgacaagggtctcatacttctccggtagggctctaagcatcttttgggcaacctcaagatcggtgtagtttgccccaagccccttgagatcattcacaatgacattaagcctcccatacatgtcattcacactctcatgaggcaacatggagaatgtctcatattggatcttgaggaaatgaagcttggtatccttgtactcacttgtaccctcatggatctccgccaacttgttccaaatctcatatgcggtctcaaggttgctcactctattgaactcctcttggctcaaagagttgaacaaggcattcatggcttgggcattgagttgaaggttgcggtgatcaatctccgtcaagggtgtgtcggtgatagcaaagcctacatccacaatactccaaatatggaagctcatagcttttaggtgagtagacattttaattttccaagtggagtagtttgtgccattaaacatgggagccttccctacatggttcacctcgttcgacatcttctctctaggtggtgaagcccaatcaagagagaccaagctctgataccacttgtaagatcgagatgtcgactagagggggggtgaataggcgatttaaaaattaaataacacctaatcaaatctaacctaagttgctaggcttggtgagggtgaactctaactaagcaactaagttatgttttgcaaacctagggtgatagtggctcaactatatctctaggaaagtaaatttgcacaaatgtaaatgcgacaatcaaatgagacaatgagacaagagacttttcaccgaggttcggaaactcgccggtttcttactccccgttgaggcgagcccaactccaccactcaaccacgaagccaccgcacgcccccttcgtcaaggggtgggcaaggcgggagccggcccacggagaggactacccaagcctcgatcactcggggtagttctttcttcacttcgaaggtggtgaactccaaaccactcacaaaccggcgccgggcctcctccacaatcttctcggagaggtcactgggcaactcctccacaagccgtctaggaggcggcaacctccaagagtaacaagcaatgacccggtgtggagatgatcaagtgccatactagctctacaatggaagcaaatgcacttgactcttggctaaacaaccctctaacacactagatggatgaacacaaagctcaagtgagtgtgagagaggtgcaaggggtgtatgcaattgaattgggtgccaagagagccccctggctgctggtgggggagtatttatactcccacccaccaaaactagccgttggtggcgaaatcccccaactttgtgctctgccggtctgaccgaaggtatgtggccggtcagaccgtgctactctgcaacggctagaaaactagccattgaagtgctgtcagagggccccatcggcctaaccggttagaccgacatggggtggccggtcagaccggcctcagctcggtcagaccgccatcagctcggtctgaccgactacggctctgtcggctctgtatcggccatcccgagcagcatcatctcagcctctagggggccagtctgaccgggaaagtgccgctggtcagaccgctcgcggggccggtcagaccggccagggcaagccggtcagaccgccactatgtggccggtctgaccgcccctggtcaggccgaacccagtgaatttgcaagtgaatgtgtgtgtaatgaaaaagagagcacaaatgaaaatgcaatgacctaatgtggcaattaaaatcatctctttgctaggtcattacccctcttaatagtacggcgaaactaaaattaaactagcaaatttgatcaccctacacctcgatcaattctaaattaaagcgctagttttaccgtcttctttccctttgctttgcaccgtcaattttaatccatcgataatcatccatgcgcacatatctcttaatagtacggcgaaactaaaattaaactagcaaatttgatcgccctacacctcgatcaattctaaattaaagtgctagttttaccgtcttctttccctttgctttgcgccgtcaattttaatccatcgataatcatccatgcgcacatatgacgtggacctaacttaaaatgtatagctcaaagacaacggttagtccataattagtgcttgtcattaattaccaaaattaacaccgggggcctagatgcttcaccagcgttttgtcaaggttgctgcagccccgtcgtcatcttcgtcctcggctccgcgtcgtcaagtgttgcgccggccgtgtctcgccttcgtccaaggatcaccgccgacgtcgttccctcgccggtcgcctccatcgtccccgagccgtctccgccgcgcccgttcgtcgttgtcgttcccacgcctcgtcgcgtggtggtaaggatccgtcctctcgctgccccgtcctcgtcctttcggtgtcgccccatgcccgtcgtgtggttgtcgaccccggtacccatgtaccagtgtcggtagtcgttcatgtgtgcgtgtggtgaccgtgttagtgtgcccgctcgatagccacgtggtttttacatgtgcagcccgcgtggtgtctagtggagtccgtttgttggccactcgcctcggttgacacacggggtccgcttccgtcgacccgtagactgtctctgtgtactcggtctaccgtggtcccttaggttgacatgtggggtccgcatgtcaacagcgcagccttcctgtcttttccaggctagcgcttgcacatgttttatagttgcaaaacctaatcataataatccgtaaatcttcatataacaacattaaacttcggatgatcatatcttgatcatacgaaccccgaatcgacccgttcaagtctcttaatgtttgttataacctaaagaatcatgtgctttctttttatgtattgttattgcttctttttaggcttgtagctttgcttatgtgcttcgcgtagcttctgtcgttccggaggtttccaaagcgtactttgtggtcgtcgccgaaggttcggaaggccgttctctctgagcaaggcaagtcgcatcacccttgagcatattgaatctcagtttataaaattattttgatttaaattattgcattactgctttacttaaattcccgcgttatcactgttttatttagccacgcctatttacctttgttatgaccttattattattgctattgttattcttaccttgttcaccttaggataaacaaaaccccaactagtgggtactctattaacggttccactagtatgaatttaggtagatgcttcgctgattaattaggcaacactaggtggttttataactttagactttgggagttctcatatcatttggacactgtggaatggttggcttgtgatggaattgaacacacacctccccccccctctattcaaaactcccaaaatggttttaggctgggcacgaggtgcatggttctgctagtagcacctcggccactataaggaccagtcttcgagcctctgttgcaaagcactaccgtactaaccacatgtctaatgggtaaggcttaactcggtgctcagtctagtcctagcaagagtacacggatggagatggatgaagtcggggctcgatggacatctcgaggccaaatgaaggctacacgggctgcggctcggtagtcgagatgtcatggcacagggccggtgtcctgctgctaggggctcaatcttacctacctgtctcgggattccggccataggggaggttgggtaaa

SEQ ID NO: 40678 - DNA, 5757 bp, Oryza sativa
atgtcacatcctttacgacgggttccacggccgtggaatgctgagtaaagatgtgtcttgtgggtaaagatgtacacctcttatcagagtataatctattcgaatagccgcgccctcggttatgggcaagcctagcaatgtacccaagttagtggtttaattcctaaaacttgcttaacaactaaaatgtggaatggttggcctgtgttggcttgggacgagctgggacccaggttgggttgccagttcggtctgaatcatcgtaggccttgggttaaggcaggttcgtgcgggttcacggccttgattaataatactatatagctctaggatcgtctttataaaatagctttgggcaactaagtgacttttaaatgctgtttactgcaaaacttaacccctatattattaccccttgtactcccttgcattaatcatgcatctcccggtgtggcttgctgagtactgtggttgtattcattcttgctctatctttcccctcttcagtaagagaagctttggaggagatgtcttaggtagagtcctggcttataccctagttgagcgcctgtgaagatggagccataggcccgctagtccgctgctgtttatttgttattgtcaggcctgaagtgcatttgtaataaggtaaatattatcgatataataaagatgtgtcttttatatcatgtttgtgtggtgtaccccggcttttcctgggacggggattaatacactagcgttcgggaaaatgcaaattttctcggttgcgacaaacggctagaaaactagccgttgtagcgctgtcagagggccccatcggcctggccggtcagaccgagccgaccggcctcggctcgatctgaccgaatacggctccgtcggctctgtatcagccacctcgagcaacaccatcccggcctccagggggccggtttgaccgtgcatgtgccgtcggtcagactggccttatgctccggtcagaccgccgttgtggcgccggtcagaccggccaaggcacgccggtcagaccgccacaatgtggccggtctgactgcccctggtcatgccgagcccagtgaaaggtaaagtgtttgtgtgtgtgtgtgtgatgaaaatgtgagcacaagtgaaaatgcaatgacctaatgtggcaatttaatcatctctttgctagatcattacccccttgatagtacggcgaaactaacaaataaactagcaaatttgatcgcccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaacggttagtccacaattagtgcttgtcattaattaccaaaattaacaacgggggcctagatgcttcaccatggagatcatattgaaacttgttcaaaaatatcaataatgttttaggtgtcccattagaaatgattatctaaaagtgggccataaaacctcggtctcatgctgggccactatagatctcaaattaattaatcatgttaagtcttaagtgttcatgataaattattctagtatttgataaagttgttggacatattattttgttcacagcataggtgcagcgcctttgtgcatattgttgtttaaatttcaactttcttttatgtgctaatttttttttcacttcacggaaattcgcaaagggaaaaactctcaatatgaattatttattattattattattatgtcgaatttacccaaactatcaccaaagtgtgatttgcctcgctaaactacgaaaccagataaaatacatccctcaactattcaaaccagacaaaaatatccacctcaacgtaccggcccaatgtgacaaattttgttgtaggacaccgtgacttcgtggttttagctcccggacacggcaaaagttgatattttgggaagacactctcaaaatatgtttaattgctgctggacaccgcatgtattaaaatattaaattccgattgaataggagagaaaaacaacatgaaaatataaaaatgtctgaaagggtcaattaggcctagagggggagtgaataggctaatttaaaactttatgcggaagctaaaactgaaataagattggaaagtctgatccacagtcagactatccgaaaatatcagatagtctgatgttggatcagactgtctgatccaccaatgaagcacaacaagtagatctatcatacaaacaagagtaaagcacaaacagtgactagatctatagcggcacaattaagcaaagctaaaaggaggatgaagggagatcaccaatgatgaagttcacgaagttgttcctggagttcaaattcttgaggggattctactctccgttgagacgctcactaagagccgggtctttgctaaccctttcctcaagaggttacactaagcactcctccttccactaaggggtatctctttccttgcggaggcgagatccggccttcacaaacttctcccggccaaccacacgtagatcggtggctcgggagtgacacctagccgtttaggagtcctcaacctccaagagtaaaagacaccacacaactcttggtcaaaccctagtgctcaagatcgagtgaaacacacactaggccctcaaacaccaaatctacaaccaccaagatccaccacacaaagaacgaggagggatttgagagagggagaaagagctcaaagatccaaagcaccttagcaccaagctcaacccaaaatgaatgagaatgaaatgagttgggtaaccctagaaaaagggttaggtggggggtatttatggatcccccaaaaagtgaccgttggaggggaatctttcagcccatgtcggatagtccgatacaagattggatagtccgatattttaaacctccaacgcaacgagaaacagacaacgaagttccatgaaatttcggactttccgagacatcggactatctgatgttaaatcggagtatctgatatttttgaagcaaaaacttcgtcctcaaacagagactcaagttccatgaaatttcggagtctctgtatcatcggacatctgatccaacatcggatacaccgacacatagaaaaactcactcgaaaggattttccaaacaaagacagagagtgaagttatgtgaaaaatcggatagtctgatttcaaatcagatagtctgatgttgctcaagtaaaactgcaataactttttactccgaactccgatttcgaagatcttggactttatggaaagctagtttcgtgggctatcaaacccaacataaaacatggtccaaaaccttcaagagatgttgaaaaacttgcaaagaaacccggtgtaagtgttgtgacaagtgaaacaactcgggattgaaattttggcttaggtttttcaactcacacaaagatgaagcattttgagcactagtgttctaccaattatatgcatgtggtatccctcttaatagtacggcattcctatgacacaatgcaaggtaaaagatataatatgccatttgatcactgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaatatccctaggcccacttgtcatattctttcctcttgctccttatttcccctttctgcaaacaccccacttcaaacgaagcctcccaatggccttggtggagacgaaggctcccgatggtgtagacgctcgagggaacaagtgctaggcgtcgggcgctcgatgacctccatcctagagaagaaggtagagtgaacaacggacggagcttggcaagatatggccggtcgtctacatgaaggtggttgacacggagtcattgggggtggacgaggggacctagtagccggcggtgaggtggaccacccttgggtggagcagagcagggggcaaagctatggctctccctccaaatccatgggaggaacaacggcgacggttgtgcaagaagtgaagggccgcgtgcgacgacaggaaaatagcctatggagatggttccctagcggcaactcgagatctacatgggtgaggaggtttcagaggagtttgccggtgtggagcgcctggcgcggggaggaagctagtgacatcaacgagatggcacaccagaggcggtgcaaggagggggctgccggtagaaggggaaataaggaggaagagaaagaatatgataagtgtgcccagggggcatttttgaccttttcacgctatttatctctcatattcaaccggaaattaatattttaattaatgtgtatggtgtccagcggcaaaataaccatattttgatatcggaatcgctagtgctctgttgacagaaaatagggtgctaaatctttcacttttttggccattcatctctgtttacaattcgtgctgcatttggattgagcaaagtcatgcacggctgtggactttgagatggaccgagcttttgttgttgcgttctgtggactttgttgttgcgtttttttggtctcacatatttaccgttcaatttcgaaacacacgcctgtttttcttccttgcatttgagcagtgttttctactgctactttgcttatgatccacgcttactaattacatcgtgcttacattataattacatatgtaattttgtgacttacatcataaatatactaaaattacatatgtaattttatgacttacatcataaatacactaaaattacatatgtaatttggaacttacaatgtaaatacatgcaaactttttttttaatagttactccctaaatttaaatagatgagattaaatttatcctatggcttgaaaaatttgcatgataggaggctagaaaatctatcgcataatgtataggcagtccctaaaagaattgcttctctaatcttacattcttctgtttcccgtaatttagtggccgcgccacatagcgcgcgaagcctttctagtaataggtaatttttgctggctatactgagtccaaactgaataaagtacagagttagggaagaaatgagtagaaagagagtgtgagcggtcgactaattagtcgccggctccacacaagctccaatgcaacactagcggcgcatgactagtttctgttaaactcacaatggctgctcacttctcaagataaatgagtggacgggaaagcttcaaaagaagaaaaattagaataaaaacattaagaagggacacacaaatagctctcttattatatacataccacagttattagttaattaaatgctaatatgaatatttttagacccatcagtcggctatattattagttttacactgaaggtccctcaacttgtcatcaagttacaaaatcatccctaaacagcaaaaccagatatccggtgtctctcaacttacaataccagtgtaaactaggtccctcagcggtttcgactccggttttatctaatgtggcagctgactcagcgtgggacccacgtgggccccacacgtcagggtgaccacgtcatcatctcttcctcttttctctcccttcctgtctctctctttctcagttttctcatgcgggccggccggtgcggtggcggaaga

SEQ ID NO: 40679 - DNA, 7607 bp, Oryza sativa
ggcgtcgctgctgaggccttagctgtacttgtagtttgatgaaattgcgaggagattggaaggaagcagccgtcaagacagaactcatcatcatcgtgttgtttgtttgtctgtctgtttgatgacggcaaggaattgacataggcccctgttaaagactaatcttcagtaaacataggcccgcttggtttggtttttaaggagaggaaccaggaatggattgtaatttgcttgcttgcctaccaaacaaaacagtggaagaggatgccaatctgcgcatggattttgtctctgccgtgctctccaaaaccaaaaccaagagcaggagcaatgccaagcctgagacaagcagcagcaatcccggcgcggcgatggagatcgagaagcctgaagaggcggcgcggcccgtcaccatggaggtggacgggaagcccgagaagaatgaggtctcgaagaaggccagatggcggggaaggtcgccgtgcagtccctggagaagtactacggcgaccgcgcctaccaattcctgttctactctgagccaaccgccgcagcgcatgcgtccaccccgcggcccgtcgccggcctccaagctgctcccccgccgctcctcctccgtcgctcgccgcccgcgcgcagctcttcccccgccgcaccagccagcccgcatgagaaaattgggagagagagaggaggaagggaaagaagaggggaaagagatggtgacgtggtcaccctgatgtatggggcccacgtgggtcccacattgagtcagctgccacgtcggataaaaccggagtcaaaactattaatggaacttagtttgcactttttataagttggagtatgtgttgtatccggttttgctgtttaaggacgattttgtaacttgatgacaagttgagggaccttcgatgtactttttccttttcttcattgctggttttttctccctccaacctcaaatggggcggtgtggcccgattccagatgccttctcgtacaccgattccagatgaaacgaatcaatgggccggccggcgggcccgctatagctacaccaccccccagtccaccacacgacgcgcgctacattctccacctctccaccattccaaactgccaagtggcaacaaacctactactaaaccctaaaaatcccaattcccacccgacccgacaccactcctctcctcctccgccgccgccgccgcctcctcccaaaccctcccctcccccatggccgaagacgccgcggcggccgccatggccgcggcctccctctccgacgacctggagcccgccaccgaccgcacccgcatccgatccatcctggccgacggcgccgcgcgcgccggcgagcgcgtcgtcgtgggcgggtgggtcaagaccgggcgggagcaggggaaaggcaccttcgccttcctcgagctcaacgatggctcctgcgcctccaacctgcaggtcctcgtcgacgccgccgtccacccgctcgcgccgctcaccgccacgggcacgtccgtgctcgtcgagggcgagctcaagaagccgccggagggcgccaagcagcgcgtcgagctccgcgtcgaccgcgtcatcgaggtcggcgaggtcgaccccgccgcctacccgctgcccaagaccaagctcacgctcgagaatctcagggacgtcgtccatctccgctcccgcaccaacacggtccgtctgtttcgcctcacaccacgaaaactgaagccctttctgaagtagactacagaaatttctagattttgcaacttccgcactagttttgataaatcctgccgtgatgatttaggatgtctagttccctggtgtgaaaattttggttttctagtctatttcctggtgtgaaaatttaggttgtctagtggattggttaacaatcccacacagttttatctacttttattgcgattttacctattgcattagatcaaattgatgtggatacattttgaaggatgggtttattttgaactggattatgagttgtgtggactgcgaattttacacaaatcaaacacttggttaatttaaagttttatggatctggcagtttccggtgtttagtgcctagtcccctcttctgctaactttgctattcttgaaagtacacatgctgagagggtcatgtaaggctatggatgattaactcccaattgagttcaggcatccacaattagaatatggcatgttaagtctaaacctttatatgtgctatttgattcccataatattttatcttaagctgagcttgattacaatgcaatcatttctgatttgttttttttaaattttgatttccttaaaaggtttggttgatgaatttggtatctttgccatttggattgccgcaactctgtattgaactgcaattctaggttttgcaatatatagaaattaatggaatatgtactttgtttcagttttttctctgttcataactcatgagatggaatattttacataacaaactctgcaatcccttattttattttgcagattggtgctgttgcgcgtattagacaccagctagcctgtgcaacacacaggttttttgatgagaatggttttctttatgtgcacacaccaataataactacaagtgattgtgagggtgctggtgagatgtttcaagtgacgactttgttcagccatgctgaaaaggtggagaaggaattgaaagagaaccctgcaccatcagagtctgatattgaggcagctagagttgttgtcaaggaaaaaggtgatgcggttgcacagcttaaagctgcaaaagctagcaaacaagaaatcacagctgctgttgctgagcttaacaaggcaaaagaaaatgtctcaaggctggaggaaagatctaagttgaagcccggaattccgtacagagatgatgggacagtagcttatgagaatgacttcttcaaacgccaggcttttctgactgtgtctggacagcttcaagttgagacctatgcatgtgctcttagcagtgtttatacctttggaccaacattccgtgcagaaaactcccatacatcacgacatttggcagagttttggatggttgaaccagaaatcgcatttgctaacttgcaggtaaataatccagatcatattttcctttgcagcatttgaaatatttcatcttagcttattaatctatctactattggttctaagattctgtatgaattgttatttcatgatattttggcgaactgtgttccaggatgatatgaactgtgcagaaagatatgtacagtacctttgcaagtggcttcttgagcattgccgggaagacatggaattcatggtgaaaaattacgataagactgcaattgagcgtctggagcttgtttcctcgacaccttttcagcgcatttcatatacaaaagctgttgagctattgaaaaatgtcactgataagaaattcgaaaacaaggttgaatggggaattgatttagcttcagagcatgaaaggtatctatattggaatttaatattttatcttccgatgacttactgtgctttgtttacatttttatctctcttcttacattgtttaaggtatttaaccgaggtgatatttaagaagccggtgattgtttataactatcccaaagaaataaaggcattttatatgagactcaatgatgatcagaagactgtagctgctatggatgttcttgtgcccaaggtaaatataaatatttcagacttctagttagttccaatataggttaggtgtaagcatgtaaatgtgttgcatgaacataaattttgaggttaggtgtaatcatgtaaatatgttgcatgaacagaaaatttgaggttaggtgtaaccgtgtaagcatgtaaatatgttgcatgaacataaattttgagttaggtgtaagcatgtgaatgtgttacatgaacagaaattttgtcattatcgacctgtcatagtatgatccctaacttatttgctggaatatcttccaaaggttggtgagttggttggtggaagccaaagggaggaacgtctggaccttctcaaaacaaggtatgcgatgctcaacttcaagcagaagatattttggaatctttagtacgatagctattgttccatgcttttggtattctctctgcttaatcaaatagtaaaatgggtagatattgcacatggtaacagtcttaaccattattacatatgtatcatcccatcattattccctattatatcatccttcctggcttgttgctgatgtacctagtcaaggctgatgttgagcatgcaaaaaatcttgcactgattgttcctcatatattctattcaatatgtcatcatttctttggaagctatgcatccagtggatgatgctgaacatgctaaaaatctaaaaatcttacaatattacgtgtttatgttcctcccctgattctgttaaacttatcagtcatgttttccgtaaaatgtatatactcagtcaatgacatggcaattttgcttcacaggatacaagacgccgggttgcctttggagccatatgaatggtacttggacctccgccgctttggatctgtcaagcacagtggttttggtttgggttttgaaagaatgattctttttgccactggtttggagaacatcagagatgtcatccccttccctagatacccagggagggctgatctctaaaataaccagagaaagctggattctaaagttcttctcgctgtcctgttagctcctcaatttcaggtctacaaatgtgcactgatatatttcgtgtcagcttggttgtaatagatgctcaccatgtatttagttatttgccactacagcatatgaacgaccaatttactcatttttgcgatagttgaacattttagaagttttgttcaaagcaagatctatttgtactcgttaattgttacaaaacgtggttttgcaggtttgaagtcataaccgctacattttctacgaatgtgcaagctacttgatagatactccctcctaaatatagctactttaagtgttaattatgtttcaaaatattgctactactataatagtataagggttgtttagccaatctagtctttcgtactttttcccttgaactctacaagagaaactccagattgggacaattaacggccgacgatttaaagcaagttatttgctccgggatcgattggccgagccgactttaatactggtatggattctagcatgtcaattcagaaaaagatcggccggtggtaattcagttttgacaaaatcaatcaaacgctgtcggagcatagtgtacgaaccgcggcttgctggctcgctgcaaaatcagcatggcagctttcggctttgacctgcttctttgaatcttggacaaacaattacagtttccgtccaaaattagatgtcattttgacttttttctttttacatttgaccatttatcttatttaaaaaaaagtatgaattacctccccgaactatcgtggtcgaccaaattgccccctgaaccacaaaatcggacattcttcacctccaactatataaatcggacaactaactcctcgactcaaaatcagacaactaactctctgactcaatccatggtggtttggttccacatggcagtgcactcaacaattcttttaataaaaaattggtgggacccacctttcagttccccacccctctctatctctctctattccccatctctctctctcttctccctcccctcaccagcacggtggcactgaggatggccacggacggcgtcgatggaggttgctcgggcggctggcggcggaggtggaggtcgctggttgttgacggtcgttatagatcaatttcgaccgtcaatataactaaaataaaggagaactagctatgcttgcaatgcatatttattttagaataatctatttccacttgtacttggattttatttgattgcagcgattgagcaaataaaatggagaagaaatgaagaaaactcacccttaagcaagcttaaggataagatgggctcacatgtcaggtgtaaccgtctcggaaactgtcataactgtcgcaaccgtcatagggacccacctgtcagtgacctaggaagtgtggaggcctactgagcctacctaggtgccgaaccctggcagcgccggatcagcctgggcctccacgtgtacgcttgtgatgacttctcaatggtggttgcagggtaaatccaacaattccaaccgttttaaccgtcattccaaggctatatgaaggggtcacttcattcgttcttccacacactcgagcaagctcaagatatctcttctacactttagtttagtattctagtgctaagtggagtagaatagaattgctctcggagtcctcggactcttcggaggaatttcggtatggctttagtagttttccttctttcttttgtaagacttttggaattaatgaaatattattctttatatactttcgatattttaatacatccaagtgttgtctttactttatatctgtatcggtacagtcgtataattagcctaccagagaggtgtagtggtgtgtgtttaatgcccgtttactcggttactatatgtcatctcgggggatgtagagtagtatttaataatgtagacgtggtgtctagattatgaagtaggcacatatgctacgggtcagttgaggtgggtcgctgatggtgacagctcagtacaggtattcctccaagatagtatatattcctaagaaactttcctaggagggtactccttcgtatttagccccgattgaacggccatgacaggttatcgtaagaaactcggcaacctggagtggtctctcgaagcactaggaggtcactgttagagggtactggctatatggttgtatactagcaggtgtaaactaaagttgagtgtatattagaattataggaattgatcgttcttctatttcttcttccacttagtttaggaatgattaaatgagatatatgagtgctttgcttcgtgtcactctacccgtttgccatatcttaacccctgcctagactttgattatacaagtggcatgtatacattattagcatagttctctattacaatcttcccttaggattaaataaattaatacgataccttggaatacttcgggtgaaatgctacaatagtatatccgtgcgtttgcggattctttctttaaaccaggatcatttctagcgtcattgctgggaatttatatttctagtaatgtcgttaagaaataccaacactggtggcgctggcaacgaaggcgaaggcgggcaacgttgcacgggggcgggctggcggtcggcgcatacggcctgtgaggaggaacgcggccgcgatggtgagcagtgcgaggaccacggcggcggcggcagcggaggtgaccacgatgacggccttgggcgtgtcaccgcctcccctacgcgcctacgggtctggcttgctgggtgacgacaacacgttggcggcggcggcgcggggagcagccgggctgctgttgtccacgtgggtgggaggggagggagatcgaaagggagacgaggtggccactg

SEQ ID NO: 40680 - DNA, 6659 bp, Oryza sativa
cttatccgtcgctaggagtttctcattcaatccgctgtcctcgtaaccggatttgcacatgccacccaggcccggcccgccattggatctgcactcgctgtctcggcccctttaccaaagccgtctcgatttgtttgcgccagcccacgccaccttggcctgcaccactacggagcacggtgatggccgacaaatgagaagagggcaaggggggagggtggcggtgtcctcaaacgagctattgccattgcttgaccaatttgcaagggaaacaagtagatctgaggcgtgggggtgactgagctgaagctgcaatggcctccgcaatcactattggatctgaagcgaggactcaaccactactaaggtctcaaccacaagcatggccttcttgacctgtctatggtgtccttggcactataaagagatagtgagtgagaaataaaaggcagcgatatctaccaaagtggacaagcggtagtagcaattcaataacagcggggagctcatggtcaccgtcgagtggaaatggaggtggaggggagacaacgcaagcttgtgatcaccgtgaagaggatgcatttgttgccgtcgagtgagctcagtggtgagaggagaggggaacagtcacgtggatagtggggagaggagagaaaaagagattttatattagtttgtatatttttagcatgtttctaccctataagttcaataaatgtttttactcattcatcatgtgacacatccaacgatcgagaatgatatgatgatttacatccgacggcatccgccaatgccgcccgcaccccgccaccccggcgtccacgccctgacgtcgcgctccctgccctaatcctcatcgccgccgccttccgcgtccgtacgactgcctcgccaatctcctccgcggcagccaacaaatatccctagctgttctgatctacatcaggtagtactctggaatggttgagtgctcaattatttgtttcagtataggactgctgtcaagggggaacctcgccgtcatcacagactacggtgccgccaccgattatctgttcccacatcaccgtgaacagctgcttcgcacccacacaacctccttccctaaattgaaggtacacccattacgctctttatcatggtcaattatgatagggggctttgatcagtcagtaaccagattcatggtctatatttcattgccacatcaaattgcacaggaattaatctgtttttttttttttttgctattttactgtcgtgacgacttataaggagaacagccctatattgctatcaacgatggcaatgcagcttaatgtagagtctttttttatgcatatgtgcatgtggatttactattctgaaagctaattgtgattctcacttctatatatgtctgatatctcctcgctcgttagctgtctctcatatagaagggataaggagatcggcgagctgaagctgtatcaccttctctccagttgcatcggcagataaaataataagatcgatcgcctgaaactgttgcggaccacctccacacaggtggaagcgtcgagacctccacagccgcactccaagcccaccgtgtccattctgttgacgaagccagttatgccttccgcctaaacatggcaaacatcagatctttgcgtgaacaggtaatctgttgtgatgtttctttttctctcaatttgcattgtgatgagatgaatccttctgtgcaggccaaatcttgaacctctggtttcgtggaattcacagctcgaccactccattctcccaactctgttactgaagaacaactgcaaactgagagagaaaaacacgtcgccaacccaggaatctggggaccatcacctgcgcccccctccagttccaagtccactatgggacaacacaaccacccacttccagcacgccctggtatgcaggtaccctctccggcatcctgcttgatgaaatgccaatcaggaggaccccacacacatagtgagatcaatttgcatagatttaattatagccatttgctgtgtagcatgaattggtatgtacttatgcattaattctgaagttcacttgcaagttttggcaaaagtgcttttagtaacatgtatgtacaagactgaaagatgaaatataaatgtggcttgactctgaagttgcatgaatttcagtttgcttcacccagagagaccacttaacgtttttttacgaaatttgagtgacttgatttagggtaatctatttatcacaaatattatgccacatggattccacgtgcatacttactagctgtgcctggcaacctttattgaaacgcttagcctgcacgtatttatacaacaatatctatttagcttaccaatttcgtgaaaacatattgttctttagcagtaaattgccatagttcattcgtggtccatgtgcatgcagtcatggtgttgccttggttctaagtttctaacagagggccatggaatgatcatgaccttttgaaggtacgattaaatttgtaagtgtacccttacttttatgcaatagccccaacacttcaaaaaatgctctatggaggtttacttgtgacagttctagagatgaatgttcttcggatgctattacgaaggattcttttgtagctcacactctgtttaatttatttttatagcagccaccttttgtgatggtagcaggatgaagagcggattagtacaggtgagagatgaggatgacacagtggtgttggacaagtctatatctccgtatcttgcttgcggtggtcgattgcatcaaggggaaacttcattggagggtgtcagctgtcatggatgcaaacgtggtgacccttctaatccaacggtttgagtggccacaatactggttaatattgattttggttcctaaccatctgacggctgacgagccggcaagtacgagcaatgtttttaggtgtgcatctttgttacatgttgctataatatttctgtgtgtttaagcaccattgatcagcggcaagaaggtgtgtatctcgttgctccttgtctagatgtgcatatctaatctctggtagtttcaacagtctgtgttttgggcaatggggagtccatccttttttgggaggacaactggttggagggttcctccattcgctacatatctccggcggtttgggcgtctgtcccaacacggcttcgctgtcgcagaacggtcgccaaggcccttcaagaccggagatggattagagactgcaccggagcgctgggtttgcaagctattcttcaatatcttcaactctggagtctcctgaggtcgtcggtgcggctctctgaccaccccgactctttcatttggaagtgggaagcatcgggagtctactcttaacgttcggcatacccgtgcactctttctaggtagggctcctttccactccgaacccatctagaagactcccccccctcgagatgccggttctttgcctggctggtcgcaatgaggcgctgttggacggtggccgcctgtgttctaggggtttgcctcacccggatggatgtgtgctctgcgaccaacatgaagagactattgatcacatcttggttgcctgtccggagtctcatcagctttggtgggtcctcctttccagcactggtttgccatagtttctccccttgaatgaagattccttttatctctgggtctacaattcctgccttaaagtggggagggctagcaggcggggatttgatacaatagcaacccttactgcgtggacaatctggaaggagaggaacaatagggtcttcaactctcagcaaaggccctggtcagagatagcccgagctatgacggaagcgactctctggcggttggcacacgaggtgctgccggtgctaaccatttaggtcttgttctaggtcgtttccttctgatgtcgcgagaataggcttaagctttttattgttctcctgttttcgcatccccctcctaattttcttgtttggcttcgcttgtacatactctttatttctcttaatacaaatatgcgtgccttgcgtattcccaaacaaaaaaaaaactctggtagtaatatatttttttgtcatatcccttgtacattctataagtttgttgaattgtattttaggatggcaatctgtggatgataaatcaaacccgtgatatgaagcttttagtttttccagactttttagtactactatttgctagatgattctgagtagatacaattgctgatggttttgattaatttttagacaatgtgatagttttgtactttttcttaaatatatttcatatatgacatggatcaaatggacagaatttgggaaatttaatttgattaacatgaatttaataatttattaacacaaattttatagtgccgtagcgttagcacggacagattactagtagtgtaaaattttaaatcttcttgtaaaatttagaagcacgaggactaaaatgagaagtgcccaaaagggtaggttttttttagaggtgttgcctcagcgcctacctgttatttgaggccattggataggagtgggcctatattgttcatgccctcgtgcgcgtacacaatcatagtttcacatagtagaaatggtgcttaagacttttaaactttcgttcttcactgtccaaatatatgctaattaaggttggaaactagaaaacaatagaaaaaattcaactacaaaataagttctacaatttaaatttctaacttgtaaaagtcaaattcttgttatgccttatataggctaacgagcatgcaatgagtttatacatacggatcgtatcatctgaattaagaaacaacaggggcattattgacagggaccaatcaaccaatgttacgaacgcgcacgtgattgatggatggagctaaccgcgcgtgcccgacaccgctggttgttgttagctacaaacgtaacacatgcatgcaccgatccatggatggagcaaagcggcggcagcgccggagtataaatctacccgcgctctgcctgcctcgccatcaccggccgccgatcgagtacgtgcgcacgcagctcatctactagcctacttcgggagggcgacatgacggatgtggagctgagagtggaggccctcagcctcagcggcgtctccgccatcccgccggagtacgtccgcccggaggaggagcgcgccgacctcggcgacgccctggagctcgcccgggccgcgtccgacgacgacgccaccgcccgcatccccgtcgtcgacatctccgcgttcgacaacgacggcgacggcaggcacgcgtgcgtggaggcggtgcgcgcggcggcggaggagtggggcgtcatacacatcgccggccacggcctcccgggcgacgtcctcggccgcctgcgcgccgcgggcgacgcgttcttcgcgctgcccatcgcggagaaggaggcgtacgccaacgacccggcggcggggcggctgcaggggtaccgcagcaagctcgccgccaacgccagcgggaagagggagtgggaggactacctgttccacctcgtccacccggaccacctcgccgaccactcgctctggccggcgaacccgccggagtacgtccccgtgtcgcgcgacttcggcggccgcgtccggaccctcgcatccaagctgctcgccatcctctccctcggcctcggcctgccggaagagacgctggaacgccgcctgagaggacatgagctggccggcgtcgacgacgacctgctccttcagctcaagatcaactactacccgaggtgcccgcggcctgacctcgccgtcggcgtcgaggcacacaccgacgtcagcgcgctctccttcatcctccacaacggcgtgccggggctgcaggtgcaccacgccgggagctgggtcaccgcgcgccccgagccgggcaccatcgtcgtccacgtcggcgacgccctggagatcctcaccaacggccggtacaccagcgtgctccaccgcggcctcgtcagccgcgacgccgtgcgcctctcctgggtcgtcttctgcgagccgccgcctgagtccgtgctgctgcagccggtgccggagctgctcgccgacggcgccgacaagccgctcttcgcgccgcgcacattcaagcagcacgtgcaacgcaagctgttcgagaagctcaaggatcagcaagacaacaatgccgcagctgcatcgaacggaatgagaactaaataattgcaattagtcgatctatcggctagacaacccaatattttgaaaaattgatggacacacaaaaaaaacttttttatataagaatatgcatttggttgattcaacatgaaaaatattttcaaaccattatatttttaattggttatgaataaactataaaaataattgcattcgtctgaatttcagataaaggagaacaaataatgttcaacggaagcgaaagccggggaaatgtacggatgttatatcgagagcttaacttatgagatgtcttatattttgttgtctatgtattgcagtcgacttgtacaccgagtctttccatccctattaagagctggagctcaatattatgatgggatttgctataaatgtgtcaccatatttttcataaaaaataatcaccatgtatatttatattg

SEQ ID NO: 40681 - DNA, 4340 bp, Oryza sativa
  unsure (1)..(4340): unsure at all n locations
ataatacccatgtatatttagattgtaagtggttaaattatatatataatttaggcacttacaatataaatatatatgtaagcccttaaatttaatatgtaattacactagatttaaactataattatatttgttatattttacctaaaaatatgtcgccatattttgagatagatccttgtttttcgtattgtacatgtgtctcggctaaatttgcacggacatacctctaatttcacagaggctagcatgcacctatgattataagcgagatacaatatcatcagctcatcacttctaaaatgttaataacccactcgaactctcgaagtcaactaacataatgagcatatgtagaagggcaaaacaaaaatttgacatgaaacttagtcacacgaaaagaattaagtgaaaactcaaggatatggaaaacatatccagtatcgcaaaggtatacacactgtcttaatcacaaggacataattcatgtatacatagtaataagcaccatctccatcccaaaatataacaacttttgattggatgagatatatcttagctagcccctgtctagattcatagtattaattagaatatatctcatccatctaaaaattgctatattttaaaaaacgaagagagtagtcattatgacaaacaatagacaatactgtaccaagcatcctgtgcagaggccagaaatataaacgctctccattactccctctattttaaaatataagacacccacgtatttcaagatttcactttcaaacattttgaccaatatttagtacaatatgaatttacttgctaaaaaatttatcattgaattgacatttgaattttctttcatatggttatattttgttactacaaaccttataatatatgagaaattataggataaagattagttttgaagaccgtgtcaattttgaccatgccttatattatgggaatgagagagtatgattctctttttttaagaaaaagaaaacagtagcaagcatcagcacacgtatcaaccctcgccgccgctcatcatggcggccaccttcctgaccgacggcctcgtcagcaggcgctcccaccacgccgtcacgcgagggtacgcgccgaacaccggcacctcgtacggcatctccatgaagtagcgcgtgtacgggaagtggctcaggtcggcgaggctcacctcgccgccggcgaggtacccgcgcgtggcctccagccgtgcctcgtacacggcgagcgtctccctcagccgcgcgacgctctcggcgatgacccgctcgtcgggctccccgcccagcgccgggacgacgcgccgctggacgaacacggcgtgcaccgagggctcgtaccggagcgcctccacgtccagccacgcgtccaccaccgccgactcggaggggtcgccttcccgcagcaggttggcctcgtccgtcgccctgtgcttccgcagtatgtaccggcaaatcgcacgggactctttgaacacaaagattgaataattttattttgaggcgaattcgtgagaaactgagaatgctttttgctcgatagttcaaatgtgtatattactcaccgaagagcatcaggtctccatcctggaacgccggaacttgcccaaacggctgatgaaacaccagcgacaaaatcaagttgcaactcggcaataatttgtctcttttaatgaattagtcgaaagcaagaaagaaatgaatccttgtctctgcgcacacatacgtttctggcgaggtggtcggggcccttgtgctccctgtcaccgaagtcgacgtcgacgatctcgtagtcggcgccgacctcctccaggcagagcagcacccgcgccacgttcgtgaacggcgccgagccgaacaccttcaccggcgacatgtgcttcgctactctgctttctgtggaaagcctggtcggaaacggggaaaggataatagtaggattcttacatatgtgtgcacagtgcagagttaatttgttgatggtggcagattaaagagagcgagggaagcctggagaagaacgagtccaacacgtacatagactagtacactgtcttcgggtggtagactttacagtcaagtaagacgtgtcgtggcgaacaaggactggagagggaggagctgttaatcatactggtttcattgctgttgagtacggtaaatgcacaatgctagttctaaattcgaagttctgaatttgaagttgtgaatcacaggttcgaaattttgtttcgaaatcattgaaatcagaagctaagctctgattcagtacataatctagttaatgaacaactcctcaatttaagctaaacctactgaaatttaggtgcctgaatttaagttgtcatgttttaaattttgctctagtactgaaactgcagcgactgaagttgtagtgactgtaggagtattctagttaaagatttgggattgagatcccctgacataacttcctactgatttggtggttgacatgtgggcccgagagtggtggagctcacatgtcaatcatagtgaacagtaacatcagaggatcctcttcccaagatctgatgttgctgtccatctcaattctagcaatgtcctgaaatcctaaataccttctaaaaactgaagttctgaatttatttttgaaattcaagtgcaaatgatttctgaaattcaagtactgaaactgagttgtgatttaagttctgaaatcagtcctagtatattaacaaaaccaattttcgagcgttagttctgaaacatgaaaatgaactgaagagatcaaatctgaatttgtactagtgcttgttctgaaatctgaaaatatagttgtgcttgttctgaaatctaaaatcttaagttgtacttgtatttgtcctgaattttaacttcagttctgaaatctgaaaatgcagtagttcttgttcagaatcattaaatcagaagttgtacttgtttgttctgaaaatgtttcccccaaaataactggatatttttacaagtacatgaatgaattaactttctttttgttatatagaagcgtcagatcaggatggggctggagctatggtacatagaggtgggattgataccggtggtaagccctctatttgtctgattgctacagttcatagagcaaaactaaaactctagttcatgagtagtagtaattttcaggaatactcaagttcaagttgtcaagttatgaatttttttttctgatttaattagttttgagacatggaatttaagtccaattcagtacctggacctaaaatcctgtttttgctcaagttttgattttactctagtactgactttatagtgaatatgtactgaactttgcatgtaaaatttatgatttgtctaattcaggttcaaacgggagaaagtaaccagatgacttaaatatcacaattaatttagagttgttggcgaagaccaatccaccggtgttgcatagtagtctaggaaagttgcagataaatttgatgtgcctctcaaagttgtggagacagtggcgcaatgttcaggaataattatgtgatgatatatgatgaagcacaaacatgtggcctttttagggctactagtgagcgtgcacatacaaggcatgtcgatatatatactaagcgaagtatattggagaacaacacatccattgttgatgcacaactatatatattaatacattgtagctcacatgcaccgataaaaataaaagtattgtaagcgttgctttgataattcatcaaataaacgtaaattggtattttattacattataacgaaatgcaaaatgtgtttttctaaattggaaattctacaaaatttgttgcctaaaatccaaaaatttctgaacctagacatccatgatccccaaatttatgaatctgaaccatggtgtccatgttgttgatagctataggttggcgcctcctttcgatttgacattcaatattccgatgaacacaaccatgccaactgcaatacagaactgggactttacagaaaatgctaaaaaggaaagtatatatatacagtaaaataagtttgcagttttgggattgttctacctacttggctacttctctcttggaactggtcagatgagaagcacttatgcttgtttccatagagttgctaaactcatcagaaacaatccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40682 - DNA, 11981 bp, Oryza sativa
  unsure (1)..(11981): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaagtacacaatgcaatcgcaaaaatatcgttcgttttattaaaaaaaaccgtgattctaagtactacgtagacccttttctaccatcggaaactaatagtgtaagggtatgatgaacatattggcgaagccaggattttacaaattggggtgccaaccaggagatgtgagaactgactttagctcaggtggacattggtggcatcatgtcatggcaattagaataagaatcaaaatctacaagttacgattcgcattagcatcttgacagctcggctcctactgagagtggcagctcgtactcacccagatgccctcgttcagactaatatatctaattgcgtgtataaatttgatatgcccaaacactcctctataattgtttgtactaatatatgcataaaatgatggttgatatagttttgaatgtatttcaacacattctttgtttatgtttatatgtctccgtatggataacaaaatataaaaagcagtttattacataacaccaattcaattgagtaattcatatataagattacatccattcatctagccaccacattgcttagttaattatggaccaaataatgtaaaacctgttagccagggtggctagctatctggtttgtttgcgtctatcaactcttagactgtcaattggtcgacatctacgcttatcatttctccctctactattgctgacgccaccaacgcccatgtgaacaccgaagaaggagaaagcgatggcttagcatgtagggcgccgcactgccggagttggtgtcgtggttggggaaaagggataaatgaagggaggaggaggagaagagaagacgctagtatgtaggacatatgtctcttttttattttatttagtgatggggctaccacgtggacaccacgtcagcaaatactgccaatactgctctgagagtctttttaaccggtgtcaagaattggagttgttattatatccggttttgtggttgagggatactcactcctttccaaatttatcatcatataatggaatccaaaatttctcaaattgatcatcatataatcacatggacacgaatttcatcggaataatgcatcatgggagaatgtgtgcatgctaaggtgtaattagtatggtgttttaatcgatacatgtattgcgggagaatatgtgcatgatgtattaattgatgcgatttaaattatctttggtcttgatgtataaacttatatgatgatcattttggatggagggagtatagaagtatgaattagatggacatatatttgagagagttaaagtggactttattctccctgacgcttcggcacgaattacctacaatgggctgtgacgtgctagcctgggtcggcccaagtcccacctctggcttacgcaatgctccctccctagtccgatgtccgatctcccctcggcctcggcctcccgtctcctcggctcctcgcccacttcgtccgccgcctgcgctgcgccgagacgccgccgatccccatcccgcgagcggcggggccggcctccatcccgtgaccgcgagcaggagcgccggcgcggggcacgtgctgctgcttccaccaatatcatcgccggtgagggcacccggtacggaaatcctcttcctcatttatctctacccacacgctctctctttgcccttaaccttggcttctcttgtagatctggaagcctttttctctttgccctaaccaatagaagttcgtttccaaatcaagattttgggggttcaagtaaacccccatgcccaacgtaaggtccgcccctaaattaccatgaccgcatattttcactgttttgcatttgtacctatagcctgtggttttctatttacattactttcttttttttacaaatttgcagaacttgttaagccataggctctggttccatatgagagaagatccatatgctcttttgagatagtttggaaaatggcatcaaagaaagtataagtgggttatgtcaagaaggcctgtgattttctagaatcaatttggtgagccgaatgatggagtgcaacaaagaagaggccctcaaggccagggatattgctgcaaagaagatggaaagcaaagactttgttggtgccaaaaggatcgcgcttaaagctcaaaggatttttccagagcttgagaacatatcccagatgttaactgtctgtgaagtacattgtgcggcagaagcaaagatgaatggactattggacttctatggagttctccaagtggatgtaatggcggatgaagcaaccattaaaaagcaattccgcaagcttgctttttcgcttcaccctgataaaaacggtttcgctggcgctgaagctgctttcaaattagttgcagaagctcagtcaacattgtctgatcgaacaaaacggcgtgcatatgacatcaaatggagaattgcatcaaagcaggctacgcaaccaaagcagggtgcccaaccagcgcaggctgcccaaccaaaacagtgtacacaaccaccgctggctacaaaacgaaatcagagtgcacaaccaacgcataatacacagcagagtgcacagccaaagcagagtacacaaccgatgcaggctactcaaccgaagcatgctactgaaccaatggagaaaacagatgcaaatagagctagtaatgctaaggaaggatatggatcatcagttcgaccacccagtgctggagaagcattctggacaatgtgtgttaactgtaaaactaaatatcagtactactccaatgttctgaatcataaactccgttgtcagaactgcaaaaaagattttcgagcagttatgctaaatgaacaggatgtgccttctgtattctcatcaagtgcagccaaaagtgcaggacaacattgtgacgttcccaaacaagaggactgttctacgaagttctcttctgcagcgaatagagatgcaaagcccatggtgaatggaggacaacatgatgaacaaatgaaaaacagtgccagtgtcagagcaggtggtgaggggacagttaaccatacagagtcaatcagaaaagggggacttgaattttcaacactgcatgtatcttctgcagcaaatgttggtagtaaggcagggggaaagatgacatcgtgccctactccagatgttgctggtagacaaaaccctggtaatagggtaaatacatcagcagagacaggtgtgatgaatattcctaatccacggagatcggctaggaggaaggaaaatgctgatgccagcatcatccaggatacgcctagcaaaaagaggcgaaccatattagattggttttcaaatcctgactcaagtcgtaagaaagtggctgatgataatgttgtccgtgctgatggacaagcttgtgaacctcatgtctccagcgaagcacacaaccaccagaaaggaactactagcaatgaaggaaaccaggaaaaaaggaaagatgttgcacatgatacaaatgctcagaagaaatctggcattcctgggaacttttcctatcctgacccagaattttttgacttcgataggtgcagggatgttagtatgtttgcagttgatcagatctgggcactttatgatgaccgtgatggcatgccacgatattatgctcgtataagacgcattgatacaaccaacttcagagttcagttcacttggctggagcatgatgcaaagaatgaggaagaggacaaatggactgatgaagaattgcctgtggcttgtgggaactttttcttaggaaaaacagtggtgtcacaagatgccctcatgttttctcatattgtgtcatgggtgaaaggtagaaaaaggagctcatacgaaatatatcctaggaagggtgaggtatgggctctatataagggttggagtatgcagtggagctcagatgcagataagcatagagcctatgagtatgaagctgtggagatcttgtcaaatttcacagtggaagctggtgctgctgttggccctttggtaaagattaaaggttttgtgagtctctttgcaaaagtaaaggagaaaccatcattcgttataccaccaagcgaaatgctacggttctctcacagtatcccattttttagaacaaagggagatgagaaggtaggtgttgctggtgggtttcttgaactagatactgcatcacttcctagtaacttggacgtagcctttccatcggttactcttgattcttgcatgcctgtctgcaagacaatgaacagtggatttaatgatttcactggatatgagcaaggtgcgctgaaagaaaatttgatgaacgaaggtaaacgtaaagatcattcccttgaacgaaccccagtgcatcaacagagtgctgcctattcctcccccagtacttttgattacccaaactctgaatttcataactttgaagaatatcgatcatatagtaagtttgaacgtggccagatatgggctctttacagtgatcttgatcaatttccaaagtactatggttgggtgaccaaagttgatacagatccgttcagagtgcatttgacttggctcgaagtctgccctcagctggagcaggagaatatgtggttagagcagaatattcctgtgagctgtgggacttttaaaatccgcaactggaggataaagttagacacgaatgatgctttctctcatttagtagaaactagccaagttggttggaaacgatactttgaaattcatccacaagtaggggaaatttgggccatctacaataattgggcacctggttgggttccttccagcaaggatactttcgagtacacaattggtgaaattactgactgcactgaagctagcacaaaagtcttacttttgacccgagtagatggctacagagctgtgttcaagcctgacagtgtaaggggcactctggagatacctacaaatgaaaacataaggttttctcacctgataccttctttccggctgacaaaagaaaacggtggcaaactctgtggcttttatgagctggatccagcttctgttcctgatactttcctgttccggagcggccgctgattggcaaatgttgatgctgactgtcctggagatagtaaggatctggtctcttgtatgctcttctagtagggtgttcatacaccacgcagctgtggtgcaaaccaaaccatgctatcttttctaatgttgaggcctctgtgctcattcagttagttattaggttaaaattgcatgttgcattggcatttggcatgtgatgcagtgattatctggttgtcaatttctcttgaggcgttgccctgagagcaaatgggaaatgtcatgcatactgcaatttttctggagccaagcttcttttctggccagtggtgtcatgggcctgtgctcaaagaagtattgcaacctgtaacatataggttgcttcttgctgtgctttaatatatttgtgccctttcatttggtaggatgcttctgtgttgtgttcatgctatgtctttctagatacaatattgctaatgtgatggtcaatggttatatgattggaaaacaataatgcaaccttagggcttaggtagaaaaagataggggaatcctttttttgagggctgaggtgaatgagatggttttgtctatctgtttggttaaaggaatgggatgacccggatcctggaggcccaatatggtagtatttgcttggggggattagatgggacatgaactagaaaatactagctctaactgactaggctagagaaaaaaattggaaaagtatgtactaaagtgatttagttatcattaattaaccaacttaatttcattagtactattgatgatgtgctaatattccttgttgataattatcatgtacttcctccgtttcacaatgtaagtcattctagcattttccacattcatatctagatttattaacatcaatatgaatgtggaaaatactagaatgacttacattgtgaaacggagggagtagtatataaacaaaccttgcactaatagtaggctagtagctgcttccatgtgatcgccaacagcaaataaacctgacagaggatgagaaccatggatgactgagaatggaacagctggttcatgatgatgcagaggagaatggcatgtgtcttttccaattggcttgcttcgatccttcaatcatttccttggtattcatatgaacacagggactgccagatgatgctaaggtccatgtggaggcacccttttttttcagcagttcctttttggtgttacaaataacaactcatcctgtttgctcctctgtaatgcaggtctcccaagaccagggagtcttgacacagatgctgagatggagagaagagtttagaaccaacacatgccaagcaattagctaaaagatttggtgattatacaagcctgaattttcgcaggtgccgtttactgatgtgatatatggtgttgaaataaattttactgtttctagccatctttcttctactttattagtaactgtaaaattaaattctttttataagcttttttgtgtttttatgcacacgtcatttcttggacagagaaggccgtggctacaaaatggctgttactgtagattcttcgtcacattttgctaggatgagaagtgaggtgttctggaattctttgggcacagttttttggaagataggactcgtgtctacatgatatgcaatattctgctgacatggatgaggagagaaatttcatgcacaagatatggtcaaattgtatcaatctgttgtatggtatatagtttcgaacggtcttcatttcggctacagggaccaaagaaaaatgtttctgtccaaagattgaattttttttttggttaaatgattctggagttggaaaatgtttgtatacgagtattggtgatgatggaggcggaggcgtactccagccgtttttgttagttactcatccgtttcacaatataagtcattttagcatttcccacattcatattgatgttaatgacttacattgtgaaacggaggaagtatatattaacccttgtttggatgactggttctgcaacctttgtggttctgttgatgatggttttagcaaggaatggtccgtactgaaagttttgtactgattgtaaatttcactcggttgaattcacttccagtgttcaatttcagtgaaacataatggcattgttcacttttcagggttgaatggcattgcactataagaaatcaagcagagtaattttttagccacaatctgtagggaaaatctgatagtactgatgcacgtgcaggacaacatcaattcagaccatcatagaataagtgtataatataaaaaaaaatcagaccatcgcataaattcagagcattgctatatcttgttgcatcattgaacataagtattgatctatttcatatctaagttcatgtctcaaagttggacttgtagttttcctactccttgtcattggtccagaattaccaggtgatccaatttgttcatgtcctaaagtaggacttgcaactgctctactcctcatcattggtccagaactaggtagtgaagtagttggtggactgcagggtggcagttttagcccttcctgatgcaaccgaagttccagaaacttcaattattatatacatttaaaatcaaagtcctcttttacataaaggttgaataaaattttttaactaagcaggaaataaatataacacataaaatcttacaaactcacatgtaaaagtgttaaaacttagataaaaaaaaaggaagcaacaccatatacaagtacaacatattctattatatactaaaaatccattagactttttacaaatgctctcaagctgccacgtgacattctacaaacgctctcatgatgccatgtggcgctctaataaattagagaaaatataagaaattctggaaaaaaaaatctagccattgatttatgcgcaaacatatggagccattatttttagccattagattagatttgttaaaatctctctctcctaaaaaccggctaatgtaacaaatctaatctaatctaatggctaaaaggaaagaaaaaaatctgtccgtacgaatctacggtccattattcatatgttaatgggtatatacggaggcgacgagactgtcacgaaccaacgagtcggatcggaattatctcctgtagtgaacaaaaaacaaccaccaaaacacaaattaagtctagcacccagcagtccagcacgtgattagtgtacgtttgatcagttggatagttgagaagagtattagaatgatatatatattgacacatctaaatatctcgaataaatgatagatatatactaaatatttattaccgcataattttgattagttgtctatataacataatcgtttaatggaaccctacattctgtattttacaatacaactacgtaggacccggccgtctggtagttttctctttccttcgatctctaagttatttttcaaactgtgcatatgtaccaaaagtactcctacgaggtcgagaagaagccacaccacggcggcgcctcacgttatccattgctctgctttcttaccgtcgatctatctattatatactaaaagtccattaaacatactataaacgctcctaaactgccatatggcactatataaacgctcttagtccgccatgtgacaggaaacattcaaactctctattttcatttaaatcggtgaacccattattttagaccattagattagatcttttaaaaatccaccactcctaatcttcttccgtgtatgtactaggttgtatacaacgacgaaaaaaaaaacctccctcctaatctactgcacgtgcaggtatgacacaattatgtgtgtgtgaacttctctttttgaacaatttttatgcacgagaagttttgtaggagttggtcttagcaagatggacaagcctagctaccttctgaatatcttctgaatatctgatacatataacaatttagcacgacacacaatccatacattaatttgtacaccaattgaaaagcatccatccatatgtccatacgtgtatgtacgacgacaagaaaaatacgtgcaaattgttcgccggataaaagccgaaaaaatgcatacatacgtaggacacaccattctcccaaaaaaacatacataatacctacatatacaagatcgggcaaaaaatcaattctcccctctcgatactcagattaaatgttgttatgttcgtatgcttatgatctgtccgcctaaacttacatacgtagtacagctattcgctgaaaaaaaacatacatgctacctagggatgtaatattgcacgggaaaaaatttaaaaaagttcagatataatacaagaaagaaatattgaaacccactaacccctgtgttagtgagagattgttactcaagcaaatgtttttttcacatggttcttagaagtgttagccggtctcacatgttagagagacattcaagtttaattttaattgtactaccctattaattggtaggaatagcttaagaatatctacagatagatttggacataagatagagaattatgtgtgaagtgttcgtgattattttattgtattacttatgtgttagactctttttatggtactaatacaattccatttatgaaaagggacccaactttcaagacaataataatctgtagtggtgataggtgagtttatatctaagcatggactaagagatttttgtttgaaatttgagagacattataatttagtatatcaaagtatatgatctatttcacggcatgagtattttttcttctattttagttaccattataagaaaatttaccatctcttatggtgaatttataagatgaatatggtaagataatactacttttagtattctcattattattaaaaaataaaatgcccacgcatcaccgcgggcttccttccttgttgcagttaaaatgaaataaaattgcacattgtatttgtatagcattgcaatttaggattagctatgtgccattttaggtgactggaaacttaaaattttcaggtgcatccaacaattagctattcatatactccatccgtcccataatatagcaacctaggaccggatgagacattttataggacaacgaatctagacagatgcataggttactatattatgggacggagggagtacgtagattttcttatagccctgttatatagctcacgtttatgtagacgggctactggttccattaacaatagtctgcaagcttacaaaatcaataaggaattagatgatgcctcacgttttactgcgggatatatgttagatattggagaaatgatgaaattatttggattgaaatattatgaaatgatttgtgaatgatgatttatcatgtgtagcatgaataaattgtagatataattactatatatttgtatgttgagctttgtgtgttcattgggttgatgtgacatgcttgtatgtagattttagaaatctatgctgagttttaggtatttagtggcattaactttttagaaagaagggttttctgagttgataggaacaaaaccctggtttctgttgttcaatttatttcattttacttgtgatgctcctgggacagaacaacgggagaccacactgaagcatatatactgtatcatttagggagcctgcaaattattcactgactcaaaatcgagattttgggatggaagtagtattattctgtctgttttacaatttctgttatttcctttcaagaaagaagctggtctatgcgtggcagaataaggagaatggagtactcctgaacacgtgttgacagagaaacacaaatcacttgcgcctgaacacatgcggtgaacagagacatttgcctgaattgacaatggaagatgaacgatacatctgcaggctgcatcctctacacataaatacataataatgtacccaggcaagagtacagcaaaaaactaaaacatccagtagagggtgtgccgcctttatcttttcattggtcatctttgtcaagattgtcaagattaacatatataactattatgctttggttctgatcgtttaagccgacaatccataaaaaaatgaatgaagcaagataacaatttatggtaaaactttttcatatatgtgttgttaatgatttaaaagccaatagtgaaaaatatactacgttgacaagactacaaaattaactccaaaattaagtttcaaaattcaaaatttggcagtggcaaataagctaagaagctaataaatcaggattgaaaatttgtgtaatattcagttttgtcccacatggtcttaggtttattgcgcattgctgaattttgttcgttctttttcttgatagttattccctttttctaatgatagagaatatatgatggattggctctgaggtccttctaccggaagaaaatacttcattgaagcttatattggttaacaggtgctacaaaaacagtagttatatgcacgtcttactgtgtttgaaaacaaaatcaaaattaaggccttactccctccgttttttaatagatgacgccgttgactttttctcacatgtttgaccattcgtcttattcaaaaaatttatgcaaatatataagatataaatcacacttaaagtactatgagtggtaaaacactcaaaacaaaataaatta

SEQ ID NO: 40683 - DNA, 10764 bp, Oryza sativa
aacagaataagttcactttaggtcctttatgagcttgaattgcatcattgaaccgcaataccaaatataatatgtcccttatctttcaaaaccaatataactacggttctaaaagcagtattgaaggttattttggctaacatgacattgatgtagcaccagaagcaaaaattaaaaagaaaaacatatgagacccacatgaaagtgaaacaacatcttcttccttcttatctatctatcggatgcgattgcaagatggacagcaaggaggaggtgaacagggagcattggtgggggagagtacaatgcgaaggacagacgcaacggggacattggggaggagcgccacgaggagaagcggtgggagtggaggaggagcgagaacgggggagggtggccatgtccaagcacgaccgcgggtcactcgttgatgctggtggtggcggttgagcagcgcggtgatatcatgctccatggacctccctgctctcctcgccgagctcgtgcttccctcgtcgcattgttgatgacgattactcctagcttccctctctctcctttatccccctatcaccctctttgttctctcctatcttcccaacgtcgctgcccttctccctaccgaccaccggccatccttctccctattgggcgcacgcttggaggcctggatagagatagggaagaaagtggagggggggggaagactgggccactaacatattgggcctagccagtgcctcaacccgtatcgccgctccctactactgcctcaacccgtatggctgctccctaatcttcatgcgggccctcactcttcgcgccgtacatgtgactggggctcatccccggtcaatggcgtcctttgggcaaggtcgacacagaccctcggtgtgtgttgtagtccgcgacaagggagtgggaggaggagccgcgatgatggggagggtacgccaagacatgtcgaggggctctcttttatgccctgcaagtcggtactgctcgattctgcacgaccaagctggattaactacttcggtaggtggctacgatgatggctgtcacgtgggataggcggggaggaggtaggccttgtccaccactccactccacgctctccaatcctagatcccaatccaccatgctccaaacccttgttggcgccgcgaccatggcgcaaccgcgacgcaatgaggaggatgtgctcgtgggcttcaccgttgacgagatactgcgacggaccgagggacagatggacgctaggatgctggactccaacattggcatgatctctatggtcgtgcactacttcgtcctgctaccgcttgttgacactagcctcctcacctatgcattgaaagcgagccgtggcagcttcaaccgcatcagcagcctccccgatgtgcacttgcatgacatcgtgtcccacctccccgccaaggactcgcccctaacaaaggttaggtgagctcgccggctgccttccccaccgcccgcctttcgccctcaccttcgatccccacccctcactgggcatcgtggtccacacgtaggcgggcacaccaccccccatgttaggtcgctcctcaactgcactatccatcagctctccaagctgcacctgcgcgctgcttgctcctctcgagagttggagagaaaaggggataagagatggagaagaaagggggaggagtagagtgaggatgacacgtggggctcattttttccccacgtaaacgtctagtcataaaaaaaacagccatctatactgccggaggatctgattttaacgattttaataagttagggggtgaagatttctcgtattgcggtttagagttgccgattaaactcgacggaaagaggaggacgcaatgtggactagttccttcctcttgtaacagaagggtacttacgtggcagcccaatagccaccacgaccctccgattttacggtcggcccagcccattactgagcggaaccacgcgcagccgccagctaaaaccctagctcatctccctccaacgcctccttcctctttcctcctcctcccctcctcggcccttccttcccttcttccctcggcggcggcggcggcggctagcaatcgcgaggaggagaagatggtgaagaagagcaagaagagcaagagcaagcgcgtgacgctgcggcagaagcacaaggtgctccgcaaggtgaaggagcaccaccgcaagaagcgcaaggaggccaagaaggaagggaagagccacaggaagaaggtcgagaaggaccccgggatccccaacgagtggcccttcaaggagcaggagctcaaggccctcgaggcccgccgcgcgcaggcgctccaggagctcgagctcaagaaggaggcgcgcaaggaaagggtgagccgggcaccgcctttctccctctttgtctttctttctatccttgctgctgctaaagttgttttgccagggtcgatttctctggtttcctttcgattggcgattctagtcgttgaatgaaattcttggattagatgttttaactgaacgggtaactgttactgtaagcaaggtgtttttgggggtagatttcatgccatatgtcattgtctggggcgctaatttttattcctgtaaaaaaaaaacgatgattgtgaaattttgggacatctgttcagaagtgtgttgaatgcacatatgaatggcactgaactttatgagatttcattagaatgttgtatgcaaacactacacattcagtgccttaacatggacttgtgtgagtaacacatacctgcactgggaagagaggattaaatatttctgcaccttatttagtttcatttgtattatacatcttgcttgtactgtttgaccaatggtagaatattgtgaccacttctgttcaggctaggaagagaaagcttggattgcttgaggacgaggacattgctaatttggcctctgcagcttctgctcagggcagcgagtttgcagagaaggatgcagcaaaggagaatgcctctttagacgtggttaagagccaaggtgaggttcaatgttcctacttgtcatgctttgctgacttactgtttgcagttacgttattcctaaatctgctggttgtatctccagatcattcagagagagccttctacaaggagcttgttaaagttattgaagcgtctgatgtcattcttgaggttctcgatgccagagatccactgggcactcgttgcattgacatggaaaagatggtcaggaaggctgatcccagtaaacggattgtgctacttctcaacaagataggtacaattcaagttttctttgagttcggacttcactcgtgttatgtctactttcttgtaacatctcaatttcaattcgtggcatccagatcttgttcccaaggagtcagtagagaaatggcttacgtacctaagagaggaaatgcctactgtcgcatttaagtgcaatacccaagagcagaggacaaaactgggatggaaatcatcaaagattgataaatcaagcaatatcccacaaagcagtgattgtcttggtgctgagaacctgatcaaattactcaagaattattccaggagtcatgaggtaactgatcaacgttcacatgtgtatcataacttcagtgggcagtgtaaatggattgttgttagagtctgcttgttgaaataatctgtagtaattgttaaaattgccatcttagcaaacagtacctttgatacctcacctggcatgaaaatattgaatttccattccgtttgttctgtgtactgctttatgcaaaccatattaacattgatgataacatcaagtagtaataattttctaatctcaagaatggcctaccttaatttgttatatgggcacagttgaatttgttgttccaagtagttctctttcattttgtcatgtttgtacagtggtaccgtcgctagggaattcatgagcttttaattctcattttgcacactctgacctgtagcgatgcatatgagttttttttttcttttctgctttatgttgcccttttagataatttttattatttatatgttacagctcaaactggcaattactgtgggtattgttggtcttcctaatgttggcaagagcagtctgattaacagtttgaagaggtcccgtgtggttaatgttgggtccactccaggagttactagatcaatgcaagaagttcagttagacaagaaggtgaagctgctagattgtcctggtgttgtgatgctgaaatcttccaatagtggtgtatctgtggcccttcgcaactgcaaacgagttgagaagatggaagatccaatcagtcctggtaagtgttgaaaaatagcttgcatcattttggtgctattcagatagttttgctgaaatcttcatttaattagctatatatgtttttattatgtgtatactaatactatctcattcaacaatatgcattaaatgttgctggaagtgcactgtattataacttgttccatttttcttcactttacatcctctcagtaaaggaaattctcgatctatgcccgcacgagaagctgctatccctttacagggttccaacatttacttcagtggacgatttccttcagaaagttgccacactccgggggaaattgaaaaaaggtggtatagtggatgttgaagctgctgcaagaattgtacttcatgactggaatgagggtatggtcgatgattcctcctgtactgatttttctttactcttattccgtttctgagtcatgtgacactgttattttttaggtaaaataccctattttacggtaccacctaaaagggatgctgtagacgactccgatgcagtaattatttcagagactgggaaagaatttaacattgatgaaatttacaaagctgagtcatcatatattggtggtctgaaatcactggaggagttccgtcacattgagattccatctaatgccccaccgcagattgacgaagagatgctagaggtattactatggttttcgtcccattgaaaataatctctattctttatgggtgtgatttgcatgacatttgtgctaggaataggattgccatagttggcatcatcgatgagtcatgacactgcaattagataatgtacttgtcttgtgcttgatataggatggcaagaagcagaatgaacctgcgcaggaaaaccatgatgagtcgatgtccgatgcaaatgagcgtgaaggagccaagacggccagcgcgagcacacagaatgacaagctgtacacagcagagggaatacttgatcctcgcaagaggaaagccgagaagaagaggcgcaaggcaaacaagttcagcgtgctgaccgacatggatgcagactacgatttcaaggtggattatcagatgaaggatgccctggccgaagagggcaacgatggtggagatgaggagcccaaggaagctgaccctatgactggtgtcgatgatgcgtgaactgatggaactcggcagattgagaatacgaagtagatcatataattataatatgatggtggactgccatcccaagttttgtaccctattagttgaatgagagaagataatggacgctgcttgattcacatagccactgagctggaatcagaattttttgcccatatgcatgcaatggttgcaaaattgcaaaccatcttccagcgatcactctattgtttgggctggtggagagccgtgcctatcagtctcgcatgatatctccgcgactgtcctctgttggggctagcgaaaaattcacaggtaatgtttgacatatcctagttacctcttctacattaagtaaataaactcacctaaacttcatttttaagatcaactcatgggtttctcgctcctatcctatgttttttaaatagattctctacttaagtgaactaaatttcactcctaagatcattccatgaatctcttgcgctcggcgtggagtgcagcctaataaataaatgaaacttccttaaatcctagtagagatattttgtattaaacataaagcatcaagttatacttgttgaactatcaaaagttcacaaaataggtttaggtcggccttttcctctattatggtgatcagatctgagccctctatactctccttcctcgctttgttctggattctagggtgttcggtgtaaatttaggacctccacataaattttttaaaaagagagctaatataaaaagtatcaaggggctgaaatataaaattaaatctactcctagagtcacttgtactatgaaaaacttagatcttatatccattgccgtagcctacgtgacgtgacattactgtgaacgccaaaaacttaactaaccacatgcatgaacctcaaagccaatataatccacatgccattttgccgctcaacgtgaggattcaaagcgagagtaaattagatctccactgatcaacgctacaccacgttgaacatgtccaaccaacccacctgaactatagtgcattgggtcgatttattaggggtgagactaatcatggtcaatgtggtcgatcgcccataaccgcgggcacggctattcgaatagttttactctggccagaggtatacgactgtacccagaagacacaatccaccggcatgtcaccgtgtcatcatgcacccatgatgaaaacgtcaccatgtcgagtggttgtgacaagacccttcatataactccctctgaccaatcgcaccacacctcaggtttcacccccacttctcgcaaggcagccgacagttccctctcgtgccacggtgaatccggaagccgatcaaccgaacaccccggccaacccaactccatcacgcccacccttgcctgggaacgtcagttagatgaaagctatacttcaagtcaggcagttacacattcccgcctgtggcaagcgttgtatgtcttccagtgcatcccgtgaactgatctttaattgccatgggtgcgactagcaaaaccatgcatccacagcccaccattcagtcgtattttagttgaataattacggccaatgaaacatggccggatgtctcgagcacacagctcgttctgctactaaaaaggtctaatactgcaattattccatcaactgagctagtggcaattaagcatggctaagcatatagttctagctaggtcacataagtaacatgagctagtcgatttattacccaaggttgacaaatgacatatattaagtaaacatggcacaagcaagcagataggtaaaccctgatcctatgtaattagcaaaacatgcacatttatttgcaaacgataaaacatttatcaattgggatcaacatgctcaagaggaatgtgtgacttgccttgcttcttcacaacaatcttctgaactcttttcctcgcgaccgcgatcttccaaaatgacggattctacacgctggcacgcaaaagaggaaaaaactctaataaacaccaagaaaacagtacataaaaagtaaacaaacaggtagagctcaattttagatgaattttgcaagttgaatgacccaatttgaagttcgtatgaattagatatgaattttagaagttttgagccatttaaataaatttctataattattaatgatttattgcgcaattattaatggattatgacgtcaccaaggggaataggtggcaccgacaagcgggtcccacctatcggtggctcaaagggatgggcgcacggtggactcggtccacgcgcgcgatgccggcgggcgcaccacgtggtggccacgcgggacggggaggacgaggtggtgccgacgtgatgccacaggggcggcgacgccgagcggctcggggagggccacgtggacggcccatatccacccggggtgaatcgggcggccacgggcgagcgggaattggctcaccggccggccggccggccggggggcggcgaccaccggcgcggcggcacagccgggaggtagcagggggaggcgaggggttggaggggagatgcccaccgagcggcggccggcggaaggggcggccggcggcaaggaacaacggcggcggggctcctcgggaagacggcaagacggagctccggcgacgggcggcactcgggaaggggcggacgggctcggcctcgatctaaggaagataaaggaggggttagggaggtgaaagggcgaccggagcggctagaaacaacggccggcggcgacaacacgagttggagctcaccttgggctgaggaagcggggttccagcgacctttggcgaatgaaaaggggcggccgggctgcacacgattgctgcggtgctgaggaaggcgagacgcagcacggggtggaccgggacggcggcgagaggtgactggaggcggctgctatggtggcggttcgggtggtgtggtggcggtggggtttcggtggcggattaggggagtggagcggcggacggcgtgcagctcggagtggcgaagctagcggtggcggcgacgcagtgcggaggtggctagagcggtggtgaggggcggctggagatcgccggggagcagcggcgcacaggagcagcgtggggagagcaatggagggcacggcgggctcgggtaaatgggggaaacgagcgaggggagtgcggggaggagttttatagcgctcgggggcgacggggaggccggggcgaggtggatttggggcggcaaccaccggcggcgtgggtggcatcgtgggggagttggcggccggtttttgcgagcgcgagagggggagaagagcggggacgtgggcggcgaggtcccacggacgagcgtgcgcgcggggggtggaggaggtgggcggggtggcgcggaaaaggcggcggggcgtgggatggtttcggcggccatggcaattgctgtggggtggctggaggtaggagatgacaggtagggtccatgggtcccacctgtcggggagagagggagagagagttggaagggggaggcagaacagacttgagggagagagagagccgagcgggccgagggaggggaggacttgggccgagcccgaaaaggaggaagggggagttatatttgtttcctttttattttaattgataaaatgaactttgtattgttaaaattatttcttgagctccgaaaattcacaggaaattccaaagagttcattaaggcacagataatattacaaaatattctcggccaatgattttttaaaggaaattttaatttcctctattatttcacttgattaatttgctttcaattttatttaatttctagaaatgctttatttaatgatttttaatcccgaacgaaaaccggggcgttacaatggaggacaagtattgccacggtaggtggtcgcatctggctcaggcgaccaacggagagtattatccaattaaaggattacacttctttatctactaactccagacttgctgttttacaccgtttatgtttaacgtttgaccgtccatcttatttgaatttttttatgattagtatttttattgtcattagatgataaaacataagcaatattttatgtgtgactatttttttaattttttcataaatttttcaaataagacggacaatcaaacgttggacaaaaacccacgactacacttaaattgggacgaaggttatagttgtgaaggtctgtttagagaaccagtttcttcgggatgcactcattaataggcctgtttgagacagctgaattgatggatggatggattatctgatttcttcgtagcaatttgagggtataaacaaataaattaactactacaaaattggaaaaaagttgctttcaaagagtagtccagaaagttttatagaaaattttgctcgatatccatcgtctagaagcttgggaaacgttcaaatgaaaatccaaaatccaaaatcctaaaaaaaagaaacaaagctaagttgtgcctaaactgttttttacaggtgtgttcgttaaggattatatagatatgcaatactataatagaaacagttcaattctcactagaaatttccagctgttctcatttctgacctctctcactagcaagttatcagcagtgcaaacgtgcaataccacaaaaaggacccaaaaaggattgtcgatctacataaccttgtaatcgtaagatcttaagcatggtaaatgtagcaccaaaatgttgcctggctagtcttcccagggacacgccagttggaggaaaaacttccaattggtgacatcatagaacaataagtgcatccactagaaagaacacatcgtatgctcttaaacacatcaaagtgatggatgagtaactaaattagaacaagaaaacgattgtcccctgcaaaaggcttgaaccatacaatctaaaatagtgtcttttccaagtaataagtcgagtttggtggtccaaacgtagacaattaaatcccagtaggttcatcctttaacaaaatatcagaaacagctttgttgctaccaggtaacttccgatttccccttcccgaaagcacagaccttttatatacacatgacacatgtacaggtagtttgcttgcaatcagatgagactttattgaggtgctgttaactgctgagatccttgttggggaatcggtttgttatcaacctctatctcgcgaaggccctcaacaggttgcctgcatattgggcatttgttggtctgatattttaaaacttgagcacactccctgcacaggcactgcaaaaatggcacatgctatct

SEQ ID NO: 40684 - DNA, 8802 bp, Oryza sativa
aacttattgtcattgcttcaataatcagtacagtgccaggggggttgcaagtgctaatacctaatagtggagcagtggatgttactgcatatcagacctttgatgtgctttaagaaaggtctgtctttcactttctggaagagagtaaagcactagcaattttttttcttacgtttaatataagccatgaactttggcatagaaaactaggaaagaagttaagagaaaatggcaagatagttggcatactcactgaaagaaaaaatgggttttaatctaaatatctatgcccgctaagcaggttccttaatatgctggacagtgactgcctttatttattattaaagtgggatttgacgaatatcctactcctttatcttagcggttcaactatccctcttccagcctccaatggcacactccaaaccatatagcagtagacacaatccaaaccttttcatattctcttccagtttaaagcaaatcaaagatggaaaatgcccgaagaatgcaacttcaaaattatctgataagttgaaagaatgctaggagaaaatccataactattttttttccaactctatctccataataatatatgtatgcttaaacagataagtcttatggcaaaatcgtgattctttcaagaatacttagtaagaaagtaacttaccatatgcctgcatggaagaacagcagtatctcttggttcagaaaggcaaaccacacattctttcccggaatcatcctcatgagcattcttatcagctgtgttcccaataccatatatttcctgcaagacatatctgattccatttacccaaaggatctgctgcacaacatgaactccatattcagcattgtctttcttcacaaatatagcatatttaacaagatatttcgattgttcggtctcatgtgccccttctgattcttggttgcctgacacatccatttgtactttgaatgctacagggaatacaccaccttccccaacattagttagctcagattcctcaaaacgagagacatcgattcccgacccacttggttgcttgaactcctgacctcgaccttccttaaaaggcacggtcacaggttgaagcaaattttcctttgcggtcttcaaggcacacttatcttcttgtgcaaagaagcagacagttatgctgtttgcatgatgaataggtcttttagttaaacataacacatgacaatcttacaaaaaaaaaaaagaagtgatgacaacaaggaaagccagtaaacgttcaattctttaaaaaggttcaaggagatagccatactaattgtgaaggtcccagaaaattggaaatttggaaacagtacaactctattttcaaacaataaattaataaatcaaagagcatctaagtttgagctttctgcaaaaaagaaaggctattctgaaaaaaatgatgcacatatataaaatactaccaaattggagaagtctgcaattggaaatacacctaaggatgatatcatcctaatcaaggtatagaaggtttcctttcaatgtttatcatggattggaattccacaaaacatggaacaagagacatatgaagttgtgatcagttcagtttcaaattgtaaatctagtatgacctggtctgcataaggcataacttttgaaaacagagttacactcaatatgcgcaacacaaactggattggttacaactcctaatgtctcatcttctgtttgttagttccattcaatctgccagaagagtgaacaggagatttcttttaaacctttcagaatacatgggttaggtggagaataccaatacgtgcccaaataaccacatactccttaagtttagatatcttgcacatcaggacagacaatatatgcagaatgaatccaataagccatgattttttttggcggatattaaatgctctagatcacacattgttccatcagttgaaagtagaaatgaataactcgatactcttttcaagtacacaagtcattttatgatagaccttcataattggtatggatctttatgagttctgcagccacaacttcacgagtgctatcttaccatgtcttaatctttgttgggaagatgaaagatgtgccaaggataaaatactattaagcatggaacattttgagggcgtaaaaatagcttaaacatcagaagagactgaaccatgtaggattagtaacagaagtcacaggaattaggagaatctcaactaatatgatttggcaatggtgacaatagaaatgagagtagcaggaatttggagaatctcaattactataacatggcaatggtgacaataaaatgaaagtagacatccaaaatcattaagataaatcaagctctgattctgacaagtctggagtacggtgagtcccatgtcactacctaaacaaatctaattcttagtaagaattatagattgattcttgctactttcttcaacttcatttttcacactcaataccaagttatgtgaacgattttattttacatttctagtatatatatattcaagtaagaaacatttgctttagcaagaagaatcaagcagtatgcatctgatctggtactaagtttaattgaattctacattgaagcattcttacatttggacaggtaatcacgacattatgccaaacacaagatgggccaattttgtaccccaaaaaaaaaagagaagaagaaagcagtacacaatcgaaagcatcacgattgcaacaacatttgtttgtgctgagctctctggcagaaattttagtaatgtagtataccaatgttactacgatctaaagatcctaaatcaaagctatagcaacgaaattaccacagcgtctaatcaagaaacccacttagcccggtataaataggtgagaggggaaaaagaagaaggagcgggaccttccggggccatcggcgtcgaaggagaaggcgaggagtaggctgcggccatcgtcgtcgtcgtcgtcgggcaccagccgcagggtgtcccccttgacgttgacgccgacgctgaccgccacggccctgtgccgctccacgtgcgcaggcaccggcaccggcggcggcgcggcggcgccggggggcggacgagggtagctgtggtagtacgggggcggcaccccgtgtctataggcttcgagatgcggcggcggcggacgtgggctagcgccgccgctgctcgcgatgttgcccattgggaagccctcgcctctggagtctggaagtctgggtggaagtctgacctcggcgcccgttgctacgctgctttagcccgttccgctttttgttttttttttgttctttttttttctctcgtagctgaaacagttgaacaggcttttatttttgtcatagttgaacgataagtagggtttccaaaccgccggggccggggttactgtgccccggcggtaagcacggttaccgcgcggtaaccgtgaaaaaccgtacaaaaccatgtaaaatttataaaaaattcaaattatttttaaaatttatttgaatttaaggaggttaccgcggtatttatattaccgtacctccgcggtaagctcggtaactgcggtaaccgcgcggttaccggcggtaagggaaaccctggttacaactcttgcaaacagacctacctaaaacataaacaaagacaataaaataataatttacatttaaaacttttataattgtgtttattattaaatttgagttacaatgaggccctaatacttaaacccttttacgtacatgggacatgtgaactgatatgtctcatgtgcgacttctctttacggttacgcttatagaatacatatgatggtattcagttcgtcagttttttttattgagttcagctcatcgctactttttttctcagcatagtagtgcaagagttacttgaaaacttctaccaaactcttgctaagattagtaagggcctttacaatgcggtgagctgttattcagttcggtcttttcacgtcagagattcggtgtcaatctttgccacgtttgtgggcaggcctaccaaattaaagcccgcatgatcttctttgatcacctgttcttggcgaggggagataaggctacagacgcgttaggagggcgaggcttcgttccactttttctacatgcaccatggacctttgtggcttttctaggtcttaaatcttgatggcctcttgcgccaatcctatacgtgacctgtattgtaaaggccctaacaatgcagatacatggtgtttggcctcgcagtgaacacgtaagaaaaacgcgtacacgtctatgtgagtcgaattcccagttggttgtccggcccttcacagggatgacctgcacctcgcctgcgtccaagatcagatgtccacgcgacacgactccacgcccgtattagatgcgtgatctcatcatatgcctttttaactctatgctcatctgaagctatagacattcgcttgccgctatgcgctgtaggaggtgtagccataattatttgctctttgcatatttgacacataaatacacgcatctaagtagcttgcaatgccctaacaagatctcggtcattcgattcaaccagttggtggttatgaaaaatcaagacgccgtcatagtgtgctactttactttttctaaagtgggataaaattaacaatccttttatctttggtggcaaattaataaatataaagctaaggaaattgcttaaaaaaactatcacaaagttttttttataaaaactttcaaatgtaactatatcaaagtaatagtgaaagtaatagtgtaacttagtaactacattgtaattacgcattgttacattttaacgacactgatagtataattacaatgtaacaatattagtaaactatataacttacgtataaaattgtattatgttttaatcctatatatctataaagttcattcccactaaatgtagttaatgctaattctctcttctctcatgaagccacatcatctcaattgtttttagcctttggatgattcatcaagggtgtaaattccttcttttcacattacctcaatttattttagtatttggatgattcatcaagggtgcaaattgcatctctttcccccaaaaggcacaccatacaacccaatcatttataacttttggataattgataaaggtacaaaaatatataaaaacatgaaaaaaattataaagtaggtaggaaagaaaattttagaactcatatctattgtattatcacacaattctcccgcagcaatgcgcggggtatgcatcttgtatatagtatatattttagttgcgctatggttatgatataattatagtactccccccgtttaatattataagtctttggactttttttagttatttttttacatttgactaaatttatagaaaaaattactaacatttacgatatcaaattagtttcataaaatttaatattaaatatattttgatgcaatgtttattttgtattgaaaatgtttactatattttgttacaagtttgatcaaactttaagcagggcatgtaacctaatggttgcagtgagtagtaccctatggtcctgagtttaaacttttatagcagtgaattttagattgggttgtttgcgaggctaaatttcctatttcaatagccgtatatatccagttagatgtagagacagggtaaaaaaaacccatctctaaaagaaaagaagtttgactaagataaaagtcaaacctcgacaattctagcggcgctgagtgatagcacgcatacagacgcgcatagcaatagcaagctcattttgcgagcccggcatctaccccgtcggatctcatgtgcgttcatcttggcctgcttttcctcttcctccccgtcacaagcggagcgagatttccaccatggctccgcgcgccaccaaatcgcctatcctctagcctcgttattcttctcttccgttttcccgcatcgtgaaaactctgctgtgtgccaaatcactggccccccgctccagattcatccggtgaggcgttatttctgatcgatatgacaactctcaccgagggtaggtgaagccggtagtcaaggaggaatctgtttcgatctggactcattctctgccttttttgctcgtcttctccggtgcttgattcgttgggtttggggtttgattccagcaattcctctctgctgatgcatatgctttctggacggagtccctcttccaattggtttatgattaattgttatttgttgttttggcaatactatgttaagattcttaagtcgattcttattgtcagatcattaagcatagcgtggatattttgggcatgatcagggctaagatagagtgaagcttttatgatttttgtgatgttcgagcatccggacagcatgtacatctacggacagtgctcgttggtgaaaaattcagacgacgagaggacaaagactttttatacgtagtactatatggacaaactactcatattcatatcacaccataaaatagccacaagaatagaacacacttttgattaatatgcgtatggaggaattgattatttggttaataagatacaatcaacacaggagcctatctattatgctaattggctttagtattagctgtaaaataaaatagagtttgttatagctggctgactatactattaattaaccatgctctaacgcggcgtgctcgccccgcgaccgctatctcccactaaaatttagcgactgagtcgcatgcaggcctgcaaatttctagcggctttgccacaggcaaatcattacctcttgtactaagagttaattatgttaattacagtacaagaggtagtgactaggttaaaaaaaatcttatatcactactggagaaaccatctttacacggtcggctaaaaaccacaatagtctcggttacaataaaaaccaggactaaagatggtttttagtcccggtttataagcagaacaggactatgtgatatttagtcctggttcacatgctgtcagggttctccgggatctttagtcccaggtctcggtttgtattatcaaccgagactaaagatcaaaacgcactatataatccctaggacttatcatcttctctcgtccacacacaaactcctctctcttttcctctctaatccttatctctttccttagagcatcttcaacagtctctccatcccactctccaagccaaattttagccattttagccaaaaaaaaaaaagctccaatagcctctagccatccggcatccggctggccaaaacccccctccactagccaaatttggccaactagaaatcactggccaaccatgggccccacatagattcctccccccatctccttcggctcttctccacgatggcgcaggcggccacgtccttgacgccgccgccgacgcaagcgccgtgcaccgccgcgagcaccggcttccatgcgccgcctgcatctccacgatggtgtggtggagccccttggccacgggcgctgggccgctgccgcccagtgaggagggagccatggcggggttcttggggatccaagctcgatgcggcgcagaagtgcaggccggcggcggagagcacgacggtgcgcatcacggcgagcgtcttgaacccacgctggagcgccaccattgtcgacgaggtcgccagccgctgtcgccgtcatctgcaccgtcgccagtcgtcgccatccactgtcgtcgtccccgaggttgccgttgccgttgtcgacggggtggcttgacggcgcatgagtccttcggcgtcggccatcagcggcatgacaagggcgacggggcggctcgatggcgagggaggaacgagaaaggctggcgaggagcggatcccgtcgttgcctcatgcacccgtcgtcgtcgtcgtcgtctggcggcctggcgctggccatcgtcgcgtgaaaacggtgtcgtcgtcgccggctccccatccacgcgccccctcgcctcacgccgccgcctcctcatccgctaggtgggttggagatgggagggaatgcggtggcggcgttgctcgacggcgaggttgagggagacgaggcggccggtgagatgggagacgaggcggccggtgagagctcggccaaaggggcaccggcggacggagcccgagcgtcggcggtgagcgaatggggagagtgagatttagagggactgttggagatgctcttactcttagcttatctctttcctcccttcacttcacaggaagagcgagcgtaggaggagggcgggccgggcgggcggcgaccggggaggaggggaggcggcagcggctgagcctgccgtgggcacgagaggagggcgagctggcggatgggagggcggcggcggccggcggccggtagcgccctctcctgcagggacttttgtcctttcttttcttttttttgaagaatttgtgattcattgtatggattgagatgaaggatttgtgattcattgtatggattgagatgtataatttcgtttttgagaatttgtgattcattgcatagatctgagatgtataatctgtgatgtatttgatttgtgatcattgcatagatctgagatgtataatttgtgatgtatttgatttgtggtcattgcatacatatgagatgtataatctatgatatatttgatttgtggtatttgtgatgttactttgatttggggatatgtatcccacttgatttgggagaaaatagttagggattaagtagtaagtagcaacagaaacaatgaaaaaaaaagaaaagg

SEQ ID NO: 40685 - DNA, 729 bp, Oryza sativa
attaaacccgatcagtagatccaaacaaggaaacactggatctgcccatcagtgacaccaattgaacaatgccccaaaaaaaaggaaaaaattatatgcattccattgcacgcaaaaatcgattatttccatcttccctagcaagcaaatctccccttgtctgaacaaacatggaaacaaccaacccacaccaatcaagcgcgtgcattaaaacacccccgaccacacgcggaaaccccgcacgctagctcgaatcaaaacccggatctgtgtcccccgagctgaacgcaaactaaactaaattaaccatcgtccccatgaaaacgaatcactataaaccatcaaccaaacgaacgaacgagccaaacaaaactgagctatagatccacaccaaactagcaccgacacagaagaagagcaagcgcgacggcaatggaggaggggatcttacctcgcctgggattgccgggctccgggtggatctcgcggagctgcgaggaggaggaggcgtcgctctgggcttgggggaagctggctgcctcgccgcgttataaaggcggcatacagctagcgcggggaggggaggggagcaccgagagtagcagtgttgggggctagtggagtgagtggagtgtgccgtgtttgtgcgtgtgagcgagccggtcgagaagaggaaataatcagacaaccgtacgttcggattaaactaaatacaaactgatcagcggc

SEQ ID NO: 40686 - DNA, 755 bp, Oryza sativa
cattgatacattctttgattccttttatattatatactccttgatagcatattgatagtaattcattgggagtacataggaattgattggattgggttctttagggttgatcactactttgttaggattgcattatctactgtatgtattctttggttgattgatactcgctacatgcagcgcctataccacccatgcgctatacacaccgtaaggacgactctatgccgagacatatttcagtccgtcacactctgcagatcatctcggtcaaaataaagggaataagagggggcttacagtggccgatcaatgtgtttggtctcattgctgcgcgcgacacgattgaccgcaaccgcattatgatcttcaaccgcaccagggataactgccaaacaattactaaagaggtgcactttatttcctattgtacatcgttttatatttcttccttttgcataattaaatcatgatttgtgcgtggacacacattgtgctactagtagtttttactatttatatatagagatatttgttgcactttattccttggtttcttcatatcaaattagcccacctcaaatggacttttagaagactacttatacatggtgatacagtttgcttgcttctagtaatgcattgccatggctaagtataggatttccacatttgttacttatatcagaatcataaagacagctcaatttacatagaaaaccattcctaccataactaaacatactaatccgtat

SEQ ID NO: 40687 - DNA, 28163 bp, Oryza sativa
tataggccatttatgtgtgcacccatggtgcatagacaaaatgcacaggtcaggcatgcttccagtttaggttagcattctattcttctatattcagtactccagttgctactgttttgaaattttggattgagaatattataggactattcgcaaggcattgtagatcgaatatctgaaataagcatgctttaatgtgtctatagaatatgcacacctcaacagatatcctgtattttctgtcactaatgtgccaagcgaatggttctttttgttttttttatgttgtgcatgccgtatcatttattatatgcactttgcatttgtatatggttttgtaatgtttttgtgctgccaaatttagcttttctttgtcatcagatttcttattgtttgtacatattggttcactcaatttcaaggtttctgaaatatttcaatttgcgtgctgaaccaactcaatttattcgctagtggcagtgccccctataagttcttttttcttttttgctgtggcaccagactcccatttcatgcttattttcatcaagttgcacttgatgaatggagaaaacatcaatggataaactttctttttatatacatgtaatcatgtcttactacgagctggtgaagtaatattatttacttaatttgcgcattgcatgcaggatcgatatttattactgacaggtcctacgcgtgctgttgtggtatctgaccctgtgtattttgaggccccgctgaaagtgaagggctctgtcgaatctgaggataaagatttaagctttttagctgtcccgctcaccggtgcttctgatagaggtgaaacgcgcttggttaatagagagtacactagcaggcttagcacgctggagttgacatttggctttgttgttgagtccttggaggcctcaatcagtgtgcgtatcattgatgggtcatggaaagatggttttcgtggtgcattcactgcccatacccccagtctaaaagacaataaagtcctgctgcttgattctggatattgtgagatggtgcctgttactgctgatcgcatgatcaagctttcacgccatgttgtttccgtggaaggtgagggagacctgaccgtttcagtgctggcacttggaactgataatgtgatagaagatgagaaggatttcacgcctaaggaagccggtatgagccagagctctcttgacgtgggcttttgtaaattggaagtaactgtcaactggtcacttctttccttgcttcctgatggctatacttaattaagtacattgcacagtggtatgtgaattgtgatgttcctttggatctgttgcttctgaacttctgaaatggggtgttggtttttttttcttttgtttactagctagaatagcgaactcttgatggacgcggtatcctgtgtatagaatgttggcagtattgccaccgctacggataaagttcgatttcctatcttgatgagattttgtattttatgatgccccattttcttggacagaatttgtggtggatgaacggcgccccactttgtgcacgcggagcaatgtggacatataatggaataaaaggggtgatgctaatgagaaaatttctagtttagatgccacttaccgaatcagcttgtcgaccacatctttattattatctttacacaacacaaacatattatcactaggaatttggtgttgtccgtgttactaataatatagtgtactgtaatatactgcagtctaggacaagttggtttcttgataagcatctaggacaagttcaggtgagcttctcgaccagctctgtcactaggaatgcttggctgcttgcaatgaaacttctatgcatgtacccagatatgtgttgaggaagttgattgttgattactttggttacagaacttgatcaggcttgtcgttaagccaaactgtaattcacttgtgggttgtggctatgaagtctcattttgagctgaatgttggtacatcactgacatggcatgccttacctacctatggaaaaccaagataatcaggttggttttcctatttccagacatttaatactagattgcagcagtagcatataaattatgttaggatgcaatttatttgtgacccattgattgtacgcttctatgcagactcaggtactatattatactatctgcttgtttgagctgtggccgtatttatgggcattactaaggcatgacaagatcaattgttctatttaaattttgtgttcatgtttataatagtggtgcacattttcttctctgtatgctcaacattttataactagattgctaactgttcttctctgtgttgaagaaaaaagtaggcatactacgttggatgaatagtatgtaggatcgctcatgtatatgcatgtgtagatgtatttcctgtagttgtaggtcttctgactcagcttgaaaaaatcagttctgacagaattgagtttctgtagttcctttttttttttttggaatacgcaagatgcgcatatttgtattaagagaaataaagattatttacagagttttaaaaatgaaaataaagaaggggacagggtaccggatggacaacaaaatctaaggcctaatctcctatcaaattttgtgaccgccactccgtggtcggtagaggtaactccggcatggccgctttcgctaagcgccaaagctcggcctcggccgccatcacctttgccacttcgacccaggtcttttgctgttggttgaagaccctgttgttccgctccttccaaatagtccaagctatcaaagctgcaacggtgtcgaatcctcgtcgttgagctttggcaaccttcattctcttgtcacaaagccataagaggaaggagggttcgttgaatggcagtatgtccgacaagccaattgctcggagtgcgaaccaccacagttgacgtgactccaggcatgcgaccaggagatgatcaatcgtctcgtcaccttgatcacacaggacgcaccgatcaggatgtggtaaaccccgtctccgcaaacgatcggctgtccaacatctgtttagtgccactaaccacaggaaatagcggcatcggggtggtgctaacgaccctcagataggcttgtcctggaattggaccttccccacaaacatggactgataagctgagcgagctgggtattctcctgacgactcccatctccagatgattgaatccggctcttccgatagggcatccaaggattgcaaagatgtccacaagctgaggtactctaggatagcttggattcccaaagccccagatatatcccggatccatgttctaccttggagtgcttcgcgaaccgtcctacgattccgctttcttgctacgaccgctgcatgcacagccggcgcaagggtgcggattgacgacccttggatccagttgtcttcccagaagagcacgttcattccattgccgactcgacatgtcaaagagacttggagcaggttcctctccttttgcgagattggaacgttgagtccatgccatggcttttccggcgatgtcctcagttgccaagcccagcggcaccggagtgcaagtcccatgcattcaagatcagggacacccaatccaccatacgatttgggtgcacaaacccgtgcccaagcgacccggcagcttccaccactagcgcttgctttcccggacgggaggaagccgcgacggaccttatcgattccctttatcacccactttggcacattgatggccatcagcagatagatcggtattgagattaataccgcatttaccatagtgactcgaccaatgggcgccatctgctctgccttccataccggcaaccgacgggctatttctgtagttccattgtatgactgtaccatatctacttgtatctcattgaacattgagggaaaaattaaagtacaaacaaaacaaggaggaaatttttcatggttcctaaggcagcaatgtcaagctggtcctctctgcacattccttcttgagaattgagataattgtttttatggtacatgtatcacaatcttaatctccatgtctgcatgttgtccccttttggcttctgcatacttatctctgaagaaacaggcatgaaacttgtctgttgcggagtattcagaccttatggatgggaaggaatcccagaaaaggatggtgtcatcacttaaggttttcaactactcctatactgatgccatacgatcttttatttgtattctagctgcatttatatttttttggtgatattgataaggccattgtctgaaagacctttggtgatatcctggcatcatatctacagtacaatgctgggttttagcagcctcagccctcagtatgatgtgcagagtgcagtgcaggttaactgcaagcgatgtctttttagcactatgcaatggagaggatatgaagctcctccatcttatgtactagtactttgtttctgtaatgaataatccctttcgttctcaactgctaatgctacaaaatgattagactactgtccatttcacaccctgcttcaccaactaagggcacattgcacaaacacaaaattctgttcttgacatgtgattaaggtgttcttcagattgatatcatttcaaaccataattttttttttggtaaagtttcaaatatgtgtatatatttggtttcttaccaactttggtaaaaaaatacataaggaatttggcaactacgtagtagtggctatcctgccaaaacctggcaatattgccaacttacaaaaatttatttattttggctacaatctcaacagccctaatttatatgcaaataaattgttcctgccttataaatctctgcggttatcttttttcctcctgtcatgttttggagttcacactttacaggagcagttatcagttttcctctatctctttctgaaccttttattctctttccagatattggcaactgcaaattctacaattgtctattcatatatccaaagcatgttctctgaacagttacttgggagagcatgcagatgatatcaagtgtaagcttttcaacaagaatttgttctgatcctcacatgtctaacacaatgatgcctctcaccgaatgcattcagcataacatttccttttcccatttcattttcttcagacatctctgaagtctgcacctgtactgggataatggtggggagaggagtacgtggagaaactgatttcaggtacgcaaaaatataataagaaatttgggcccccgtcttgactgattgaaaggaaaagcccaacaacctatccccatccatgcctcacacgacaatgttcttttttttttctcggcagactattaggtagtgataattttttttttttgagaactaggtagtgataatctctccctggaaatcataaccgtactcaccgtgaatcatatggtggtgaaatattcaccactattttcgtttagaagtcatatctttaccacattaccattttgactgcacgttttacggtgatctccatggaaactatacagtttctcatgaaatgaaattcctacattttgaataagctctaaggcatcatttgaatggtggagttttaaaaagacttggagaaactgaacaaaattctacaaaaatcatgtaaaatttatgtattccaaagaatctctaagaaggcgtggacgctacatttttctccaaagaaaagtgcatcaacaatcctagatagctactcttcatgttccatattataggtcatattagatttgttttaagtcaaacttctctaattttgatcgaatttatagaaaaatgcaccaacatgtacaatgacaaataaatgtattattatcgatggatttaatgaaactaatttaatattatagatgttaatgactttttttaataaactcagttaaagctaaaaaaagtttaacttaggacaatactaaaatgacttgcaacatggaacataagggaatagtgtcacgcccagaagtttcccccttttttcttgctttaaatatttgttaaataaatcgtccgaagaaattatcttaattaacctagagctaaatccctagttaataaatgcaattaataatcagaaatagcgtggtggaattttttttcttgagtcccccatgctccaatgcattaacaagatttttagtggaattttcagagccttggaaataattttaaccaattaaaaatcaccaaagtgcaatatttaatcccaggaaaatccttcttctctttttcttttcttttccttcctttttctctagatgggccgtcggcccatctctctccccgcgctcggcacccctttcctgggccggcccgctcctcatttcccctccccgaagtcctccctccctccctttctctttcgggcgccgacaggtggggcccacctgtcggtcgtcccctacctccggtcattggagccggagctccaaccgcccgcgccgccgccttctccgctccacgtcgcgcctccactccgcgctcgcacctcgcgcccacgtcgccgccctctcccccgcatctcccgcgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctctcatttcccccattcaccgtcctctcccacgccctctaccgccgtagcgccgcgctcgccgagctccgccgccgccgcccatctccggccgcatgccgtcgccactagggccgccgccgcgccaagctgccgccgccgctagctccgccgccgtgtgggccatctcggccaccgcctcgcgtcgccggaaccccaccggaaccccatctccctcgcgagccggggagctatccattcccctccgtctccggccagccctttggtcgtcgcggtcgccttctccatccctaactcctctcctcccctcctctgggtgtcgccgccgctcgtccgcccctcctctcgtcgggtcgtcgacgccgccttcgtcttccgctctggccgccgtgtcgccggtgagtcctccctccccctcctttcctcaccttaccgcgagcgccggccacgccgctgctccggccatgcgccgccgcctttcggccgtcgccgccgcttcccacaccgccggtcaccgccgtcggtggccgtgcctcgccgccgcctcgccttggtcggccggtcggccttgaggccgagccgagcccggccggcgcctccctcgcctcccctttgagccaccgcctggtggggcccacctgccaggcgccacctccctcccttggagccgctgacccgtggggcccacgtgccggtgcccccctttcgctgacgtcagccctgggtattattgcgcaataattaattaaggactttttctttattagtaaaaacacagtttatcttctaaaattcataagtaattcatccgagctccgtttaagtccatccaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcagggcaagtcatgcaatacgtttgatcatattgtacccaatttacaaatatcccacatttctattaaatgttgcattcttttacaatatcatgtgggatgggtcctactactcagccatatattgatttccttatgccattgataacttgggtattaaaatgactagatgttggtttaggaaatgcttagccatgcttagttcaactagtacacaaatgggggtcacattattacatagactctgactattggcatagctttagattggtgccaccgcaagggtgtcagttaattaaaatattctgaatggcgggctgtgagtgcatggttttgcttgtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggtgcaagaggggaccgcccactgccttttgaggggtgggggtgaaaccttagcgtggtgtggatggttaggggaggtttatgtggagggtcttgtcacaatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgttttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttcttagttggagccgtctcagagaggttggtttcgtcgctgccgtcaaggtttgcctgtggagtggagtcgcccgctgctgaagtcaagcttcccggtttagctcgctttaatctttcccgctgcatttgtaatcttttatatttttgtaagatgtgggtctgtatgtcaacaattgtcgtttgtgtaccctggctggtcctggacagggatttaatgcacattcagcttagaaattctggttcgagaatttctgggtgtgacaaatagataccttgatgacctgatcaaagctagccagtggcaagtagaatcccagttttgagtgattggattgccaatcatggacggccggtgagtgagaagaggatggtgccttgcccttgtcatgctctgatcatgcagttggcctctggaccaatggagaaaatgcattgccatggaaaggagatgagaagggtgtggtacactagtagtagttcagaggacggccggcattgatgccatggaggagccctcaatgatcaggcactcgtgtgcgaagaagaaaggggaggcttagatgcaatggctcacacacggttcgtcccatctaaacccttttcgctctttttttctctcaggggttgggacattgcatgatttgattcacatctatttctatcagttggtcccaattgatagtactgtcaagatcattgtttaagccttgctgattagttaggtaatgaatagtagtagttgcactggtactgtttttaattagcttccctccccccacactgatcaagaagcacattttcagagtccctttgaccatggtgagtggattcagaagcatcttgtgctctgaagcatgttcaggttgttattattcctctgagacatgcctggaataatgattagattagtgctaatccctctgctaaagaaagattccttctcaaatcaattacttacaattcgttgcatgatgagaggagaagatgcattgcttgcaaaagatccatgtgagcgtcatgtgggggctccatggatgtttctctgaactctcacggcgttctgctcatccatcccctcactgtgctgtggctgccaggtgggccccgctccgacacggcgatctgtggttgaccccggtgagaggattcgtcagtgatgctcgaatccatcacacgtcagatatgaaccgtacatccatccatcgatcgacccgagctgacgatgcagttgcagacgaatcgttcagaatacgcacatcacatgggaagcaacccatcttttttttttttgcttttttcttttcttttttctctcgttggtgagtgagaactgagaagaggaagttggctacgtacaggaggagccgttgtacctgaacaataaagatgaagatgagatgtggcctccaaataatttacgtgaatgtcggcagaacatcccctgactgtcaatactcaataggtcaaagaaattcaccctagtcgacactcaggagctaaaacgaaatagaaggatatgccactcgtttgttttattgatcaagtttaaacttgttttactgattgagtttagattaatatatgtatttaaatttgaattgaatgatatatagtatatatatggtaaatatagacgaatcattaaaaaaatttctgaatcgggttttttagcatgcacccgtaacacatatagttgtgtccctaccgatattgtcgatgacgtattgagagagaaaaaaaatggacacagccggcaagaggtaatgggtagcaccgcccgcggccgacacagcagggccgaggaggattccgccgccgccacctctgcggcggaggccggcaggtgccacgtgacgtgctcgccgtcggcagcatgccgcactgtgcgtgctacccagagatgcatatgcttccaacacatcggcgagatatatatagatcgatctgaacccgcaaaaaatatagatcgatctgaaactcctgcaagaagaagacgatagtaatgcacagagcgtatgtgtgtgcgtaggacagtatacgagtaggtagaagacgacgagggcggataacatgggcgacacatgcgtgtctagctagctccattccgtgccgtcgctaccgatgcctagctggacagatccatgcgtactcctatgtgatatcgatctgcgttgtcattttcagctccacgtggctttgtcaacgtgccaaatcgatccagatccaaaactcaaaagaacaacaaaaaaaacttctttttacctacaccctctattctataagtaaataagttcattcttcacttatcccacacatactgatacaaaatcaataaaaacataacacccttgttttcttaaatcccaataaaattttttctctctttatcttttgcttatttattcatttactattttcataaactcctatacaataattacttacaaataaacttattttgagataattgtaaaaaaataaaaccacggatctcttatcactacacgatgatcaaatgatcaattgcatatcagataaatggaagaagccaagattgaacataatctaggatggagtgattacctacccaacaagaagcttttctttttctcgtcgccggccgggcgtcacgagcggccagctcgtctcgtggcgtgcatggatgcatgcatgctgctcacgcgtgaccgatcggtccgatcgaatcgccattggcgtttgcacgagaaagcaactcgctatcacttgcatgtgtatgtgctggccttgtgccacgagaagtagctaggctgcctgcgcccttgcttgtcacatgaagctacaccacaccatatgataccaccatacagattaaattgccctaaagaatatattaagcttgaagctgaagaagctagctaaccgaatgcaaaccatgtactccctccatcccataatataagggattttaagtttttacttgtattgtttgaacactcgtcttattcaacaaattttagaattatttatttttttttgacttactttattatccaaagtattttaaacgcaatttttcgttttttatatttacacaattttttttaaataagacgagtggttaaatagtgcaagtaaaaactcaaaatcccttatattatgagatgaatggagtattaattaattaattagacccttaattaatctgacatttctagcgaaagatagattacccacaagaaactaaaggatactgtctcatcatggaccccatcgatccatcccaggctagtgaatttagagggggtgattatatacagctctgcctaattgcgtgattaaccctaggattaggaggaagaagatggtgaaggttccatgtcggccttaattaattaaagagaaggaaaatgacaagacaggtgctgggctggacaagtgaagtgtattgcccccaaagagtacaggacggagaatagacaagatagaagcagcaggggtgagagaaaatcctgatggattaaggcagctaactaacgatggagcctctctaaaattttgtgtttggcatcatctccattccagatattcaataactgaaagctatttgtagttttgcatatattgccccccttcagtcttatcatctagacctctgacccaacagtttgttagaaaaattaaggcaaagaaactagtaacatggtcgtgtgcattacaatttgcaaaaaacctaatacaattcaggatatgagttgcattagcatatatgattagcgaaggcttggagtgtgaatcaaacacgaagcactggctccaacatatcatttttaactgatcgcttaattttcttggctagactagagctgcgcacttaccaatgtgggtatgaccgtatgagcctacggacaactccgctttaaaagtaggttacaacaattattaagtaaaattcatgtcaaatttgatatccatgttcaatagcaatagaaatactaactctgtctcaaaataaattcatatttcactaagctcatgcataccaatacaaaaccgcgtccgtgaaaagaaaatataatacccctatattatcaaatctcaatacaatcattatttactttattttctcccaatacaatttatttcatattttcacaaactctaatacagtagttacctaaaaatgaatttattttgggataaataaaagttgtaggacgcatccaacacattttttatattttcaaaaagtaactgtcagtaggtggggcccacaagcagagacacgcacgccaagcattagtattagcagtatgcttcactctccctataatcactaatcacccacccccaccaccaccaccggccgcgtagttacgcaacgaatcaatcacccccgcggtgattaccactgcaaacaccaccaccgccgccgtgggaaccggcattagaagcgaggagacgactaatcaagccaccaaaaaaaaatttaagacccctccctcctccttgccgcactcaccaccaacctgtaatgtgaacctgctgctctgcgagttatcggtgttcatccagcagcgagagcggtggcagtggtactaggagtctaggacgagtggtgggtactggttgtactggtggtacggcggtttcagcggcggagttctcgcgggattgtctcgttcgtctgatccggcgctggaggacggcggttggtttctttttcttctgctgcttcgcgagcgggtgtgagagatcggttccatgcgggggtcgctgctgctggcctcgggccgtcaggtgatggagaattccggctcccctgttcttcgctttgttcgtgtgtggtttttggttcttgggggagtttgcatggagaggagagggtgaggttcttgggggattcttggtatttgctgtgatggaaggcgtgttcttggatgcttggggtgtcggtttgtttgtgagttggtgccggattctgcaatgccgcggggttttgttagatttgatgattcggtgctcgatgagcgtttcttggttcgtctggtgatttcttttcttttttctttttcagtttttgtttgtttgtttgagttttgagcggttttgtgggacggatgattcgaagggatgttgaaaagttcatcggaaagtgattgcgccgtaaatgttcgattgggcttttctttgacagaaaaattcggttctcttttcggctcagcgcatcattgccgctcttgagaaagtgcctccttttcccctcggtttcctgaactttctgcgatgtaactgctcgtctgcctctcgctctctcccgctttttcatgcttttctttggtaaattcagttagattttcgtgagaaattttatttgggatcgtcggtttttctgacgcttatctgacagttactaccttttctcctctttccatttctgatgtttttttttcttaattttctctctctgtcttcatttatcttgcttagtgtcattggtactgtgatgcttgcctgaacacgtcctgaattcagccagtgcacaattcgctgaaggccatgccaagcaaaacttgttcttgagaaagatccttgtttttacttgtccgatgaaactccctctctttttctatctaccaaatggtagtacttctgaagatgcaattatgggcttagaacagtggattcaggactgctaattttgtggggacttttgttacactttcatgctttcactggttcttgtattatttcagacttccatgttctctttttggttttgatttgcacttgcgtttagttttcttgttttctctgtcatgttatcatttggaccgcaactggtccgggtggttggcatgtgaacgaataataacgccacaatctaggtggttggcatgtgtttctggctgcatgtggtttcgggttgagtgattcaattgcagatcgggaggttggaatttcgtgtgtgttggaaccttgacccaaaaggaaagaatggagtgttgaaaatgctgtcatagtgtcatggccttggtgattcaagtaaaattgactatacaaatttttacagagaggatgtggatgctggagtttttattaggaaacttaaaactactccactgttgtagaatttttggccctttaggtagtactgaatcacttctagtcggttgtaatttagttttgtgggctgttaagttccaatgcaaatgtaggttcgaggtctttagtgtggtatagtagaaatgtttgctccgagttataacatgcttttcatctcaagtttccagtttttttttctgtgtggtaaacgtccacctaactgtgtgtctgtatcatttcaaacttccctttcagttgttagtatgtcagatcaaatttcaagtgttgattataatgtatttgactttgcagggtttgcaagcggaatctactcaactatgacggattagcctcaaaataaatgatggcagctgaggttaatcaaacttttttcgcgtggtcacaaggagaaccaactgaacgggacggttctcaagtaagttttctaaggtattctggctagtagtagtagacgacttcattttaaataaattgtacaatgtgagatcaatttcaaatggtaatgttacactctgaagttaaagcaattgtagttcttcgcaaaaaaaaaacacaaaaattgtagttctgttcctgtgaagccagcagctaatagtctcatttcctttctatttcattgtttactatcctcagggtgtatctgtgtcccagaaaattgatcatggttccatctcctttggaagattcgaattggagtctctatcatgggaaaagtggtcagtattttctgatgacaagcgtcatgaagaatttggcaaattcaatggtttagttgcacagaagaaggcatattttgaagagtattacaggaaaattagagaactgaaggcacagcagcaaaaccagcaaactgaacttattttggaatacagtggtgatggcagtgattcgagtcagacaggagaatatacacaaggtgcagagcttgaaactcctactggatctggaactatcgttgatgattatgtggagcaaggtgcacatgaaactacctctgagcaaggattgacatgttatgatgaccatgaaaacgagaacttcaatgcagaattctcctcatccaatatttcttcttcagctgtaggtttacagcaaactggccgggatgctagagaaaatgtacacggtgatgattcggctggtaaaatggatttagagcagcagaatgccatttctggtcatagtcttggaacagcatatgaagttgtaagggctcctaaaagaattatcgagaaagactccaggcttagatatgctccaaagatagtaccaaagtctgtcaaaacctcctccgatagtcctctggatcgcacatctgttagtaaggtaatgaataatagtgtagtactcactgaagctgcggcctttgtcttgtcaaaaatctgcttctatcagctattacgctaccactatctgtctgatattatagactagcaagactagtgcattagtcctaccttatcgtaaatactttctagctaacatatgttttgtgtttatacactcgagggcatgaatctttcagtaaagtcttaagagctttttcattaatcgttgcagaggcctgattctctgaagcttggcatgagtattaaccagaaggctaagactgacaatgatcgtttattgagaggaccaaatgtagcgcctcataagatgtctggatcaaccgaaaggaacaagcttacaacaaaacaaacaggtgtcagaagaccttcctctgcatcctcacaacggccctctgtgggagagcggcaccggatagccagggagagcataaaaaagcctgctgatgtttccaccccacggcgtccttccactgcagaaaggcaccctgtcaccacagagcgtgcaaggaagcaagccgatgtagatacaccacgccgaccatctacttctgaaagacgtgctgtcaacaaagggagtgctgacatgaccactacacatcgcccctctactggagaaagacgatctgttaccagggagagtgttctgaagatggacgtaagaacacctagcaagacaaggcctactatgacgcaactgaagggtgcaacaaccacagtggtatgttctagcacttaactgtaaccgaagttccatctattcatttatgtcgattgacacttttaagtccatgttttcagttaaatctgaaaaacatgatggcatcagatttcttagagttttcatcttcatgcagggtattgttaaaaaggcaggcactccaaatgcttctaaaagcatcaacatgggaacaaaaaggttactcttatgaacatattgaatagacacttggaagagttagatttgtgttcaagattttaattgcattgttttatacctgatttaatgaacagcaatatcagagaactggaaggaccttcgaaagtgggcagacactctgttgggtcaaaaattacggacctgcaaattgctggcaaacagaaatcaaggtgctactataaattagtgttggaatgtggcatgaatcttttacaatatgatttgtaaaacatattttcttgacaaaacttatatcattttgtagctctgtccaccttcctccacggaaactattgagttccagtattggagaaccagcactgcaaacctttacaaggccaaaaaagaaagatgtaagttgctcaaaacttgtatgtgattcttgttattttatgcatgtggccatgagttgtgtgataaagtgccagtgcaatcgtttttgtaacctttgtcatataaacggtgttttaaaattttgctgtcttctttacttttgtggttctagaaccccatgttacctgctgatagattccagtaattcaattgtaaaatcactttcaatcgccacagccacttaactctgattattacgctgcactgacaagtttgtcagttgtgcctggctgtcagctgaacagagattttgctttctctagtgctttaggttctaagaatttggtttcaatgttatgttttgtactgcaatgttgcaccaaaccattatactggacagaaatatagctgaaacaagataaacaaggtactgtcagtaacagttaaattgagtgctaacaatgacaacaaacctttgtttgggtattcaggttgcagcgcaatctcgagcatctacatcgaagagagcaatgactttgcacactggaaacgtaaaggggaggagttcaaatgtaagactttcacagcactacatcatattgggattcctcacctgaatcctaagatgtctttctcttttctttcttttcctgttgcgcttgatgtagctttattcataccatcagattagattttgaccttttgtccactcatttatgcagccacccccaccaccacctccaccgcgtcggccttcacggacgacgaacagaccaaatggcagtaactcatcaactgttggacaaaagccaaagtatgatactcatgatgaacattcaaaagtaatcttatgatgcttcactgcaaactactgaattacacccatccaatgcagggtttcatcagcaccaaaatggcattgatgcaaagggagactttcattcaacctactctcccgcacaaatgatggatctgcgacaagtcgcaccgctacacgaatcttaaagcatcggcattgctgtccacttcccctgaatgatgtttgatgtttctgtatatcagttcctctactctctagtgcctccccccttcccttcagagcaagtccaatatagtgtatgtagttacctgtatcatatcatcaactgcctagctttgtcgcccaaggaacttagaacagtgctgtacatacctcaaataaaatgtttcgtcagctaaagtaaggctaccctgaacatgtgaaaaatctgtggtctctgaacattgtctgcacatcatcagtagtaatggaaatcgttcattcttttcacttgttcttgtcaataatggtttgactgattcattatttggcatgggcagttccatcgtattgcctttaactgatcatgagccttaacgcatactccctccattaaaaaaaaataatctaggaggagatgtgatctctctataacaaatattgtactaggagaggtcatatctccttctaggttttttttaaaggacagaggaagtactagcggctaaaaaaactgtggataaaattttaatatgcatgttttttatcatcttaaaaagccaaaacattgaaaagcaaactacgatttcaaatttagttataaaaacaaaaacaaaaacccactctaaattaagttctaaaatttaacatttcaaattaagatttaaaacctttttgcgggcgggggtgatgctagcagctagctcctcgccgccgcgacaccgggatcttcctcgtcccaatcgacgaagtaaagcgaaagaaagagacacaaagagtggcaggcggcctcgctcgcgcatgattaaccttagctacgtccgtccttaccttccttcatccacaaggcagtgctgcgaaatcaaaaggagagattcagaatctcatattacttactgcattgcatgcatgtcccgcgctctttgggtgcaaatgcaattcaatccaatgcgtgttgggtaattaattagggtctcggatcgtagagaagatttctaccgtccagtgatttttccagctagcttcacaaggtggtgggctagatgatttaggttcgaaggctcccccttctaattatttaatattaggtttttccctagagggctgctatataacggaatcccatttttgaacgggatgataccggttaggtgtcaagtccggtatcagatgatacatatcaggtatcagacgattctaccacgtttttatgatacttgcgaggtatcagatgatacctatcaggtatcatgcgattcttaccacatagaaaggcgatacttgcgaggtatcaggtcctgatacctaaccggtatcagatgatacttatcaggtatcatgtgattctaccacgtatcaggtgatacttgtaaggtatcaggtcctaatacctaaccggtatcagatgatacttatcaggtatcatgtgattctaccacgtatcaggtgataattgtaaggtatcagatgatacctatcaagtatcatgcgatttttgtcacgcagaaggtgatatttgtgaggtatcaggtgatacctaccagatatcatgtgatttctactgggtaccaaagcctcgaggtggtctacggctgttgccaagaacggattcgtctttcctgttattaccgaatggtacttggacctgacctgacctatgtgcatttgctccaatggtgatttgcagcacaaacaacgagctgttggagctgctatggcacaacggcggcattgtggtgcagccgcaggcggcacccgagggtcgtctcctcctccggccgtggccagagcatcagcgtgctcaccaccggcgacgagacagagaccgccgcgtggttctcgaacacccttgacgatgcgctagagaaggacctctacacgcagctttggcacagcgtcaccagcgatgcgttcccggcggcggcggggccaagctctcaccaccctccgacgccggacttgccaccctctgacgaggccaccgatgaggagcggcatcgggtcgagctagaccggcaacatctattcgaccttctgcggcagtaaccacctctcggagatgcctttactttttggataagcatggggacgaagggcgacgggatcccattatttagcatttctgttttccctaatattcccgttttttttaaagaagatttctgctgaaaatgcaagtagatcattgcctgtacaaactttcattgattattctttctttcgcctagtaaaccacgtgatatatacttcgtcgtttacatccgttttagccagatgcacgatacgtgaccaactctgcctttgtccctgcgactcgtcaatacaagcaatcaagcaactacactttcacataccaattcctttgcttctgaatctgtcctgtttctgaatctcgccgatttctcatggaccaaggagaccgagtttagttccaaacttcttcaaaacttctaactttttcgtcacattaaaacttttctacacacataaacttctgacttttccgtcacatcgtttcaatttcaaccaaactttcaattttagcgtagactaaacacacccggagacgatgaatattccgacaaaacctacccctttacccccctctctctctctctctgacgtcacatggacggagccgtgacgggatcacgtcacgccgtcatggtatcccgccccgctacccgtgggaacggggcagcgcgtgcttttttctcaccaaacccaccccgcgtcatcacgctcgctgtaaagtgggccaggggttggcgtgctgggagatgggccccactagtcagtgggagaggtttcggtttggaccggctcgggggaggaggcgaccggggaccaccgccccctcctccgcacccgcacatgccacgtacgcagcgggtgtgggcccgaggtgtcagggagagcggggggacgttttcggtgggcagaaaggcgtgggatggggggcagtaaggtttgttgggccccacgtttcagcctccagctgggatggtgggccagcgggagagctgtcggtatgtttacaatagttttttcttgtggaagagatttttgctaggcgcacactatattgttttcaatgttttatgtatgcatttagagatgtaaacctccaccaacaggaaatccatatctgaggtaatattgttaggccttgacacaataaacgagactgattaggtgtttttaacctcagatgataactatgcccatacatttagaagaaaaatcttagacaattttaataacacaaacattttctttcaaaaccatgtgccatgtcaacttactagtgctagatgggtttttagcttttcgcgcattacaacgaaagaataatgtgataagttggtagatatatggtgtgaaattttctttcttactacttaaatttctctcatgtgcttatatgtttcatacttagatcaattatcaaaagattataaataattggattatatagtatggtttttgggcagaagagatcaagagataatttatatccttgatgaatcatccaaaagctaaaaaaaaaggacgatatatcttcacgagagaagaaagaattaatataaagtagggatgaacgtttagatatacaagattagctaactttttaaatatatatattttattagcatctacatgaatagaataatatctaagtcatttttattaatattatttaatgaataaagagtgatactttggtattggatacgtgaaacacacatgataaatacatatgacatagatataactattgagccgttgaaatcagtatccaaagacgctagcacatccctgttatttaaataggatcaaacgagtctgaatcaataaccaaggagctcaggagaacatgcccttcttctccatcgcctctttggtctcttattgtacattttcaatctcaccataagtatcaaacacaagattgccataaagattatccatcccttcctttcctttccctctaattttctttcacacagtccacaacccacaattaaatcatggcatgattgctccgtgatatataatgctacacacgtcaccatgtcaatgatcccctttcttttcctatcaacagctacaactataaaagcacgaccggtacacttcagcatctccaacatcgatcgccggcgaagaaaataaaaaaaacacaactacgccgcgccggaggagaagagcccttttgtttcatatcaaccgctacaaccaaaaaagcatgatcggtgcacttcatcatctccgatataagtcgccggcgaagaaaagaaaaaagaaacacaactatgttgcgccataggagaagaacccatttgcctcctatcaacagctacaatagaaatcacgaccgtcgcacttcatcatctccgatatcggtctgccggtcgccggcgaagagaagaagagccaccatcagcagctgtggtggaatggaatcgatatgggggcgtgtacacccagcgattacacaccccgggcttgttccacgtcggctcggggtggggccggccaaggctggaggctcggcgcccaccgagccgcaagacaactggagacagcctgtctcccacccctctccccctcttcttcgctctgtctctactctctctctctctctcctccccttctccccatctctctctctctcctctctccccccattccccacctcgcttcgcctcctcctccgcctccgccgccgccagggcctcgccctcccaccccagcagcgccgccgccgccgccgccgccgccgcggccggatcccacgcgcggctcgccgcgccgccccgttcgaccccccgaatcgccggatcccgtcgccggcgccgccgccgcgcctgggggggagctcccaccagggcgctccccgctatcctcctccgtccttccgccgaggtgatttgctcggagctttcgctttcttactagtttttttttggatggggagtgatcttctcttacctcggtgggtgcttaatgtgctggtttgaacagttggttgtgggggaaatgagtagatgttgtgcttgtgggttatctgagttggttggttatggcttgaattgcttcttatttggtgctggaatggttagctgaagcaagtaatgcgctaccagcttagtcatacttaggtggtgtgcttgctaatttagcagattaaaccggttttatgcgaactgcgaatatatagaagtgatggactgtgagcatcttttttgcggggataaggtttagtgtgtagtcgaatcattctagctttgcagggttcgggcgtgagcttatggggtactagtaaggagtaaatatttagtttagtaatttgttgcctccttaagcaaatttgaattggatttgctttgcaaccacccttatgcgattgcttgatgattgcagtgctgtagaagctggtcacagttgaaacctggaaggcagctgagtctatggtttttgtgggccattgtgctatcgatgcgagtagagagcatgcgtggcagctgttcttcgggtgatgcccctgaccagagaagctgccgatgcattcggtgtggcaacaattacactgtttgcaatcttcgctgttctgggcctcttctgcattttccagtcaatctatttccggtttcggattcggagaggggccttcattccgctcggatactttaacggcccttgggtgactcgcattgttttgattctgatcaccatttggtggggagtaggggagattgtcagattgagcttcttgaagagaaagttgttctccagcatattattgcagaagggtgtatgcgacgcgtacatcctttccaatctagggtttgcggagccaagcatcttctttgcgtttgctttccttcttcacggctcgttacagaagagggagttgggcactttgaaccaaagatggaattggaagaccataggctacatgttggttttctgcgttccggtgttcttcgtgcaggctcttctcgtgtttgttgggccaacatttgttaaggatgagaacaatacacatggaaggaaaaagattgctaaatacttcatccggacatccatgccagttggggacacaaatatttgcacctatccattgtttggcaccattttcctgggacttatagacgccatcctgatgagctatgtctcctatgttggatctcgggttttgtccttggtcatcaacaaggcactgcgaaggagggtttccttgctgatgttatcggtgcttttcttccttcctatcagggtgcttctacttgggttttctgtcctgccccaaccaggagatgtagcatttgaagtgatcatcttcttgtcattcttgatgatgatatcctgcacaaccgttggtgttctcttgctggtgtactatcctgtagcagattcattggctctccgagagataggtcagagggaaataacagagatggttccttatgatgattactactatgaaggtgcatcgcttgtagccaaccagagctttcgagaaattgaacggaactcagatacttcaacgaagcgtggttccatatctttccgcactatgatcagggaagaccaacttcagcaggatggtgttgatgaaattggattctcctctcgtagtggtgctcatattggatcaccctcaccttcaggttcatccccaagtgctgcaatgcccatgctccctctcaaggaagtacctagatactaagaagtattcacctgttccttttgcccttctactatgttctcccttttcttcttcctctttcttcctcttactaccttaatgataacagttttgtggcaatcaaaggtttttgtaaagtttccaagtagcttgactcatcattagtttagtactcaaatctcatttatcaaagtggcatgtagctggatgttgcaaaggctgaggagctgtgcatctggcattggctggaaaggctgagttggaattcacttttggttggttttgctgctccacaataatatcttagctaataaattccaccatggcataggctggaatgggcctcagccttgtcctctattccttagctgcttctctccatgacagctatgcaagtatatattatatttgcttctttgtgttgaattaaaggtctgccaagagaagctgtcagttataaatagctttgggggaaatacagtggtagcatatgctaagcaaggaccaccatcttgccagtctgccctccatccctatccaactaacaggtgagcaatgaagattaggcaaatgtttgaccaaactaagtcaatataggaactcaattcaaatcaatttttgcccacttagaatatatgtcccatgaaatatactgaagtagagagctggaggaggggcctgaggcttcatatatggctaaaagatgaatctttactatgtttatctcattggctgctctcgtactctgcaaagttccatggctcacctgccctacatgctttgacattggcatagatctgtccatctggggatgtctccttcaaaatggatcgatcagtgggcaggtgagcttgtttacaatttcctccccctgcatagagtgcttagcatgatccagatgcacactgcctggtatccaaagcccctgttgctgggcatagtcaactgggacaaaattgtctcctgtttttgtgattgtcatttgtcctgtttctacaagctctcctctaccctcccttctccggcaatttttcccctctgcagttgtttttcctgtcatgttttttgtgcttgtagtagtagtagaacataggattccttaggttggggtaatatgggtactcgaccacttgtgttacttgcctggtgctgccagtactgcaatgcatgtgatctgtgtggcttgaagggatctgtcataattttagtgggcctgccgtcttgtgtcactttttattctcttacaggatgggtctcttggaatcacactcttcacaaacaggagcaaagcgaagtgaacgtcataagcagcagctagcactcaaaacaaattagggccttctaatgtcctttctctgatcccaaattcctaacgaaattcttcagacatctgctgcgaccgtgccatttatttcaaatttattttttctttctttttgaaaaaaaattactatgcgtttgagcaagtgtggacctaacgacgcaatggaagaaatactagaacaaggcatgcaatcttctggaggtgttcgtatgagtagagtgtacattcataggggtaagtgtgcgtgttctggatgcctgtatggctgcgtttatgctgtgtttcttagaaaaaaaaacttactagttggtctcgcacaaattgttttagctttggaagaatcttcctagttggacgcacacatgtaatcttgcatcggaaacatggacaagtggagaccattttgcttgttaatctcggcccaaatggtcgacattctcgagtgatttgcctgccggggtcgtgacagcggcatcgccactgttcttttcgtacccgagcaacgtcccccgcacgctatgcgggacgcgctgtacaacttctcattcccaatgctgtagcgcacgtgacgtccaagaggaaggttgatttcgtctgtggtggctcctaaactccacttccacgattccgcacacatgttttccaaactgctactcagattttgatattttgcttatactgtttgatcatttatcttatttaaaaaatatatttatctgtcgctctgtttatgcatgggattagttcccaacccacgtcaaagaacacagccaaagaatagctcgcagctgcccaagtggatgagctgcacatcgtctcttccacgaggccactgcttattattacaaatttacaacacagttttgttgcaaagttcaccttacaagttacaaagagtcagtatgaggctacgagcaataagcttctcttcatcttaggaagatggcagcagggactctcatgctgtggcgttcttcaggtatgcgatgagatcagcacggtcctgtggctgcttcagtccattgaaccccatcttggcaggagtgtactgcatatgcaaacaaagagtaatgtcctgagatcatattgaataaatgaattgccctgtaatagctgacaaatatgtctgaaatattcagcatctgatgtgcaagcgtttaagatataccgcgtgtgtatgtggtggtagtggtagtgggcaaaatcatttcattggatgcactagaggtacttagcaatagcacataacagtcaccgctagcaagacaactagacaaggtgctctgaagtagtagacagcgctttttctgaatatgagataaccatgaataaaagtttaactctagtttttctttgagatcgactcgcatcagctcttgtgatgcaatgacccttcatgcgaatcctgctactttatgagttatgcctgggatcacagaaccaagagtatctgcaaagacacgtaatagaaacaaaatagcacaatgagctaattgtagttaatctatactagcatgatgatccgcgcattgcaaaggatcccaaatttaaaatataagatgcaataaataattaat

SEQ ID NO: 40688 - DNA, 11714 bp, Oryza sativa
aaaaaacacggccaatcaatataaacatcagaagctaccacttatgagttccagggaggcgactatctttaatttaggtccacagcgtggcagcgcgagggcatgctgtagaataatcagcaacactaacaaagttcacaaaacactatcagttcaagtgacaacaaagcttgcaaagtcctccagtccccggacttaacaatgatcacttcgactggcaacattggcacgggacaacattgcaaatgaaatatctggtcacaaaatgcacatcgccgacgcacacatttgaagttacactactgattagaaaacagaagtgatggaaagttaacattggtcgcaccttcttaggagtaagcaggtagtcatacaaagtgttctcttcccaaatcacaggcactatcttgtcgccagatgggtaagagaaaccaggagctgtaccagattgcctcccaaacaaaccgttcaagtttggccctgcaaaggacagcattgacattagtaattacatatcagcatctggttggtaaagaagaaaaagagggagaatactacacagatgaaatgaacagatcaaatgaattgaactctgaaaagtgtcattggatgaaatacacagctactgcacagaacagtaccagatggaaatggttaaggccctgtttgttttagcttaagattattgtaatccagattattcaatcagattactctaagctggattataataagctgatatagaataagttgcgagttgtttgtttctctggattattggaggcatctaaggatagtgggtctttagccactcaataatctagaaaaagctcctccataggagattattagattatactaatctggcttatagattataataatctatcataataatctactccctccgtttcacaatgtaagttattctagcatttcccacattcatattgatgttaatgaatctagatagatacatattgatgttaatgaatctagacatatatatctatctagattcattaacatcaatatgaatatgagaaatgctagaatgacttacattgtgaaacggaggaagtacttgtttgttttggcttactcataataatccagattataataatcctaagctgaatcaaacagggcctaataattgacatttcacagactagccgataaacgaagactatataaccgccaaagatgtataggatcattagaattaccattaaaactagcatatgtacacctggccctgagtatactacatcgagagagaagagctcagagagcttaaatgcatattaccagctaaccagcaaatccagcaagatggtcaacgcatgtccctcgtatgattcatggtgattgcaaaaatcaaacatcagcgacagacacgtgctagctgtaagatctaagtagcatatattacacaaaccaactatctgatggcaacctggaaaccctgccatcacgcatcagagcagtaaaacgatgcagaaacctccacaatctaacaatcctccaaccggacgaacactgagctatatgcattaggtggttcggtggctcaccatgcttgtggccggcggccttgtcgacggcatggcagtacgcgcacttggtcctgaagatcttctcgccggccgccgcgtccccgggcggcgcatcggagaatgtcgccatcgccaccgcactcgcggaccaggtagggtttgggttgaccttggaatgactgatggagaggggatggacgacgggcctggttgggccgcaggcccacgtagaggcctcgaactcgaagcttttgaatttttaattcgactagaaaaacattatactctttattttcggtcaaaaacacattttgctccttccttttcagtctcggtctagcccaccgcctccctgtgcttagcctgcttctcttgaacctactctacaagtagaatgtaggcctagctcgcatagttgaatgccatcttcaacctccggaatacagtccgtgtagtatgatgctaggaccgatcctcctatcaaatccggtcaaatctttcttgatctcctaaaattggttgagggcttttggatcactcgatctcctcttttcatttttatcaaaattggagcgaatccacaaaactgtgggatataaacggtgacttctaaatagagattgaatatgaatatggtgaattaaagcggagctgaaaagaaaaaatatgtggaaaatgatgatgggtagtggagaattgatttttataataaattggaggacggaaagcatgaggaggttgatcgatgtggcggtggtgctagggttcggcccaacgatggaaaaccgagtagatgaaaaaaaagaattctaagcaagtgcgcacacccttccgcgtgccaaaaaaaatatgaataaaaaatagggacgggaaaaaagaataaaaataaaaaggcgatggcaaaataaccggaaagaacggcgaaaaaaagatggatggaaaaaagaacgaaaaaaagcagatggaaaaaaagaaaaatgggaaaaaaaagaaggataaaagagacggacatataccaaatctgtttttccggatggctttttttttttttgcagtcggcgatttatttattttatttacggtcggcttttttttttacccagcattttttgctatttttttcgttggtacgaatcggacctcttttcgctgtttttctttcgcgagattttttttacataatggaatataatatccggcctttgctcaaaaagaactatagccaattattagaaagatccacttcagaagagagtgtagttcaagacaagttaaacacaccaaacaagagaagagaggaaccaaactgagaaaagcaaaacaaaattacggattttgaggaatagagattaaaatcgaaacaagaaattaaaaccgactcaaacacggatgatttaccaaagtaccggaaaaaacatcttcaatttttataatagtagtaatttttgaatcttcacatgtaaattttgaaaatttatattggatttggtctttttcttgaagatatggtaatttagtgtccattattgcgtttcttagttaccttttgccttttactgtgtctattggattttaatctaaagattaaaaatctgcgtgatatgattataaaaacctttcgaaagatgcataggtacccctttttaatttacgtccccattgtttggctcggcatatttacaaacgagaagtaatttataaataaaatttttatatatgtgttcttagcgacctaaatgtaaaggctgagaaataaacttcgatgaaaaacctcaatatttgcttcaaatttaaggttaaaaattcaaattttggctgataagcataagcataagcgaaaagatgaggccgttactctttttttaagaggaaatttgaatgaattttgaaaccatgccaagatataattaggcatatagggcagagattttagtagctacagtttcactgaatcttcgacttaaaccaaataattcatattgtcatctatattttaagagtctaaagttgtaaaatctaaaaactgaattaaagctgtaagcttaaaaaacccaagttcttcatactcttataaaaataacatctaatatgctagctatgaatgcatccaataatcctttttctcaccgctgaatgctgatctcgatcaagagcagtcatggcatgtaccctttcccctgtgggggattacttggctcccttaagttcacagtgccccgcgccggcggtcatcgagctgtcgccgtcctcgatgtgatgtggagtcgaaagtccattggagatttttggagcagcgaacggcggaggaagaaacgcggcggcggcgccgcgcgctctttagcagcgctgcgcaggtagcaaagtaccgtattagggcaatagcaatagcactctttagcagcgctgcgcaggtagcaaagtaccgtattagggcaatagcaatacgtcttgcattttgttagtcctgaactgccaagtaggatgaggaccttccaaggacacaagactcacggtgcgaaatcaaggcgggtggaaaggcgaggcgaagccctgcgcactgcaatggccttgatatcgtcgaaaaccgggtggcaggttttggtcacaggttcttcattttggtggacccatcaagaaacgtggcatggaatcttgagttttggcggacgtggagagctcaggctgaatgccagctccttgcattgtgaacggccttagcgacaagttttatcccacctcgacaaatttgatgttttgtgacctatacaaaagagtttccacctcatgatgcgttgcctcttcggagacaccttatatttataggtcacagcatattagctaccaagtaccaaccagtaaattctcacaatcttaagctccctaaacatgatcataatgtcattttaaaagacacagtactaaaatatgttgctatattttttttatcctctttgtctatttctacaagccaaacgatcatataatacaagatcaaacgtctataatttatctacgagtggaatgtgaatttgaaggtttgtacgcaacgtcttataaatgtctagaattaacaattctatggctattcacttgttgcgagaatctcatatatcagtttgtgtatgtcagtttatgttgttggaggcatactaggatatcaccactagcatcatttaaaattgtacaaaactacgtggaggaaatttgatgatgaattttgaaaccacacagtaggaatcgcgccaggtgctttgctgctaccctagaagataccaggcgatggggcccacctgccagcctccgtgcgcaccactgccccacacgccgccacgtgcctcgtctcctccccctcccctctcctctcctccgctttcctccctccctcctctgctgctccttcccctccacgccttatcgcttccgagctcccatggccgcacgccccgcgcgctagctgaagcagccagcctcgggccccacccacgcagccgccggcgccggcgccgccgctccccatgaggcagccgcacctcctctcgccgcagcagctctccccgtccccggtcctctcctcccacttctcgccgccggcgcccgggggctcgccggcgtggcggcggggccgacaccaccaccaccggcgggcgttccacccgccgctctcgtcgctgcgtgaccccgacaaggccacgctccgcaaggcctcgcccaacgtccccttccgcctcggcggcggcggtcagggcggcggcagcagcaaggaccggcgacccgccgctgaccaggaggaggaggaggaggaggaggcggcggaggataagggagacggcggcgcgggggccatcaccgggacgctcctcgccggggcgctgctggttggagtcgtaggggggttcggggcggcgggatacgtgtacaaggaccagatcaacaccttcctcacccagttctccgggttcattgatggtaatggctaatccagctgtgttctatttggattgtgctgtgaaatgctactggtctattgctgaagactgaagtgtctccttgctaattttgtgctaaagcaaaccggaagctggatgcgaatgctctagggcaaaaaccaatgaactagggcacgtcagtgtggttttcacactttattaagtgttatgtttctcaaaaagtgtataaaattgattgggtcagcatgctatataaggcttagttcaacttgcgatgtgtgctatgtggcaaaataaagagcacatagctgatttacgtatgtgcgcaatgtcttgtttgatcaacatagatttttattttccacaactaattgtcctttgttgaatttctgcctgaaatgtgaccgtactttgcatggacaggttatggccctgctggatatgctttatttgtactagtgtatgcaggattggaggtatgtccttttgctagctaattttactttcattgatgctgtacagtgtcttcgtttctataattttcacctaaactagctagtcaattacagtgatagtgtaaggctgatatttttgcctttcagttacacacacacacacacacacacacacacacacacacacactttgtaaatttgttgtgccaaaatgtttgaatatgagtgagtaggcaataggcacttttgttttggataaagccacttcttgatggagggcatccatttctttctttgtttgatattggtgaactctgaaataaactaacgatctacatttagccctgtcaaccatttgtacaggcttttgtcatatattcttgacatctggattggaacttcaccttcataataatactatgattttctttgaattcaggtccttgcgattccagcgataccattaacaatgtcagcaggtctattgtttggtagtattactggtacagttattgtctcaatcagcgggacagtaagtaaatccacatcaacagcattctgttgttaactctgccttcagctgcattttcttattgtgctttgccaactgtgcagctagctgcagcagtggcctttcttattgctagatactttgccagagagcgaattctcaaattggttgaaggaaacaagaagtttctggcaattgacaaagcaataggtgaaaatggatttaaggttgttactctgctgcggcttagtcccctattacctttctctcttgggaactacttgtatggcttgacttcagtgaagttcttgccttatgtcttgggaaggttagtttctaccaactcctgttcttccatgattccagtatggcattttctgtcaaacaaacaggaacggcaatatggtctcagtataacgactctacttggtagtaatgcaatttataagaccaaaagggtagtaaaaatcatatacccgttaaagataccaataatccattgcaaatcttatatccctttaaagggcaaaaattgaaggatcgtcaatagtacctttttgtcaaaaccttgttggctcagatatctttctaccattgtcatgcagttggttgggaatgcttccaggatcatgggcctatgtcagtgctggtgcatttggacgagctataattgtaagttcttaaacacattgaattattttagttcattgccagcacaaacgtacttccattgccatttcatccattctgttcaatgaaaaccacatctattgaaccacagaactctttcagctcctaatggctgatcagtggtatttttgtactttgtttctattttctacgaatgcctgtatcttaccatatgtgctttctcatatagtattgtatccaataagagctggttcatgccatgaatctgggagtgttttgcagtttgctgatcgccgttgctttgtagtgaagtgttcaaaggacacttatttttagatgtttacatatccagaattgcatatgtgtacgtcttaattcaaagccatgaattctttacccttgcgattttctgcctgtagaattgatccaccgctagtttagcagttcacatcttcgacatttgtatgtctggggtgaggagagatttttcatgtcattaccgaatgatcttgcttgtcttccttctctatttgcataattgcatagcagcagaacacatgctatccttgaaatgcttatctggtggcttgactattgaaatcataacatatggttcttactgctgctttttttacgtcaaacatgacatggctctcattttgacagcaagatgagtcagagatcggtttgggaggaaacagccagctactgacactgggcatcgggctattattcacagccattgctgctacatatgtaacacgacttgcaaaggtattgacttgctatgatctatcacacatactgaacaaatgggattcggcagtatttgaacatatgcttatttcgttagtggtcactttgggtttcaatttctctttttcgaaagccaattctaactgttcttaactatgttatttgcaggatgctgtaaaggagatcgatgaatagaatggtaggattctctagtaaaatgcggccttctgatactagcatactagcccattgtacatcatcactgtcatctttgatgcaatctgatctactagaaattcaagcaatttttcaaaggactcccagatgctcgttggaatgcaatgctggttctctctcttatgcacatgcctaattgcctatagagtgaatcaaccaaaaatggtcaaagacaacacaatcgtactaagctccagttaccagtaatctccacaagaacatgaaccatccttcatgtgatggaagcagttggagtctctcagtatgatctccctgccgtacacctcggcgaccatcttgatcgcggcgtggcagtcgccgcacacccggaggttcttgtacacgcggatgggcgcggcggctggcacggcgaggaggccgaacgcgacggcgagcctctcgccgtggtgagccagccccatctccctcccctccggcgcctcgtcctgcagcgcccactcggtgtccggcacgtgcccccgagcccggatcctcgccgccatctcctccgccttccggtagatctccgccgcccgctggtgatccctgtccccggcgtggaacacgtgcgtcacgccggcgaccaccacccagctgcacccgggctccttgctgatgccccgcgacctcatcagcgcgcgcaccctcgccacgtcgccccaccgccgcgcccgcgagtagaggttggacagcatgacgtacggcatggcgtccgtcggatccagcctccacaccatcccggccgcgcgctcggcgagcgccgcgttccggtgagtccggcacgcggcgaggagggccttccagaccgtggcgtccagctcggccgccgggctccggtcgagcaggtcgacggcctcgccgaggcggccggcgcggccgagcaggtcgaccatgcaggcgtagtggtccggccccggggagatgccgtgctcggattgcatggactggaagtgggcgcggccggcgtcgagcagcccggcgtggctgcaggcgaagagcaggccgacgaaggtgacgtagtccggcctgcagccggagcgggccatgtcggcgtagacggcgagggactccctgccccggccgttctgcgcgtacccgacgatcagcgccgtccacgtgatggcgcaccgggagcgcatcgcgtcgaacaccgtgcgcgcgtcgcggagcgagccggtcttggcgtacatggacacgagcgagttgccgaccgagaggaacggctcgtgcccggaccggaccgccgcggcgtgcaccgaccggcccagctcgagcgcggtcgagccggcgcacgagctgagcacggccgcgacggcgaactcgtcggtggcgaccccagcggcgaccatgtcgcggtaggcgcgaacggccaggccgtgggatccggcgcgggcgagcccggtgacgagggaggtccaggtgaccacgtcccggcgcggcatttcgtcgaacaccgcccgcgcggctccgaggcgggacagcttggcgtaggcgtcgacgagggcgttggcgacatggaggtgcgacgcgagccccgcgcggaggaggagcgcgtggagcgccgccgcgggcggggcgcggagcagcgcggcggagttgaggatcggcgggagggtgtactcgtcggcgcggagtccccgcgcgcgcatctcggtgaacagcgccagcgcccgccggtgcagccccgcgcgcgagcagcgggagatggccgcgttgcacgcgaccagccccttcccgcccggcgacgccatcgccggcgccggcgccgtctacgcgattagagattatttatcaaactttgtcgcttaacgtaacaactactactacgcccttctcgtaataaaaaccaaaagaaaccaaggcgttttcaacttctcattcgtgcgttcctccacgacgccggcgacccgtcgccggcaggtcgccggcgccgccgtacaccagagctcaatgccggcgaggcgttcgagaggtttgctcattttcttcgaatcatccagaagccaagaattggtcggggtcccaaggcggcgatgcccaccggaacctttcactgcctccagattcttgcccggaaatctccaaaatcccaaccactattccaaatcaaaatcagcaacaggctccatttgccaattgccatgatacgcgctaatggatttgctaaactagggattagcttccgttaaatctgcaggctaacaaacctcatcattcctctgaagacgtcgtttcttcaggacaaaacaagagctcgtgtgcattcgggtggttgtgaatgacacgggtcattcctacaaaaacagcaacacctgcagctggtaatttgttaatctgcatgcgcctatctgttgctggtggcctaacttcgacgtttgctgactttatagaaaaaatcgactttgcaaaagagggtaaaagaagattctctttttatcagctgttttttttttctcagctaagttgagtaatcactaatcaaccataaactaagcaccttttctgcagaaagcagcagaactgatatagtttcgtattcgtggtgaggttacagaaagagctaaaagaccgacgtggacagactcttgcctttcgaagtgccaaactcatctgtttcaggatcactcgaaaatgggttgacaacagccagtaattttggccagaatattaaaaccgcaggaggatttgttcgttttcttttgccaatgattgagtagttccagtatctcgctctcactgaacattctgtcacggagtgaccagagaaatcagatccatgtaaaaaacgaaaatatcttaaatgtggtttttgacctgcaagagaaatcgacagtgaatgcggttctctatcaacgaacgctctgctcgtagccgccaccaacgcaggttcgacatgcaggcctctaaaaatctagctgcatttcacatttcatcatcctcctcctgctcgcacatttctttcaatactcgtgttgaaattgagtactccaatgttcaccatctacgacaacccgaacccgaaagccacggtaaatggtgagtctaaattatagcagcgaacacacatcatgagaaatacatctatacttatcaaggaaaagaaataaaaaataaaactgttttttttacatgaatataatatataactgtgagtgtaaaggtagtaaaactgtactccctctaattttaaatatatgaagttatcgaatgtttaaccatctatcctattaaaactatatatgcatcacttattttgttgtgacctattttatcattaaaatattttaaacatgcatatattcttgtatttgtacgttaagattttaaatataacggataatcaaaacgttgtatatttttacaagaagaaggtagtgcaattctttttaagtaatacaattgggcatttttatttttcgagataaatacaattgtgtgtagaacataaacattaagtaggaacatgtaaaccggaaaaaaaatcattagtacgtgattaattgattttagtcatttttaaatcagataaatactaaagtaaaatatgtctttataagaaaacaacgggacctaaatggatggtgcttaaaaaaaaaag

SEQ ID NO: 40689 - DNA, 2120 bp, Oryza sativa
aggagggggtggcgtccggcaacgcgagctgggtggagcccgaccccgacgacctcgtcttccccggccctgaccgcgcggcgctgtggtcggactcgtcggacgacggggagaggcgggaggaggccgaggccaccgagccgctgccggtggaggcggcagcggcggaggtggaggcgggcgagggcgcggtgacgaagggcggaggggctggggcgggggtggtgcggtggtggcacctgccgatgggcgtgctccgggcgtgggcgctgcgggcggcgaggagcgtgtggtcgttgcccgtcgccgtcgcgctgctcggcatcgccgtgctggggcggcgcctgtaccgcatgcggcggcagagcaaggccgtggcgcgcgtccgcctcgtcctcgacgaaaaggtgaggcctctcgccgctttcccggccatgcccttgccgtgggttaaacactccaaccttgcgccactgtgcttgtgtaagcgtctcattttgtttgtgtcatcctgtatcatccacatgctgctcgaaaatgctacaaatatttttaatatttttctataaacttgatcaaacttataaagatttgactaagaaaaaaaagtcaaaatgacttataatttgaaatagagggagtaccttgtttgattttagggtgaaaacagcataaaatttcaacttccctatccattgaaaacaaaaggtgcagttctcaagtctcaaaccaaacacaaaccattttacttcaggaacctgatattactggctaagcatgtaagcaatagccaataggtagctcctttagagcctataggtgattgcatttttctttaagcaaattacatgagttaagtatggttgcaagctgatgagaaaatatgtagctccttgtactaatcttgtcgccatcgtcctcataatattgcacaaagaattctttctgtttgtgactttgtagtttgtactgccatactagtggcaggatgtgcatcgcctacctgtgtttgcgtgtgcacgcgtgtatcaacggggcaaagcgctgaactttgacttacttcgaaagatgattaggaggacttagagtagagcctgatcacataagagcatcctgtaatatgcttatatgagacaaataccatataagacggttttcaaaaaacaaatactatataagagcagagcctgcataggttgcatcctgtcgcacagggcatgaacccacttataggtcaaaataaacgggtttgcggcttattttggcctataagtgggtttcacgggttaaccacttatatccttacgcacaggttacagtggtatgtaaatgcaagtaattccataattgttgaatgtaatgccatgtgatttgtcgacgacaattgtgctgacccttaacgttgttcatggtatcagtgcgttccccattattgcttagcttagctctgtgtggattcttactgtcatctgttccttaataattttaattgacttatgcagaaggcatcccagttcaaggcccaagcatcacgcctgaatgaatctttcccaatggcacgccgagctccgatcatgaagcctctgcttcctgcgaatggagtgaccccatggcctgtgctgggacacatctgagcttgagatcgacggcataggactagtaatacaattgtccaaagttacttggcttgtgagcataccatattggtccctaaagatctagccgctataccgctacttggagtatacacctctggttgtggaaggtagttacattcccactttatgtgggatgccatttaggccttctcagctttcatgtttcttttgtaccttataattttcttctgtagtgttgtgttaccatatgcgcttgaacattgtatctgtaattctgtatatatgacaaagtaaccatacagattgggagtttgaaactgtgctcagcttcctttcgctactgttaatttagctgtttccgtgctgatatactctctgcgtcactgcgtgtatgcttgattaatgaaaaggtcgcagattactttgaatacctagagggttgagcccaactgcccatagcaagtatccctaagagcaagtttaatagtatagcccactact

SEQ ID NO: 40690 - DNA, 18741 bp, Oryza sativa
attacgtcttagaatttgtgctgtagctggctacaaatctgtagttcactgctcttctctctcttcttttatctctttaaaatatgtttatagctggcttatagcatgctattgtacctgctctaatctgtctcctttttattttcttataccatactccatccgttttttaatagatgacgccgttgattttttctcacatgtttgaccattcgtcttatttaaaaattttatgcaaatgtataagatataaaattactatgagtgataaaacaactcataacaaaataaattataattacgtaaattttttgaataagatgaatagtcaaacatgtgacaaaagtcaacggtgacatctattaaaaaagggaggtagtacacagtatagttttgagatgcaatgatcattgagaaagattagcttcctgaaccgttgagttgaatgcattatgcatgtcccctttcttgcatgggatgaaaggctttctcgtttaagctattgatacattacatgccaaaggtcactatgaagtctgttcaatgttgatggagataacatgataaaaagaaaaatgtgtgaaccatctctatcttagtggtcgtgccggagtggttatcgggcatgactagaaatcatgtgggctttgcccgcgcaggttcgaatcctgccgaccacgttttttattttttttactctggctgttttgctattttactcctgttgtctcactcggttgttttgctggaataatagtcccttctgttttttttattttttttactctggctattttgctattttactcctgttgtctcactcggttgttttgctggaataatagtcccttctagggcaaacacagaggggtgtggggggctctgggcaaggctaatgagcgatcacccacccgcccctcctctatacgctccgtcgccccccccctttctcctccccttcttatcttcctactacaccataaatattttaatttaaattcaaaattaaaacgggcatataaacttttgatttataaactttgggtctataaactaatatttgaattcaaatttaaatttgaatcgggtatgtaaacttttgacttataaactttgtgtctataaactttaggtgtataaactttagatgtatagaaatactatatataaaaaaaattgaattcaaattcaaatttgaatcgggtatgtaaacttttgacttataaactttgggtttataaactttaggtgtatagaaatactatatataaaaaatatttgaattcaaattcaaatttgaatcgggtataaaaacttttgacttataaactttgggtctataaactttaggtatataaactttagatgtatagaaatactttatataaaaatatttgaatttaaattcaaatttgaatcggatatataaacttttgatttataaactttgggtctctaaactttagatgtgtaaacttgaggtgtacaaactttaggtatataaatttactaaaatagaaaagtaatgtggtgccaaaaaaggaaaccaggtggagggaggggatccgaatttgatcgagcaatctcggagtgctccatataattaaattttactcctcatgtcttactttacagttctcgattagattggccttatatgtctatggctatataaaaaaagagaaggggttgctcacattgtcacttggtgctagagaaatactaaatgataagagagtctcacctatatattttgtgtctccactttttagaagttgcatactaattcgcttgcatgttctgcttcttacatccactccctgatcaattctcaataaacatatgtagtatttgaaaattatccacgaagtatattcatttatgaagtactgtttctcaaccacctggtacattcttttcatgtcctattcaatagaattttgtcattgattatttacttcatgtttctaatttgttcaaaaaaaactttattataatgtattgattaaaccacctattctaagctatttgtgaactttgttttttataaaataataatttgtcacgctaatcgatcgatgtttctaaggcctaagttcggacctgtttggtacagctccaactcctagatttagctctaggagttgggtctggagtggagttgtggagctgcctaaacccagctccacaactctagttcattttgtgagagaatttcactcaactctgctcctattttaggtggagccgaaacagtttggctgagctccatctccaagagaggtggagctagagctggagctatggcgctatgccaaacaggcccgtctattcttcaactctaaactttaacttactcgttttctgttagcacgcattttaaactgttaaatggtgtaattttttaaaaagtttctatgtagaagttgttttaaaaggcaaataaatccaaattttaaatttataatagttaatacttaattaatcatatgctaataaggtttctcgttttacgtgcaacaaaaaaatccaactcccaaacgggagatcgaatgggctggctggttcctagtcaagtggcaacattagtttatagtaagataaatctaggaaaatcattcattggaaaaaaaagccaaaacaaaagaaaatgcacaacatccaacttctacagtctttctaactattttgacataaatataggagattatctgtaaggaaaaaacaaattcaaaggaaatgcgcaacatgcagattctagaggttctccaactataaatcgcttttgcgagaagtttagttcacaattatctttgaaaactttgctacatgtgaaggaaatataaaacaataaattaagtaattgaatttataaaaatatgaaggacaaaagcaggataaaagtttgcatatacacattttttaatttatggtagtcatatgtaaatttatcaaacacatttttaaaataagcatgttataaatttagcaagttttttataggaactttatggtactaaactaatttatattgaaaaacataaaacttaaaatatgtttttcacacacactctaaataatatgcaccaggtacactaacgagagcgccaaccggcgtgcccatattttagtcatgcaaataattcgtgtcaatgatataatgagcgtagttgtatgaagcatgaccttaatttccccagctaccccttgttcaattttcctacctactattatcccaaccaccactcatttatcatttctctaaaaactaatattatattcataaaaggtcaaagccacgtaaccacgtcacatgtcagagttatgcatgagtcagatcccaaacgtagcaagagaatacaataaaatagtagttttcaccttaaatatctctaatatttttgcatgccttaatgggttttttatgtataatggtttatttttatctaaaggcatagccagggtttcacttatagcacgataatcgcgcgattatcatggttatcgcgcttatcacgagggtacgtaggggaaatcggcgatatagtttggatgaattttgaccaaattcaaaattctagaaaaaatcgaaaaaaactgaaaaaattcatagatgtagttgttgatttgtaattgccaatggtgaagaaattatttgaaatagagtaagctaaattcaaatttgagggcaaaaccaaaaatggtttacaaattgaaaaaggaagaggatattgggccttaagtatcctacatattcttcaaattattctcaatttctagttttctacacatattcaaccgtatttttaattttttttaccctatttattttacatttacatgatttcagctatacaacccgcgataaccgtgcgaatatcgcgattatcgcgctaccgcggggtggcgataaccccggcccaaacgataaggtaaaccctgggcatagcttggttttgttccatagatttttttttcttacaaataagcacgatgtgaacactctacctcctatggacaccctcgcggaaataattttttaccaggaaacagtgggggagtcccccacggtaatttcattaataaaaagaaaaattgtacaaattaattacaagttatcaatccatgattgaagaaaaggtttgaaagctactctaagcctagttaaatgtagacttagttcctccttgagacttgatttccaccttgggagggagggagaaatactattaaagatcatatcattcctctgcttccacagaagccaagcagccaccagaaaaatttccataaaacagtttggagagatatttctcgcggaaacaattagtcgttagtacgagcaccatgccaagtctaagatcttaacataggtggacaggttccatgacaaggatcataatcaattgagctactatcactccacttgctctactaaattttggtagcaaatcaaacacttgacattttgataattcttaatattatctactcatattgctgatatgatttagcatgaaattgaacttgtcttttttaagttataacttatcaaaacttggaacgatttataagtgttgggtttggggatgaggtaggatgagttagacccatttcttttttttaggatggatgatcctatctatccgtttgacataaggggtggggtgatcataattttttatttaagggatagcttatatgttagtgagagaaaaaaatgggttggattggtccgtcggcttttaagggatatgactaatcggactctgatgggaatattccctttcaagacttcttcgcttaatcccctccaaaagggatcggaggagatttgaagaggaataattccacgtctattgagttgttgaataaatcctctcagtcccctccaatccttccttatgagattaactgaacaaagagtctcgggaattatccattccacctatcccaaacaaaacacccttatagcaaccacaatgtggtagtaaaccaggtaacaagcaattaatgtgcccttactaataagcatcgttttttgtgctatgttcggtagaaaccaagtaaaatatgaacattcttataggaacatgggtagatgaggattggcatggataattttttcaggtgaacactgaaccccgcctcatttaccactatattcatacaagtattgtggggagggtggcactaccttttgatcatgggatctaccttactatcgaagtcaggcaacatacattgcacatatccttaaaaatcggttccacccgacccaacccatttactttttgaaaccaaacgtatgctaaaagtactacaaccaactgtaattcatttatgtatggaattgaaatggtttagttggattttaacttgtgtttagttcacgctaaaattggaagtttggtttaaattggaacgatgtaatggaaaagttagaagtttacatgtgtatgaaagttttgatgtgatgaaaaagttcgaagtttgaagaaaaagtttggaactaaacaaggccaaaggaaaaaagtaatgttggtgcggtgacaaacaggctataaatttcaaatcgtaaaatctaaatcgagagcgctctcaatttagtcataatgagcgaccctatcatctaatcagccgttgtccagatatatcttgaagaatcttactttactatagtactaattgatcaagcaattagaacaaatattcctatcatctatgtttcaaataaaattttctcttaaattactcatccgatttacaatccgattacaccgttgtgttcataacaattaaatctttacaacaagatctcacatgattatattttgataaaaaatcacaaattacttttataatatatctaaattacttttagatttcactaagttacttcttaaataaatatataaaagtaaattcaataaagttttaaagtaattaacatatattatagaagttactttccttttgttataagttacttctataatatatgtaaattacttttaggttatattgaattacttttatatgtccaagaagcaacttagtggaatctaaaagtaatttagatatattacaaaagtaatttatattttttcatcaaaatataatcatgtgagatcttgttctaaagatttaattgtgacgaacacaacggtgtaatcagattgtagatcagatgggtagtttaagagaaaattgtatttcaagtgtaggtagatagtgtttatcatagatagagtggtagctagtttagacaccagctgtgtagcatgtccatttcaaatatactcgcctgtgttcccgtgcgttgatctcgctccccccatacagccatactacttggcactttggcagcacagccaggagagcgccacgggggaggaggaggacgcagaaatagaaagcgaccaagagcggtcgccacgccagattctctctctctctctctcccccttttctcatcttcctcgagacgccccgccccgcgccccgcgcctcgatcctcgcctcctccccgcattcactcccccgaaaccctcgctctctcccccatccgccgccgcggccgcaaacgacggcggcggcgaggttcgtcggcggggattgtgggggggggggagaagacgacgagggttttttttttattttttttttctgattatccccctcgcgcggggggttttgggcgatggggaggaggagcaagcagaaggtggaggatatggccgaggagctctgcttcgtctgcaaggacggcggcgacatccgcgtttgcgacttcaagtgagcttcgcctcctcccccctcctcactatttttttttggttcggttcgtggttttgtgctgtcgctatctcctctgttggaaaaaaaatggttggaattgaggtttgttctgttggggggaatgtgtgcaatgcgggtttttggtagatggtgggtgcagtggctgctgcatgcagaattcagttctgtggtgcccttggaagttggaacagtatcgtcgggatcatttccaatcgattggtgacagtgtagctagctaattgtgccttgttatgcttttcaggaactgcctcaagggttatcatccacactgtgtggggaaggaggaaagcttccttgattctgccgaacagttcatttgtggtgagcgccttttgtttttttcccccagtatttcaaccatacttagctgctatctgaattagcacgacattgcaatacccattatgctgcctgcccatgtttggttacctcattcatttggtttgaccaagtatcctaaatcatgtcctgcctttgtggaattgccaatgcccctttctttttcctagaaaaaaaaatcggctgctggatgcttaacctttcatttattagtagtgaatgggcttcagtatcttggacaaaaaacttgggaggattaattgctcagtagtttttatgtagcatagacataactaaaaggaaggtgtttagcatataatctgtcagaaataagctgcaaagtacttttgtgagctagcagtactatgcattttttggatttcatttttctgttcttggagtgcctctttcaacttctaccatgtggtacaataatgctattcattcttgagcctaacttttactatttgcagaattgcacaaatgtgttagctgcaaaaggaattcagaatatcattgtttgtgttgtccaagttcctctgtatgcggtgaatgccttggaaaagttgaatttgcacaatttaggaagcagagccagaccaaaggattatgcaataactgtttaaagttggcattgtttgttgagaagaactctgaagctaattctgatggggtaagtgcatgtggatccttttacagtttttgaattatagcatttattttccatttttctggaggtagtactccctccatccaaaagtcttgagcctttttcatttcctggtttttccaaatgagatagacatatttgtagtctccatgcatctgaggcttaagtgaaggggttgttttattgttttacagtgctaaattaaattgttgagtggaacccaagcaaccaccttaatacttattggttgcatgcacatatagtttcttcgtctttgttacatgaggatgagttaatttctccttggtcttgatgacaaaagaaatatgccttagacctttggatggagggttaagcttccaccaatcccctgccactccatgcctgccattagtcaatccttgaaaaaaaattcaatggcctagtacagtagtgcctaccataggtccattaaccttgtatttatctgtttattgttcctctggcataatttgtctgggtagtttccacaaaaatgtcagttgacctctccatatatctggtctttttctgattactgttcatgtgcatccctaggaaacagttgaattcagatatacggagaactatcttgttctgtttaaagactactgggaaactattaaagacaatgaaggcttggcattgattgatttgcagcaagccaatatttgtcttagaacaagcttaagctgtaaacaaggaagggattcagagaaacccccagatgaagattacagggcagataagaattcattgagtgttaatgatggcgctgaacaaccattcccggttgatgtaaaggtccaaccaagtgaagcaaaaatgtcactgaagagaaagaagtcaaacaagaaaacatatgtcggttggggttcaaaagagctaattgaattcctgtcatgtattggcaaggatacaactaaacctcttgatgaatttatacttactggagttgttaaggagtacatccagcagaagaatctattcaaggacaggaaaagaaaatctgtcatttgtgatgataagcttcattctttgttcaggaaaagaaaagtgaagtcaaatatgattcttaacttgctggaaatacatcttgcggcaaatgctgcttcagaggatgattttctcgatgattctgaggatgatgaaggccgaattatgagaaaaaggccttgtaatactttaaaggcggcagagacttctgagagggatccaaagagaaacaagaaatgctttgcagctcttaatcacaataacttaaagttaatttatttgagaagaactctaattatgaatcttatgggccaagacacatttgaacagaaagttgttggaagtttggttagagtcaagaatgatgacaatcattatagttatcagatgcctaaaaaacactaccagcttggcctagtaacaggtaatcaactacaggcagtcttctcaagttttgaactttgatggtttctgtaatttttgtcaggcatgtatagcatatctgtagtattgcagtggaagaccaaatcatcttttttcttcattaaccagcaagccaaaaattattttgttttcttttagatgaaaaccattttagtgctacattcatatttcatgcattggcctatatgctgtactatctatcctccaggaaggatatgactttctcaccatgttgaaaacatccataacaggcattaggaaatctccacaagaatacaagataaaggacaaacgtacagatattcttttatgtgtttccaatctgtgggatgacatcaagatctccatgttgtctgaagaggacatagaggaggtatgattcttttcctagtgtactgatataaaatggaatgagtactaccattatgatcaagtaggccgttattactcccatttgatactataatgtaacacacataccaagaaatcttaactttgaagtaatatggagtattttataatcaaaccatgatttcctattttgtgagtattcttatggtccttgggaggtactagtacctcttggtgcctcccaagaaccaccgaaaaaagaaactgcccgattcgatgtcgtagtagcatgcgcatctagcaaggataagcaaagtctactcttttgaatattattagtgtgccagactaatatcgggacagaggaagtgtcttactttctttattctacattgttctgtccactcaaaatatttccctgaatagttgatgtggtcaaacacttccttttgcgctcttgataacaggacgagtgtaatgatctccttctgttggctaaaaaaggactcttcaaaagacctactgttgtaagttcatgttatgaaaagcttccttttcctagttgcagtccccgacagcagcaatgatatattctgtgatgtatatttacatatataactttagtgatgaaataatatattgttttctgggattgtttttaacagtggagacatccttgttgatgttcatgctgatgtgcatgccatgttgggtggatctctttttatatagtaatatagccctctcaacctgctgctacttaacttatgcatgttggtctgtctgagtcgctgaatgtgcatgtgtaatacgaactgcatgtctacttttatacatgtaaccactaaccacttaatttgggtcttattgtgttgcctggacttgtgcattcacacttacatggctaaaacatttatcttctatgtgagtcagcttatttacttcagttttcacttattagtttctgtgagctaaaaaaaacaacaacagtttattcagtttctcgttttttcttgagcaccgtgcagttgtgcatttctaaactcctcttttactgctctgggtctggatttttgataggctgatttagaagagaaagctgcaagtatacatgtggacatcgtgaatcatgtaagtgaactctgaattgatttccgtggaattttattatgctttatttttgagtttagaaatggaaagctcaataacaaattggttgtctgaggcaattttaaaagagcggaagtggctttacatcttattgactgccctagtgaatgactcagcaagagatccttaacttcctatctttagttcttaactacaaaataaataccctatataattgacattagcttgttttcaaacttgtgacctattttaaattattgcccttttgataaaaatatgttttgcacttatattttggtttgatacttaagtattgtctatatcctaatcttgttctgcagtaggtcgaggtactgtctgttcccttctctggaaataatcttgatgtttgactccttatgctatcttcattccaaattaaatttcttaattttagacacagtttgaaacctgaaagcaaattgttatagcaaactaaatacttttgtggttcctacaatacaatgattgacaaggtttcccttttttcagtggattgatagagaacttatgagactggaaaaggagatcgaaagagcacatgagaagggttggcgccaagaatatccttccaaattgtcttttatttgtggcaataaacttgtactccctccgtcccaatatatagcaacctatgatgggtctcatcctaggttgctatatattgggacggagggagtagttgttaagggtttgtctgattttcttattggactgctgccagcattttttccttgtaacatggaagaattttattatagttattccttgaccaactctattttaacattgcatgaactatttaataaaaaaagacttctaagcacacaagacgaaagacaacgtcgtcttgcagaggtcccagaagctattccagatacagaagagagtaaaagggatgaatttggagttgctgcaagcaaccatcttgaagaaaacaaaggttcaaaaccttgaaattttggctcttctatttttttttcgtgaacgcaaattttggctcttctatgaaacatattttccttcccatctgttttacgctaataattgtgcaaagtgatacatcatgtaggtgctattttgctcttctgatctatgtccatctagaggttgaaaacagtaattcaatttagagcaaatttcattttcttatggaaaactatcaatgaaataccacgaggaagtagtttcacaaaagtacaactatagttgcatacagtgttgcaaaactacattttaaggataatgcaaacgttcttttgtaaaacagtatgcaacccaatgtaagtgttttgaaactattgttaaaagtgtggttctttgaatatttttgcattaaaagcataggattgtgaaatttactcgtttgaatatctcattgacttaattttgctcctttctttaccattgtgtttgtttgtattctatactctctattttatgcgttgagttggcagatagattggtcatggttattaaactcttttcttatttagcttcacaatcatccctgcagaggcatttaagcagaaaaatcctgagaccttacatgcatgaagtcatttgttccgtgtgatcattttgaaataccaacttggaattgaattctttcactagttattttccagttgcagatacagaatgtatacatcttgtcaaattaattcaataaaaatattatgttttaaaagttatcctcacttaattctttacaaatatttgggattttacagttttaaaagtaaattatggatctgttacatttttaaaattaatgctggatttgttacttttttgaacaaatactggatttgtttgcaatacatcatgggggttgcttgacattggctgctgctctgcttacctaggtagagtagtatatagagtagtactgtagctaacttgcacacacaagatggttttgtattacaattcacatctgctctgtttaccttttgaagctactaatttaacattattctatggatgtaacatatagtttatagttctaattgcctccaatactcagcactcagcagtgcaagaacaaactcgagttcattagtttcgcatgcactaagagctgttccctgcaaatctgctgtaaccatccatacttgagactggtggaggagcatataagacacatcagtagtatgttttcgttatgtcacaaaagggtggccagcttaaaactcaagtgccatcaggttctttagattctcaattatcacagaacaatacagaaatctctactattataaaaattgaagatgtttttgctggtactttggtacgtcatccgtgtatgagtcggtttttaagttcgttcgcttttggaaatacagatctgtagttgagtcgggttttaagtgcgttcgcttttggaaatatagaaggaatcgtataagaaatctttttaaatgaactcgcatgctaacttgagatgattggactcctaattgcagctcatgattttctagaaaaatatatatccaagtgaattttcacagtgaatttcaccttaactaaaccgtataacaataataagattaaaatagttttcacccgttgcaaggcacggacattttttctagtataactataaaatagcagatcatactgtaatcttagcacagtaattttgctgcaagtttactgcagcaaccgaagggtcattgatgatgccctgccaacttgtattttaatgtaatcttgacttgataagcttgataagtgggtttaggccagtttgtcataatatgctgctgatttttttgtggcatgcaatctacctgtatggacatggatcatacgaaacactgattttgtgtgtcaaaacaagtattaaatcctagttgtaagtagatatatggcatgtacaaaattgatgctataatcttttttttttctagaaaataatgctttcgctttgtttacatatatattgtagatcctaataagttcttgaattatctgaaccacaataataacaagatcgatggtttacagcatttttctagttcatattattgtagtagtttctaactagtcaagagtgaatgtgagtggtaactctttcttgtcagctttgcccatcgagtgttcctttccatttcgtgtatttgctattaggcacttgtaccttcccccctaatttggttgctattatgtaatgtagtttttagtattatgtggaaagtggaactaatggcgggcttgcttttgccattaagagttccattccatttgtggtatttctattatgtacatgtacctttttccctaaaatagttgctattatgtactgtagttttttttttgttattatgtggaatttgtaactgatagcaggtttgcttgctctcttttaacactgagaccttattaagagttatcttttatcatctccaggtgcaacagggcatgtacctaattctgtgaaagttctaatggaggattcacgaggtttgttttcataacaatcagatatggtctgtgcagttaatgcttagaagaataactgtactttgtgcttgacatttaataaattgctattcacatctcttatctttcccttgtaggctagttgttattttgaacttggtcgttagtattagatagaactaaagcacttgctctattttaacactgagaccttaataagagttttacttctctcatctccaggtgcaacagggcatatagctgattctgtgaaagtacttatggagggtttaccaggaggtttgttttctagcaatcagatatgtactgtgcagctaatgcttagaagataactgtacttctgtactttgtgtttgttctgcatttctgcaaatgtttggttcaaggtgcacctaatgatttgtcagtatggttatagtcctttcccccctcttcgtgcttcgggggaaggttttggggggggggggatttgctatttgttactcttgtctttccctcatacattggttgttattttgaacttagttgctagtattagagtgaaccaatggaggtcacattattttttatgtgctgagatctgcgcccttgtctccaggtgcaacagcacgagtagctgatgttttcaatgttgatatggctaaatcacaaggtttgtattactaaatcagtcatgatttttttgcggtagttgacacttttctgaatatttctacctatattcactatgtttacttcattatttgttttttacaagttttatctaagcttttgtttgagcttttttctctcctcatgtttcattgtatctgatattattttgaacttcagttgttagcagtagatggaacagcctcagcccagcctgctctctttttaaattctaagtcgctgcctatccttcttatttctaagtgcaaaaatgcaagtagctgaacctttgaaagttgctatagagaaatcaccggaaggttttgtttcatgtcagtgtgattggtgctttgttttgatcatgtctctaccttatctaatatttccaaatgatcatgttttgccccttttctcctcaaatatcttttctttggaacagattaatcttgattcttgagatagatgtaactaatgatgttttaccttctttaatttctttgttcaagatgcatcagggcaagtaactgattacttggaggttgttgaagaggaaactccagaaggttattctgcgcctctgccttttctcaaatattttttcttcgaacagattaatcttgatatggatgtaaccaatggaaggttttatctcctttcctttttcggcttcagatgcatcaggacaagtagctgatatcttggacgttgttgaagaggaacctccagaaggttattctgtgcctctgccttctcctcaaatattttttcttcaaacagaataatcttgatatagatgcaaccaatggaaggttttatctccttttctttttgggcttcagatgcatcaggacaagtagctgatatcttggagcttgttgaagaggaaacttcagaaggttattctgtgcctctgccttttctctaatattttttcttcgaatagattaatcttgatatagatgtaaccaatggaaggttatatctcctttcctttttttggcttcagatgcatcaggacaagtagctagtatcttggaggttgttgaagaggaaactccagaaggtttgttttttcattaaacaatcatataatattttgggtatcatagctggctaactgctacttgggttgcctctaggagcagagcatctgagcaagtagatactacttgtgaagttgctttggaatgtactctataattgattctttgaaccccactttcatctattgatgtagtagcacactgcttttgtgttgaaacagatatgaaaatatcatataacttccaatcttaacaaatacaatcaacccaatctaaaaactgaacatatacataaagggaataaaaggggaaactattactgttgagttttggagttcaaatatccatggtggtttatcatactaaggactatttccactgtttgttttaggattttttttcaagctaattaaacacccaaattagaattcagcatgatagcacttaatcagggttaagcaccagatgaatcccctaaagatctctattgagcgtaaatcaatgaacaagcagaaaacctctatgcagcagtatatctcaacagcagtaataccctgttataacatgaagatatgcatgttttcatgggagtaatatgcatatatccacatacagatagtttttctatttacgatgatcaacaatgatctctgttgtccagtgtgtgctcttgacattcaatcctttccctgaaatatggaaatgcatgaaattggccagctgctattgttggatttgcatccttatggtttccttttttatgttatttcatgtagcacctggtaaagacctttgtaatggtggcattcctgggtctggactacaaaacaaaatgcacaatgctcaaggttttctactcactccttttgctagttatgatgggcctaatgaatttctggaagtttctagttgctgcatattgagctaacattgttcatttatcttttaatttttcccatcgattataccttgattccttgcattttgagagagctcagaggtgctactctcaatcctgtgattgctttactgttgatttcctcttctctaaccaagactaatcttgtttagatggtggcacggctcaaggcagcgatatgtgcaatggcggaaatacctcaaggcgtctcaatgatcgcaagagtgttatcgttatcgactcagacagcgatgaagacgaggatcctcacccagagcaacatgaaccagaacgtgctgctcctcgggcagccatggacgtggtcatggctcccactcatggtgctccggtagccatgaatgggactagtgctcccactcttccttgtgctaagagaggcaagaacgggactaccgcgcctaaaggccgtgttccggctatcgctgcacttcacgcactgcaatccatgaatgcgccaggtgagcatgaatacatatggaattacgcggatcctcaggggaaagtgcaagggccattcacaatggagcatatgcggaactggcaccggaatcgtttcttccctccggacttcagggtgtggagattaggccagacacagaatgattccgtcctgctaacagaggccatgggcctgaaattttcttcttgacctaaataggctttttttttttcgttccttgcgttattcaacagtgtagctgaaccttaagcaggcatcgctgaagcttgagttgatgtaaatgtttagttttggtcataggcggttcagtggagatcttttttttttctttagtgatgttttagcagattgcaatgtctagcaaaatttgctaaacaaggcaaacagaaatggacagtcggtttagtgatgtttagcatattccaatgtcagacgctcagagccccatcaaacaaacagcaatggatatactccagtacataagttttcacagttatttatacagcattggagtaaaggtttattttatcgactttgcttttgacaatttgttttttcgattatgtggtccgttttaactctaatagcaagctaagcctagaaatttcagtacagaagtgaactaaatatcgtgaaaaccatgtatacacaatagatgggtcttctttacaggaagcaacttgtgacatcaatcatttggaatcactaccagaaaaaatatgctacgactaggatggaatatacatctcttaattgcccggccaacaaggatcatggaacaataatcagaccgccgcattgctgcttaattgcgtagacttaccctctcccaaccctgacgtggcgctggttgcgaaaatagcttagaagaacctgagcctgcgcataaatacgtataggtttgaaggaagttttaggatagaaatgagcttgtcagttttaggaaacaagattataatactaaccttctctcttgcacgggctgtgcctgattgcgacaatgcaaccaaaggtggcacgacgccttcttgaagaaccagggtgcaaaacctgttactgtttgtgcagagttgtagcagggcagcagcggcattctcctttgaacgtgcagaacccagctcaacaacctcaaccagtactcggatgcctcctgcctgagcaatggcattccttccatcatgcacagtcgcaaggtttgccagaacagcaacagctttatcaaccatcccagcagctggatccatcagctccaccaggtggttgacagccccagcctgaacaatgcgggtcttgtgttcatgaaatatcgacagattgaagaggcagtagctgcatccttcttcccttg

SEQ ID NO: 40691 - DNA, 7945 bp, Oryza sativa
tcccaatcccattatacaaataatgcctcaagagactatgcagtattaacaatggtttgaccctcctgagaggtttgaccccgccgcctcagctttacgttgctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggcccaaatgatgacactctatcatctgaatcagagttttcatgtatcaaattataatgatgactatcatccgatgcgcactgtgcttttggatgcaatgcagctaccaattggcagtgttctggtgatccagacttgtatgcacttgcacttccatctgtgatgttgagggaaacagggaagcacaaactcaagagtttaacaggatctggtagcattataccatgtacctcacaccaattttcaatcaactgtttgacagtgaagttaggaatcaatttggtgtgtcccaatatttggcgtgtctttggacaaatgttgtatcccagatcaaaccattttctgataaaaacatgctcatacgtttgaccagatgccacaatcactggatccgacattagttcaagggaaagaggacaacaaaaatcagcaggaatggtcactccattaatgctacgtgtttgcttttcttccacatgtttgtcaagcatatggttgactaattcaacaatatcgttaatatcatccatttctttgttatcttcatgattaccttttgttttaaccttaacaagtgcaacatattccatcagcaactcctgatttgtggataagctcaaagtagtttgaatctttccaaattcctctgaatttggcataacttcccctgctaaagccctggaagcctccctaatgacatctgaaatttttccacagctatcgtgttcaagatcctgcaagttgcaagaagcacactgataagaaaatcagatgtcaaaacaatgtcactgagaagatgtgaaaggattttttttatcacctccaaatgcattgactcaatctgcatgagagaattgacaatttggcataattcgaatacatatatctgcatcttggcaataattgaatcagcctgaataacctgcacccaatatattactcatagtgagttatttactaagtagcatattaagaagaataataggggaaatcctacttggatggaaattaaagcattgtatatgtagtgactaatgagggagatttatcatggaaaggacaaagtagttacaaaataaatcttgctcatcatttgattccagcctccaactagctcagtcgcttcattgatggtagcgccaagttcttcaagcactttacttagttcaccatctggagtaatctgaggaaaagctctgtttagggccacctccaagtgatcaaggatgccatccatcgtttggcaatatttcttaactagctctgttttcgaggcattgcttgaagacagcacccggaaatttgaaatactatcgagtagtgacaatgacactgaatccatcacctacataaacaaatcaaaaattaagttcacttcgggtgcggagacaaaggaacggggaagctcaaacaggctcagagtgactaaacaaacaagcaggtgcattccactgtcattcgaagttatgcgtaagaaaaatagctgagtaataacaagcaggttagcatgcacgtttcagtgaaaatgagctgctagctaacttccaagcatgactaaccatgccttgttatttatctactatatatgtgaactaagatagacataaattccgtgcttatacctggaacggaaagcaacaaatttaggcgtgatagcatcgaaacatctcgtcagtgtcgtaaaacaattggtgatcatcagaaattcagaactacttagtccaaactgtatacaaacaagctcaccgaacacgcatttttgccccaatacaagcaccgaagcactatccccacactatcacaaaccctaaccgcacagaaatctcgaaaaccccatgccgtacttgcccaccaccacaaacaaacgccatcaccacgtccagtacacacatacatccaccaccaccagcgcaccgaactaagctcaaatcttcccaaacccaaccatggcgagttccaccatccaagcacaaaatgcagcacgaagcacccccaccccccccccccccaaccctctccctcgatcccccaccgcaaggtaaccaagcgcgatcacaccacgcgcgcagaacagagcagaacagcagccagagcaggagaggaagccccgttacctcggaggcctccaatggaggggggaggaggaggattcggactcccgtgtcgaggtgctcggggtggctcgcgcgaggcggaggcgtctcgcttcgcttagtcgcaagaggcggagaccaagcacgagcaaggcgaaggcgacgagtcggggtagcgtgtgaacacgaggcagcaacgacccaccccgagtgggggtcgtgcggagacagaggccaaactagacccggctcaccgtgaaccgggaacagtactttcactgacaggtagggcccatctgcaggtagggggaggcgtacggtagaccgggtgcacggggtgggcggatgcggctgcaggacggcagcaactgctccccacctgagacccgagggccccaccggcagtctcgcagtgctgtagtaccggacctgcgccgactgacgggtgggcccaccgtgttcctccctcaggaggtgggatccccacctcgacatcgcttttttgtgctcatgcgtcgagtcagcgcgtgagccgccgtgtacggaccgaggtttgtgtgctcggctgtggctggctggtgggcccggagaatcactagttctggccctactctgctagcgtcaggattcaaaaattgagcgcatacgagggctcgtttagtcggtgaaatgatgggttgtcacattggacgtttgatcggatgtgggaagagatttttggacatgaatgaaaaaactaatttcatagctcgtctgaaaatcgcgagacgaatcttttgagcctaattaaaccgtcattagtacatgtgagttactataacacttatggctaatcatggactaattaaactcaaaagattcgtctcgcgatttacatgcaaactgtgcaattagtttttctttttatctatatttaatgctccatacatatgtccaaagattcgatgtgatgtttttgcgaaaagtttttgggaactaaacagagcctgatattacaggagcaaagagcaagtttaacagtatagccaattactagctccaaatcatctatagtcaatttaatagccaattcatacaatagttactataatattaatacctaatcccacttgtcatacacacattgcatcttgaagtctgtgctgcagctggttgtaaatctgtagcccgctgttcttctctatcctattttatcttcttaaaatatgtttatagctgacttataatctgctattttatctgctctaatgtagctatttctagcacagtaacttagttccaaaataaagctatttcttcacctacctcctcttctcaaccaattacaatcattattcttcatctcctttctcttttcaaccaatcacatacttccttcaatcattctctcctactttctcaatacacgtgccaaccttaaaaatgactatatattaggacggataaagtagtatagtagtcctagttgaattattaatatatttttctgcaacaaaagaatttcgataggttcatttaggtagaaaatcaaccgtagaaacattctcatgcttgtgaaaattatgagcatcttttccatagaatgtatacatatacccacagataactctgaaacgatgagctgctgttaagaaacgacacacggggctaattaatcaagtaactaaagtagccagcttaattagcatttatttgatccaaaggacaatgcacgcagaatgttgaaacctgtccgtgtactaggaatcacgacataacttgctaattaactacggtatcctgccctgtcccccattagttcatgtatgcatgcatccagacttacttaacatgcaatgccactaattaaagcagagttagactaatctgatgtgctgtacctcatcaccaaggcaattgaggcaagtaggcataaaactaatcatatggaatcatccagatcgccaatacaaaattacccccaaactgagatcatggagtgttcggttaaccgatgctttcatctctggagccaaacgctaatcaggctgcatataatatgcacttccttgtgccgagtgatcaagagacagcctgagtgaatgattaaactagctaatgcaaaagagctttgattgctttcatctttggaagcatcagttggtcatgaatttaaaattaagcctgtagcttgcagagagcagcttaatttagctgacacatattatatattgatccattgatcaggataacaaagtcatggtggttaaattaatttaagctgtttggatattatatatacgtggtagtggatatgatgatgcccccagtacttcatgcatacgtaaacacgttgcttctagatataatgcatgttaaatatgattctctctcttggtagctgatacaaacttttaccgtagttggttaacgtgtctttcttgacaagttaactacataaccatattgatcatgatgcatgactgacttaagcccctacacgctaattaaaggtttgctaactgaattgagtagtatatctttcttacagaataatatatatgaattaattgaacctgatagttatatatcgttcctccgtttcgaataacttttgttttagctttattttaagccaagcatttctatctttgacttccaacttctagattttttttaacatcgtatttatatattttaattcatcataataaatactttcaaaatatgtaactttcatgttgttaaactgtacaaactcttagaaattaatagttaaagataaatatgaaatgtttaatttaggacgaagctagaatgacaagtattaattttatttttcctagcttgtaaattaaatagtctctttagtttcatagtttgaagtgagttcattggattaaattaattactgtgatgggtacttggaatatatggtagatagaaaatgtgtggacattaccaaatgcgttatatatatgaccgaccggatttatatatcgcaatacagttctgggcgtttggagttcaattaaaccatgcatccattgtaaattttttagatactagtagtagctaaatgccagtgcgttacagcggagcatgaaaatagcaaaattaaggccttgttaaaaaaatattttaattgattgaaacacaacctttcatcttaacaaaacaaataaaaaaccatacttagaaaattgaagatagttcagacgactcccccatattctaatatcttggctcccatgtcagtaatggtgatggtgatgactattatctttaaatagtagtacatataatggaaactaccagttacatgtttttttagtggaaggtgcatatatgttaaaaggtacttagtaacacataataaacaaaaaaaagttaattcttatgcacgcaattttcattaatttgatttttttaatgtttatggggtgggggagtttagccacctgaattttcattgagatggataaagtggaagttacagggtgataatagtcatagagcatcatactcttagggagatacggagtagcagagaaaaaccagtgtttccactgcgtaattacagggcgttctttctcattcattcgctccgcccattctttaatttgtcattcattcgctccgcccattgttcttagccatatgccagctagctcccacgtgttaaagatttgtcactaaaatttccttagctagttcctttagtctaaccggcctaaaggttgattagtggttagaattgttccgggtagttatggtacgtagaattaatttggaataattttggatggcactagagatatgatgttcctttcatggcttttcttctttaataattatataagtatataccggatattgattaatatatgaattaagatgctgtgtgtgggtgtgcgtgagtgcgagatgagtacgaagacatcaatcgatcgaacaacccaagctagctggcgacccaatctttggctgcatatatgcaactagctcggtgtataatacagtgtgtcagcatcacgcatagctagcactggcacgcggcaaaagaattcctcggaaggttcggtgtgttaaaaacgtccagattaaccgaacagcggaggcaccaagtacagggtaaagaagagataagcacgctgtctacattaccccgtggaatatatttcatcaaaagaaaaaaaacttttgacttgatcatatccagtctacacgacgatacgtacagatggcaacctgcctgtgcttgcatgcatttttgggctccgatcgcatcgcgtacctggcgtttcgagcacgtacgaaacgcaactcttcttctcagatgtagatgctctgcgatattcccccgccttataaaaaacaatctattacacattctactactataaatctaaacaatactataatatattaaatttaagacctagattcgtttttatgggacggtaggagtactacccatacaatagcagtgattgacacatggacatgagcggatccagcatggaggcagcgaggtcttgtgacccatcagtgtgaagtcgtgaagaccatgagagtcccacgaagccaccattataattttttaccatatatgtagatgggagggaggattaattgtagtttttatctagtttgttcagatttctctactatttctttctagatctgccacgtggatctaaatccatacgtcggtgtctattactgtatcattagtactgtagataattctcacttcttcttctcagcttatcattctctaatccaacaaaacattgtgacattaattagatttaatgacacgtgttattattttggcacgagttgataggagtacatgataacatgatcaaaacattcaccgtctcgatcaaacttattaaaaccgcgcgaacggtgcaacaaacacgagagagaaaaaacaacaaagaagcaagagaactcgtaaaacctgccacgaaagtcaccattaattcctcgaggcgacacgtccatcatcgaccacgtcgtgcaatatgctctgcacaaatagctcgatcgatccctggttagtccagcaaattaaaaaaaaataaaaataagcatattccaagcaaggatagacacggacatagcaggaaaaaggcaaagccacgcgcgggaaaaaaataaataattaactagcttgatctaatccaatggtgactgatcggtcagaaagcaacgtgggcgaggcgacgcagccatggtcatggaggagataggaggaagaagaaaggtggtgttgactaaccgcgcggcgatcacctaatcggcatctaatgccaag

SEQ ID NO: 40692 - DNA, 12200 bp, Oryza sativa
ttatactgtagttctcaaaaacaatattaatcgattgctttatctcgcaagctgatcgatcaatttacattcatccggtatgtgtgtcgccttttataactaaaaatggtataatgttgttgtcatttttagttataccgaatctttacgccattaaattttgatatgataacaataagtttaccatttgtccaaataaattttagctgttttgagaattttcgcagttaaaaactctatcaaaatttatctagcttgccatcacgtctaccaataatttaataacacgaatgtatatatgctaaaatttgaaaataccaagttctttaagatcaagagtgatatgttacagactgcacgcatttctacatcacgtgtcctatttcctatatgcgagttccaagtgcttctttactcggaaaaggaaaaagataaggaaaagaaaaacacccaagtggttcttaacctggctaccttttttacctttgcctttgtgtgcggcatctgaattgaatttgttgatcttgtgcgggtgcaggtttcggggtctaaaatgtgttcggtatcttttccgtttttcttccctggtatatgaactattaagcacgttcggtttttctttcatttaacaccttgaattttcgttggtcaaatgtgcaaactttcaatgttgacgggtcaatgagaatttattgtagttagatcacgaaatcgcatcattggattgtcatcaaaatagtttgatagtttcataattttttttcacgtgtaagttgtagctgtgaacttcacgtcataattttgtatgaaccaaaaaatatataaatgtaaaaaaatgaggaataacaacttaaggcggccgcattaattttttatttaaattaggaattgaaagttcaattttgtagcggatactccctccgtcccataatataagggattttgaatttttacttgtactgtttgaccactcgtcttattaaaaaaatttgcgcaaatataaaaaacgaaaagttgtgcttaaagcactttggataataaagtaagtcaaaaaaaataattccaaaattttttgaataagatgagtggtcaaacagtataagtaacaactcaaaatcccttatattatagaactgagggagtacttaacatggttaaatctatctaataatttcttaactcccctacgaagcttaggtgtagtgataagaaaaatcgagaaggattggtacaagttaacaacttaatcaatagattgtgcatatagcaaacaagtctatataataacacaaagagaaagaaagaagacccattttagttgatagtggtattattacccaaaaattaaaaatacgttcaatttagacctacttttataagcatcatgccagctacagctacagtcacagcctctttcatccctttttctttcttccaaaaaacgctcacctgtagtgatggatctatgtgaaagttgtgaggtcgaatgtcgaatgaccctacagcttcttcacattcattcttgagtactaaatttttcatggaaatccattcaaatctacacaaataatcccactgaaatatttaataataataatcgatctcacaaagtaactttatctaataatttattgactccgccactgaatttaagtgtagtgataaaaaatcgagaagaaggtttggtgcaaattaacaacttaaacatgaaattaaattgtacatgtagcaaacaacctttataataacacaaaaaaaaccattttagttgaaagtggtattgctaaaagagttaaaagtatttcaatttagagcaacatgccagctacggctacagtcacaacccctttatcctttttctttcttccaaaatacaaacgcttaccttacagtgatggttctatgtcaaagctgtggggtccgttgaccccatagtttcttaccatcatcgtttagagtttcttaaattttctatatttatccgttgaaatttacacaaataatcccactaaaatatatagtaatgataatcgatgtcacagagtaaatttgctggctctgccactactcacctgtaaccccccaactatgccaccaaacacacataactcatcgcctcatcatcgtcatctatctccgcatgagaccgcatccttatcccaccacgtccccctcgcgctcacgcgcacagcaacaaagaaaaaaaaaaaaacccgtcccttttccctcgccgccccaccgctcccccaccccacgtgtcgccggcccatcggcggcggcgcctgcgtgggccgtgtggcccaccctgcggccccttcccgaaaacggaacgccccccccctcctcccctctccacgtcactgcgcggtgggcccgcgcgtgcgtccaagaagcgtgacgtaagcagtgacagaatccgcgccgcctctcggggcgcccacgtgtcgcggtcaaacggtcagcgcggggcgggggctcgcatcgcatctgctccacgtgtgcgctatcgcggctgcggccgcacgggccacacgtgtcgcttgcccccggctctataaatgcccggctcctcacccggaacaagtttcaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccgtacgataatcctcctcctccatcctcccaatcatcaccaccatcaacgccgtcgtgaattgattgattgatttggtttgatttgttggtgttgtgtagggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcagggtaagcaaaaaccacacccaagattccatcactaaattcattactaaatctgtgttcatcgtgattattgattaatttagtcacctaattattcgcccaaaaccgcagctcgattcgaacagctggtggtacttctagatggatactactatttagatatttgatatatttattttgcaacttgtttaatcagctcatttcgctttcgaaatgaattgggaggataagcttagcgtggcccacggctttgggccgcagaaattaattggagacgttggctcatctcatctctagggccgcacctacgtggtgcaacttgcgcagccacgatcgaatcgttcgagcgtgaaacccattgccgtcaccacctcgcctcatccctttcagggaccaatcggtttttagccctacgcgcccctgcgatcgcgacgcccacgatagctaaatcccgaaagcaaataagcagtaatcggacagcgactcgaccgggattagttaaacaatggcttgattaattagatgctggaatttggagccttctgataagtttagggcctgtttggcacagctccagctccagcttcaccccttctggagctggagctcagccaaacagtttcggctccaccaaaacggggagtggagctgggtggagctctctcacaaaatgaactagagttgtggagttgggtttaggcagctccacaactccactccagactcaactcctggagttaaatttaggagttggagctgtaccaaacaggcccttagttttgcacttggtactttaatttttttttgagtgagtgtaaatttgtttctaaactttgtttatgaatttgttttgtattggtgcagttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgtagatatctttttttttttggtagatgctgatgtctgtttgttagcaatggaaaataaaatgatggaaccatgcgaggaaaaagcgtggaattaatacaacagacgcatttattttccaaccgagctgcacatcactacagctggagatgatcgatcagatgagcgaccaagcaaaataagcttgggcgcgaaggaaatcaaacgtgccgctctgggcggagtgaggaaaaaacgtgaggaattggagtgcgcgcgtagacgacatatgggagagacgggtggatatgcacgcattgaacgatgagtggtcggtcggttcaatgcgcacgtgtggggggcggacgtagttttgtctttgagggttcatggggcggtgcggttgacgacgttctacatgcggcctcgtgcttatcgcctccggttagccggcgtgttcccattcctgttctccaggatatgctcctgctatactctctccgtcccataatataacaatctagcctgattagacattttataatctcgtctcataatataacaacctaagactagattagatattttataatacgatgaatgaacgaaatgtctcgtccggtcctagatggctatattataggacggaggggtaagtatattgcacattagcacatataaatcaagtcatattaggcagattttattccgaagatttactccctctattttatattataagtcgtttgacttttttttcttagttaaatttatttaaatccgatgaaatttgttggagtaattttcatctgactggacctaactcctgtagaactgagcagcaaagcaaatagcgcaatggatttatccaggagtagtgaagctagccatggttttcaaaaaaagaagctagccatactagctcatctcgtctaatctaatccatcctgccatcgacgcttttcctcctgtactcctgtgcacagccacggtcccggacaaaactgctgactgctgcttccagagataagatccatccacccgttcaaattcactgcatccgtcgttctcagccggctgtaaacgcgcccacaaaaacaaaaaaagcggcgtcactttcctcgaactttccggcgacgttttcgtccgtttgcacggagaaattcaatggttctcacccatgtatgagtccatgacgaccccatctcgtctctcttcttccttcccgagatcgcgtcgccgtcctcggccgcatttctgacgctacgtttttgaacggaagcggcccgccgatcgtgtgctgctactgttcaccggtttccaacccgaaaacggcgtgaacgcctagtacaggtcgtatgtgaaattcttaccgggactcgggagtaaccgagcatgagcttgtttagttcccaactttttcttcaaactttcaatttttccatcacatcaaaacttttttacacacgtaaacttctaacttttttctttaaacttttaattttaatcaaacttctaaatttggcatggaactaaacacacccatgggctgtgtttggaaccctaggagtttgtttagttcacgaaaagaaaatttttgagtgttatatcggacatttgaccggatgtcggaaggggttttcggacatgaatgaaaaaaactaatttcataactcgcttggaaaccgcgagacgaatcttttgagcccaattaatccgtcattagcgcatgtgggttaccgtaacatttatggctaatcatggactaattgggctcaaaagattcgcctcgcgatttttcccataactgtgcaattagttttttaatttatttatatttaatactctatacatgtgtctaaagattcgatgtgatgtttttaagaaaaagtttttgggaactaaacagggcctaggtttccaaccccttttcctcgtattccgtacacacgttttttaaactgttaaacggtgtgtttttatgcaaaaagtttctatatgaatgtttcttaaaaaaaattatattgatccattttttttaaaaaaatagctaatatttaattaatcacgcgctaatacctagggcatgggttaacaacctctatacacgaacaaagcctaaatggttagtcttgtgattgtccagactaatggaattttcctatagctataggcctcaagtgttagagaaggctgagattttgagatactagtacatggctagctggtgatcaacaaaatagttgggctcccaacttcaacttttctgaattttgtatactactagaaaaatatttttttcaggcaaccaaaacacgtttatgcaaatgacaagaccctccacccgcaatttaagacctatgaaaataattttcaccggcggacctaatgttaccccgtctaaaaaaagtattttgggcaaaaaagaaaaaacaattttcactgcatgcaagcatcggatttaaatcagaatcagatccactggaacaaacaagaacaacatatccacatgaacaaacaataacatgttacaaacgattttttcaagtgaacaaaaacgtttatgcatgcaggcaaactctctgcctgcaatttaaggcccgtgaaaatctatagttacgtaactacatatttaagttctagaaaagttacggctgttagaagggataataatctcctgctgccgaacgaaagaacctaggccgattgtacatcgaactagtagagcaggcaaaacaaggagagatgctgagacctgtaatgggcttcggtgaatatgctctatagccatgtgtttgttagacccaatatcagcccatcatgttcatagagcgaaatagaactaaatttccggcccatagacatggatggcataactgggccctatcacagatcagctggatgggaaaaagttcactttcagtctctgaaacgcaaaactttgcataacaactcctctgactattaaaaacgatgaaaatgactttcatagcaatattgatagtggtattcactgatatgacgtccatgtggtagcccaatcactaaatattaaacttaaaaaagaattagatgtggggcccatgtgtcagtgccctttcttgttcttctctctttcttctctccttttccccaaccatggtggcaatgcaacgcacgctcacgagccctcctgctatgccgcagccttctcctccttctccggcatcggcttaggcggtggtggcgccagccgtaggcatgggcgtggcctaccgccctccgtgacggtgaagtgtcagtgtcgctaacctcagcttccgcagtttgcagatcatgtggcattgcctagtgaaagcgttctagtaaattagtaaatgtgttcgcctattttaacagagatcagctgctgaaaccaactttccccattgcattttcaaatattcaatttgcacaatcatcacaggcgatcatcacaggtgcgacttaagggctgccaccgccgcttgctcccttcccgcggacggggagggtgagcttgagttcgatgggtttcaatgaccactgtcgctgccatcggaagctccttgttcgattctgaggggattgaagaggattggagatgattgaggggaataattttacatcacaataggtgtgaaataaatccccaccaattccttccttaaagggattaactgagtaaggcctaaagggggaagacgaagggagggagaggaggaaggaagggaggttgaggatgacatatgggctccacggaatatttccaacttccatgctaactcagcgtttctgaccatggtcaacgtaccatactaccatgtcactcaataccaccctcaatactgccatatgaattatttcgtaccagctttaggacttggtggggattattatacctgatttgcggttgaggaatatgagtaaaatccaaccaataattgagagagtaaaagtggactttttcctcaactggacgcatcgtttctctgttgggcccaagtccactgtgggtctcagttcttcctgtagaaggctaactgcaattttcagataaaacaagtgttaataaatcgtgtgcttttttttaatccaagctttacctactactagtactactcatacctgcactgtaccaatcgtaattcgtaggagtttgtctaaagagaagagaacaaacgtcttgtcagagttggtgattatctaagagcaaggctaatagtgaaagtagcagtcggcggtagtatttatccaggtcatctaaagttaatactatatattgtttatataaaagattggctctagattggctttacggaaacaagaataggtttaattgttgcatgtacaggtgatcaaaactaaactccatctctgtagcccatcctgcttcagcatgaaactaaactatacttggaaccacacactatgcatatgcacataagatcaagtagctgaactatagacccacaaagtgaataaaatatttcatcttgcctaatttaccgtgctatcgtccggcgcttgcagaagcgctcgcttcgctctctctcatgctttctctctcctctacgtatgataatgctgatgtggtgcttcttatagccggctgagcacaatactattataccttctctcaagttagattcagagagtttcagacggatcatgccggaaatcaaagagccggacgtgatcgatctggtcgcagaataaccggcggatttcctcttgcggttggatggtcgcgcaccatggcacggcgctagctagcggaagaaacgcccaacgacaagtcaaaaagcgcgtgtgcgtatgtgattttggcagaattggcgtggtgacatgtgaagaaaaaacaattcagcaagccgctcggttgtggagtgccaacttcgcaattgagtaagtcctccctccgtcaaaaaaaaaaaagaaaaaaaaagataaaccctgttttccatgctcaacgtttgaccatccgtcttatttaaaaaaaatataaaaaaaattaaaaagataagtcacgcataaaatattaatcatgttttatcttctaacaacaatgaaaatacgaattataaaaaaatttcatataagacaaacagtcaaaattgaacacggaaactcaaggtttgtctttttttttttgacggagggactataatcgtagttgatcgagtatgttccaagcaatggaaatctcaccccattttttcttttactagccgttccttcattttgcagtagggttacagtagttacctagtaattaaggagtactagttctaccttgataaactagattcttttactgacatggagtgttttaccgactcaaagcgatgattccttttactgtgctttgccgtttaccttgctaattaacttgctaaatttgtggctaactcgtggtaattaagttacgttgtatgattcttgcagatggtgttagacaacaccacatgtaagtagtacaatatgctgtgttcacgtgatcgtttggttaagcaagctacagcgagagcaattaaaggtcacattagatatttaggttgtttttagttcagtgtaaagtttgtattttggttgaaattagagatgatgtgactgaaaagttgtatgtatatgacaggttgatgtgatgaaaaaggactgaagtttggatccaaacttttaatctaaactttggaataggccgagagcctggaacaatgacaccgaccatagcgaatggagggaacatggtgatgtggatttatgttgacacctcgcctgatgctcattcgacgaatcagttgggccctcgtgcgcttgcgatctaatcctgctcgtaaaagtgtcttttggtttagctttggctctgcatgagaatgagagatccatcaaaagacagtgagtagagtgtgacactagatatccctacttaagctagctctgttgattaaccccaatctctatacagtacagctaccaccactgctagaggtcaacggaggcctcagcctaacaagcgatgatgactaattatgtactcccccctactctaatataagagaacatttgacacttacactgtttaaccactcgtattattaaaaaaatactttgtacaaatataaaaagcgaaaagttgtgcctaaagtactttggataataaaataagttagaaataaaataaataataattctatttttttaataagacgaatgatcaaacagtgcaagtaaaataccaaaatcccttatattagaggatagaggaagtagtactaataagtaatgcattagtcagcgaatggagttaaattataacaatctccatgttcgttagtagtggtcggagttaggagcagtttggcaagtctcaactctcaacacaacaatttggtcatttgcgcggcagtagaacacacatgaacaaggaaacaatgagattatcacgagctaatgggcaatgtgatgatgagtagtgggttagttggtaggtaggccgcgccgcattagtgacccgtgagcccgcacgatccagtgggcttgcccccaacctcgccggactctcccccccgcggcggccgacgccgacgtcgcgccaccgtggcgcggcaccgacaccgcggcgggaaggacgtgggcgggcctggtttccggtgggcctacctgtcggtgcagtgggcgggccgcgtgggggtgggattgaatgcgcgatgggccgtgggccagggacgctgcaggtgggcccgcgtcgtactactatttgtttatccgcgctgggtggagatctttccgttttggcccttcggcaaatccatattccacaccacattgctgccatatacgaggtggtgtttgacatatacggagtacgaagttgaggatgaagttataaaacgagaaagctgattaattatctcttaatactataaatttaaaaataaatttatttgataagtattatattcgtctaaaaaatatatgaatctaaaactagatatgatattttctagtataatatatctagacagcaatgtttagccgtttgaaaaacgtgccaaaaaatcaatgtaaaatcatcttaatcatttacagcaataatgcgatatttggaggacggattcgcagagaccctggatccaaccatttttggtct

SEQ ID NO: 40693 - DNA, 5200 bp, Oryza sativa
tttgagcttgtcagtgtacacctccattgaaaaagattagagctagaaagttgccaccatagctaacctcgtactctttatgtaatattacatattaactttccaatacattagcctcatacttgtccttttcttttattatacattctctctccgttttatattctaagtcatttgactttttttaagtcaaaattctttaggtataatcaaatttatagaaaaattaacaacatttacaatactaaattagtttcattaaattttacattaaatattttaaatatatgtttgttttatattgaaaatattactatatttttcaataaacttggttcaagttaaaaaaaattaaaaaaaatcaaacaacttataatatgaaacagaatgagtaaaataggcgacgcacagatatcccactttatactatcgttcaaatctaatttaacgaccagtcaaccttatctctttttaagtacctatagacttgcgttttaatactacgtactggctgattgacttttgacataacgcaattcagtttcactatcgcacgctaatagtactcgtacatcattcaccacaataaattgtacagtacgtactaataattagatccctgattaacgtttggtatgaacccaatttagcgtttactataattcacaacgactgtacctaataattataaggtttaatttaaccactactactaattatatagtactacttgaatatcgacaaacccaattttccaaagcatagctgcggtaatttcccaaaacatagaccatgtcattgttacaaatatatataatacctttttcctcaagtattcgttgataatgtattatttcagaaagcatcatcagttaacctaactgccttattcatctcttctgtagtagtattttactaacactcagccaatcaacaaagccttgccggtttatatacgaacatgagtcgatagttttcagtactaaatgtcactgtcagactacttttttctagctaagactaggcctttgagctttgttacctaacccaacagatggccgtctctttatgaatgggccgaaattaaagcccaacatgtatgctgtatgtttcctaattctgctgcccataaaatgacaaatttgatactgccactccaaaattcaaaattgatagcgttttaagatgccactccacaagagaaaaatggcaacaatatgcataaataaaaatatatatttagacaaatgcatgtcagagctagcaaacggaatacgcatatgcagcacactctgatcatatagtacccacacaccatgcatgcacaccacaaatgtatattaggggtgtttgggaactaggactaaatttagtctctctcacaaaaatataagtctctataataggaacttatatttttgtgagaggaactaaagtttagccccactttagcccctccaaccaaacaccaccttattcttcatcatacatacgtatacgtatacgtaggtctaccagcgtactatacgtacaataccacaataattattgtcatcttcatcgtcgtcgctcttacggaatacagtataattcgatcgaatgcatgcaatatttgcatccatggcgatcgatctagaggaggccgcctttgccggagtcgaccttgaagtagccgaggtggagagcagtctggtggtggtccgacgagtactgcgccgccgccgccgccgccgcggcggccagcatgctcaccggcggcgccggctggtagtattcccttgtgtcgaacgtcgccggcagcgcctccagctctgtccccgacgatgacccgccgccgaccgccggcgccggcgccatctcgtcgtcctccgccgcctgctgatcatcatgttcagctcgctcggcctctgccacctgtacgaatgtaaaatcgataaattaattactgtcagtagtaatatcactaatgacttaactaagttgtttaatttttacagtatgcaggtcatgattattgacagtgtaaggataactcaccttggctctcaggaacatgttctcgttctgaagatctgcttcctgcacgcgatgaggaaacatgaaagacattgtgtgatcatgtacattattgcaagggagaaataaattaaacaataagtaattaagcgtgtgcatatgcaaattttgatagtgtatctgagtattcgatttagcgaggcatacccttttctgcatgtattcgatctccgagaacagcagctcatgctgaaaagtggggggaaaaaatcaggaatcaaattagacatatatagattaattaatcagggtgaaattgatagtgtacgtgtattattgtcagttcagtataattaagcaaatccaactattaataacccctggtgaaatcatattactacacaagaaatttcttcgcataatttataaatctgcaattaatatttcaaagatcttcttgcattgttgacatatatataatccattgattataattagcatgtgctcatggtgtctcgattatatatattttcaccttctttgatcgaattcggctgatgcccttttcaagccgattttcaaggctcttgagctcctttgcggtcatattgccaatggactcaccgatgaggtgcctgacaagattatatattgcaattaatatatatgaaatatatgaacactttcagatatactatatacgcgttcatcatgcatgcatgacagcatgagatggatctttttttaactcagacatgagacgcataatatatattgtgctatagccataagctatcacaatacgagatgttggatttaagggcttaattacctgtttgcattctgcaaggtctgtatctggtggcgcatttttgctgcttcttgctgaaagtattgctgtgtgaagatacccagtactggattttagagggctcaagataacacacaaatctcacaatgtatgtagtatatttagttatttacgggtaaaatttcaggccaaattaaatatataaacgatgcgtgctatatatattatacatatggatatacagtatataaccaattaatgaatacaaaacaacttacatgagaattgacgtctatcactggagcggatcctgaagtgctggcagaggctttcttgtacctctcgattgttgaccttgtgctgaaccaaatgtgttgtcaaaacgaagcagtatagtttcacaaattattaaaccattgtttgatgaaaattagcaaatcttcatttttttagcagaaaaatgacatgatatataccgaaatggaactgaaagatagcttcagaaaccaacttcagcagaacataaaaaaaaaaaactactagtaaaatgcatgctgcatgcatgcatgtatgcgtatgctgtccccctagctttgctagagcctacagcacaaggtagcagaccatgcaatacttgatacacattcaaagattcactccagataggtttgcactacgacgtgtcacagatgtatatatatttgtggcctttacgttgcaccaaaagatgcagaggggccaaagatacatcatttgaattaatactccatactcgctgcaaaaacacaggcacagtcaatggcgttctttaacgctctttagcactgccaaggaagatgaacagggacaacctgcaatttccttccccatgcaacatacattctctctccgagagatagagaaatatcagatagcgagtacttgtcagtgcacataaaatgaaacgagagctttttcaggggccggcttgcctggcaacatttcaagactggctgcctgagacatctcaagactgaaagcttggaatggattactccttcaagtcccttgtgttctaattttgaccatggactgattgtggaggtataatttcatgaatgaacaagatctagcccaaggctgttacaggttgtccatttccaagatccacacaaattgcacagagatatactaatgtacactagtaataagctcataattaagcatctgctaactgacaaactacactactagtccgcccatcttgaatctatctcagcaaaacatctaagcttaaatgctttatgatcagtcacaacttaattatacacacacacacacacatgagtcaagtgtggtgccctttaattgtttccaattaagttgcagatagcaaattaattaaatgaagtgcaatggtggatggggatgcatgcatgatgcatacttatacctgtttacattggagaactcatagaggcgtcctcggctggagaagacgatgagtgcgatctcagcgtcgcagagtatggcgagctcgtaggccttcttcagcagcccattcctgcgcttgcagaaggtcacctgacggctcgtcttgttctcgattctctttatctcaatcttccccctccccatgttgatcaatcgatccaccttcacaaattaaacatgtacatgtacaaccatgcaacacctccctcttagcaattcatggcagaagcaattaagcaagataaagggagtaaaagcgcataaacttatcagcatataataaagcaagaaattcctagctatctagctaggaaagcacaacatatattgtttttggtttgttcagaggaaatattggtccaaccaaaatcttgaataatcacggatttttacaaattcatgtcttatcgttattacttagttcaatcgctaaacttcagtctcaagttcaccatttgaatcttcatcagcatcgatctgaagttctgaacgatctaacacgaaaagaaccttaactcaaagattcaagaaggggaaataattaacataacttcatcaaagatggacaagactttagagcaaaagaagaaatttcaggagcaaattatccatttgaacacctcatccatatatagcacttgaagaacccccccccccaacccccccaaaagaaccacaagttccaagaacaagaagcatagctagaagagggcaaaggagagaaccgcagaaatggcaacacaacaagatctagcaagcagcttgctgcagctgcttatgtttcaatttcccctttccatcagctcgttgcaggccctagggcttgctgtttctcaacaaatctgccccaaaagaacagcacaaaatggcgcaaagaaaagcaaatactactccatccaa

SEQ ID NO: 40694 - DNA, 25602 bp, Oryza sativa
  unsure (1)..(25602): unsure at all n locations
ataattcgtattttcattgttgttagatgataaaacatgattaatattttatgcgtgacttgtctttttatttttttttcataatttttttaaataagacggacggtcaaacgttggacacggaaaccagggtttgtcttttttttttttgacggagggagtatcttaaaagcacaggcgtccttcttttcttcccatctcaatgccaagtataaaaaaaccgcttcaaagaaattggtgtaccaaaaaaaggaacaaaaaaattgagccgtgttcatccaattcagtctcattgcaacacacggagccatgactagtgtaggctgtgaacaccttaattttaatttgactagaaggttattttaatcttattattgttatgctgtttagttaaagtgaaattcattgtgggaatttgattgtatatatatttttctagaaaatcatgagctgtagttaggagtccgatcatctcaagttagtatatgagttttttaaaaaatatatcttatacggttccttccgtattttcaaaagcaaacaaacttaaaacccgattcaaatacgtatttgtatttctaaaatcaaacaaacttaaaaaccgactcatacatagatgacgtatgaaagtaccgacaaaaacatcttcaatttttataatagtagagattaaaattgtactgactattgagaaaatacgttgtttgctaaactttccactgaaaaaaaaatgggtggactccttaatttgattaaaattgaactgactactgataaattactttatttgctaaactttccactggaaaaaaaaaaggcaatccaggatatgcttttcagccagcccctgaacaaaaatgtgaaagtagtagtagtacatagaactgcagaagcatttttagtccttaattagaggaatcagggtgcagatatctgcatgtccacaagggtgctagttgtttgtctggccaattttttataggttccgattcaatcaattaaatttgaaggtgtctgtctatatatacaacggtgtgcgggggcaagttcttcataaccatctcaaactgaacttaatcaacgaagtaactttcttcacttattatatatggacatcccaaactgaactgtaaagtcgtaaaagctgtcgatcatataaatagcacagattaagatgcgtacacgatgtttctactatgcactaatcaaggctaagctttttctgaataacacacacacaacagagtgatgcacgaattcagacgctacagaaaaagtcgcagctcaagctagccttgtttagttcctcaatgatactgatgattgccatccaacgacctgcatatatacatgatgtatatttgatgacctattgattactatcattctatggttgatatgatagctatggtctgctgctgaatttttgaactgacattgatgcaaatatggatggagattaagattcaggcagctggtaattaacgaactctaatatttgtacgtttgcacattggtcatgtatatatatatgtagacagacacaaacagaggggtgctgtatgcagacatgcatattcagctagcaccacaaatccaaaataaaaaaaaactaacaccacaaatgttctgatctctctccattcctagctagaatagattcacacttgccatttcgctgcaaagatacagagcatgccatcttggcccatttcaggcagcttgctcacactgcaaggctctctgaaactttacagccgctatctattttggacacctaccaggaaataactacaggattaaataggatatatagatgcaggggtaacaattaatcacaacgagtaaaaaaccatgaacttgtaatgattttttcatgtgcttttttgagggtgaaaccgtagaattgagaatacccatatgaaattttcaatcatgaatttacctcaaaaaatattttttaaaaaaataggaaaaaattacctaaagataaatcaatcgtgaaagcatgcatttcccatagtgttgcactgttcgtcttgagcttgcagaaaaagttgtaaccagattttcaggacccttcatcagtgccattcttctttgctgcaacaaaacagcaggtgacactttatatcttctcaggcacatatggcaaaatctgctcccaaccgtaggatcagagaatgaacgatcccgatttaccctctgtcgccgctgcctttcattcagatagctaaggacacctcaacatcacaccatgatttcacctcctgacagttgcaacgcacttagcgcccttttagccaaggaaatggaccacaccaacgttaaatggtggtcaaatgcatccacccatttttttgcctctttcttgtgcaaaacttccctttttcttaagacagtggaagcattttgtgcaagtttcctaagttgctgagaaaggagtccattgctaggaatgtgtgatgcgtgaagaagaaatggatcttcagttggattcctggagatggagaaggagaaggaccctcctccaatccacctcaatgccctacctgatttatgggtgcatgtggaccatctgatgcaatatgctctgcctcaatcagaaagtccatcaagccatccaagtgcagaagctagtcaagtttgcttatctacctaactctgtattaaggtgtatttgcaatattccatatgaataagcagaacattgcaaaaaaaagatttaagggttttttttaaaaaaaataaggcaagattttgccttgtgaaatttcagattttagtgcaacttcgacagataacctgccacaaatcaagtacaagcacatagaaattttgtttcaagaacaacagaacaaaggcactgtttagttcccacacaaaaaaaattacaccctacacatcgaacgtttaaacacatgtacgaagtattaaatataggctaaaaaaataactaattgcacagattgcgattaatttgcgagatgaatcttttaagtctaattgatacatgatttgacaatgtggtgttacagtaaacatttgctaatgacgaattaattaggtttaataaattcgtctcgcggtttactgacggattctataattagttttttattagtgtccgaacaccctatacgacaccctatataatacccgatgtgacacgtaaaaaatttactcccctgatctaagcaccccctttgtggactcatgcaagatggactgcagtcagtgcaaaacctgcaaaatctacactgaaaataaaatgtgctatgtgctcaagtgcactcaaatgggtactactactacttgtttgtcaggtactgtcattttgaggccctctttgtttaggcttataagccgacttataagtcgaaaagtttaagccaaaacaaataagcggcttttttgtttggcttttctgaagtcataagccactctaacactattaagccaaaagctaagttagaaaagcttttttggcttatattaggtagatgcatgactccaccattaaacttaggacattaaatccaccggcttataaatcatataagccaataagttgacttaaaagtctaagccaataagtctaagcctaaacaaagaaggcctcaagcgaaggggtacacctcgatgaatgccaattttcagagaatagatgcatgacttctttcagctaaatgaatggcacaatggaattcctttgattataggagcggcactgctttgctaattttctgaaagaactgaaaacaatgagtgagagatacatgaatagtccgctgcatgatatcaatatgcaccgccaacatgttcataataggcataaagcaatgcaatggcaagaagattgagacagtgatatgaatgttatgagtcttatgactagggatgatgggaagatgtgaaagtgtttgcgttgaggaccaaggaaatgatgctaattaacaatgtaaaataccagcaagattcagatgtgaacgtgtttgctttgagtagtgagtatgttggtgagttcgtcttatttaaaaatatacgtaattattattcatttatagtgatttgatttatcattagatgttcttaaagtataacttaaatttttatatttacataaaaaatttgaataataagatgaatagtaaacgtttaaaaaaattgacagcatcgtcagggccggccctggccctatgtagccgaggcgaccgctggggcccatgatggtggggggcccataatgggtgtgggggggtgcaacacctaatttattagtagtatagtacctcatccaatgttgagatcaatgatttttattcggaattaaaagtgttgcaagtgagtttgccagattcttcgagatgcagatttctatccaaatgtttcagttgcctatcaaactctcttaaccgtacttgtgacagtaactttagctgaaagaaatttctcaaaattgaagttgttgaagaactatttgagatcaactatgtcgcaagaaaggttaaatggcttggctatgtgctcaaccgagaaggatatcttggacaatattgatcttaataccgttatgtcaagaaatgcccgaagaagtctctttttcataggaagcaatgaatatgatggggttctattcttcataaagttaataaataatgatattagttccaagttacaaatatattattattttggtcgactttatttcttgataattatcagacatgttaaatttaatatatggatgtatttgttttcgttttacaagtaaaattagcgtctatatatatcataaaattttatatataacttagagggctcatcgcgatgaattcatctagagccctcaaaatcattggaccggtcctgagcatcatatattaagaaatgaaggaagtactacgataaatcaaagtcttgtaagcacaataatacaatatggggaaaatgtacaccgaggtaatgctgttacaacttacaacggcatgtgatgcctccctttggccggtcaacttgctatacaatggagatcttatgtgtatataaataaaatgtaaattcctaatagctgttgcggtcccgtagctcagtcggttagagcgttggtcttatgagccgaaggtcgcgggttcgagccccgccgggaccattttttattccacaattaattcagtgaagtttattttgcatttttcatcaatgttacccccaagtttattttgttttttcatctatgtttaccccaagtttatttggcattttgcatcaatgttttattccacaattaattctgtgaagtttattttgcattttgcatcaatgtttaccccaaaattttgttaagtttattttatttttttaatcgatgtttatccccaaaagctaaataacattattttgcattttgcatcaatgtttacccccaataattctgttaagtttattttaattttttaatcaatgtttacccccaaaaggtaaataacttgtagttttttcccctgtttataaatttaggtccaaatgttcatttaaccaacaaacccaatatttatcccttaatgtatatcacatatagtttttgtttccttgttataaatttacccccaaatttccatttaatccataaataaatatatacataaagcaataggaaatgctttttttaagaaaaaactcgcatttactacctctctttttaaatataccataatgttaattttttcacatgttgtttgattattcgccttattaaagaaaactactccatatgtctgaaaaatatttttgacatgagggaggatgacctatgaggtgctttatgcttaatttgtatggttgattagcatatattattggttgcatgttaggcttccagctaaaatctagtatgcttaaaaacaattgaaggataggtaatactacctccgttttaaaatgtttgacgcccnnnangtgtgancacatgttggactgttcgtcttattaaaaaaatttgtgaaatatgtaaaattatatgcctacataaaaatatatttaacaatgaatcaaatgataggaaaaaaaattaaatagtatgtaaaattatatgcctacgtaaaaatatatttaacaatgaatcaaatgataggaaaaaaaaaattaataactatttaaattttttgaataagacgaacggtcaaacatgtgctaaaaagtcaacggcgtcaaacattttgaaacggagggagtattagatccatttcagaataaattaatctatcacgagatgtgatatattctttcctagtactacaaattcatattccactaattgaatcacgattttaaaatttccacgaaccaccgttggtgagcacatgcagccagatagctctcgttaattaatttaagtagagcgtgatttttgaatccgatcgaacagagaacgaattcgccccaaatttagttggagacacgtaacccgctcaaagcgccaccgaaccataaccaaccgctctccctgccctccgggccccactctgggccccacagcgaccacccccacccacactctctctctcccctcttccgatcttattttttccattccgacccgaaggccgagccaccaacccccctcgcggccaccgacatgtgggccctcaccccaaacagcggtgggtcctcctgcctcccggcgaggcgcaccccgccgccgctcgccgccgccggcgaggccggctcgctggccgcggggcccgggaggtggtgctcgtggaggcgtcgtcagccggcggagcggtggcccaagctggcggtcagcgcgtcagggaggaagagcaagggcggccgcgacgagggcggcggcgacgagcccaagaagaacaaggcggcgtcctcctcctcctccggtaggttctctcggtcgattgaaaccgatggtgcttccggtttgtgcgtacttgcgcgattgggatggtgaaggttggggggtctttgtgtgggaagcggtcaaacctttgtagattcgatgcgggttggagtgatcggcgcagggggggtgaggtttcttcgttggaagttgttcaaattgagtcatgaaaatggttgcgttagaacttagaacacttactagacatgggatcgagattggggtttattatgtatttcagtggatttcttagccgtaatgtttcatgacgtttgggggtaaattttgtgctggtaatgaacgaattcgacgtatttacgattgggatatctttggagattgaaatgtttctggtgcaagtatggtgcaattggtgtaaaatggtttgctatgcttatttggtcgtagaaatgatcgaaatctgattatttatatgatttttttctctgaaggtttctgattgcttgttttgtattctagcttacactgctaaattagcatattacatgtgtttggcatttcttattttcttagtattagtataaaaagacaatgtaaagtggatcattggatgcgagctttatggaatgcaaatggataacttttgagttatgtggtggtggcaccgtggcagtttctttcattgtgttattaaaaataatatatatttctttcaatcctcataagatacatgtgttttttgtggaaaacataattcatgaacttgattgattaactagtcgtaggtctcaccaaatgaccaaatcgataatttctacgtacaggaaaaggtgatgcgtctgctcccagtggagatgtttcaaataatgaactgcaatccaatgacacaatgtatgtacctggtaacttgtcatattggagagacgttagagcaagctttgtggttccaaaggtatggccaatcagtttaaactaatttaatctaactgtggctatccactttttttaatgtaaatgaggttaataataggtcatctgttctttacaatattttcttgctagataatttgccgagattttggcttcgcaccttgcgttagctctattctaacgactacataacacctctgaaataatttgttgtcggtaccatatgggaaaggaagcaactagtcgatctctgtagttttagttgccctgtatgttcacctcagctttatacctatttttacactttctgaaaacatctatctgacaacatgtgctctcttaagaattactgaattaagacaaggaaactgtatcggatggtcatggtgacaccatcatgttataattattctagattcaactttccattctactttagattatcgtgaattggctggaacattttgaaattatcacatgtaccttgttttgacattctcactgcaagtaatgctgcaggatgtttcagcgtgtaattgatagttcacaagtattcactatgcttgtcctgaacaacatccattttgccctgtctagaaaaaatattttttttctccataagcaaagtaatatcctgtctctacataactataattggtgtttttgattatgtaatactatctcattgctgcctattctctgttatgttttcaaatcaggtgcaaacagtagatgcacatactctaccacaagcagctacggatgcaccagtgcactgtcttcctcggaagtgggcacattctattccaatgccagaatctggttgtgtgctggttgctgctgaagagcttgatggcaatggtacgtttgagagaactgtaattctcctcctaagattaggttcaagagatgcctatgacggcccatttggcgtcatcctaaaccgtccactgtatacaaaaatgaaacacgtgaacccatcgttccgcaaccaggcaaccccttttagtgattgctccctcttctttgggggacctgtcgacatgagcatattcttgatgaggactaccgatgacagaccaattaaggggttcgaagaggtgtcgccaggcgtctgcttcggtttcaggactgacctagagaaggccagtgctcttttgaagagtggcgcggttaagcctgaggacttaaacttctatgttgggtactctgcctgggattacgaccagttgttgagcgagattgatcaaggatactggcatgtcacttcctgtagctcaggcctgataagcgactcccttgcaacagatccttcttgcctatggactgagatattgaagctgatgggaggccagtacgcagaactgagtcaaaagccaaaggaagatggctcgtgaaaattcttgcttgctagcatagtttggcacaattgacgtgcttggtttgtacataattgggaataatctcgcccggtcactggccagggtaattgaacagtcctagtagtagtttcatgtggtcgtctttgtcctctgtattacttgaacaaatattatggagtactggtgatagaacggtgtgggctgtgaataattactggaattacatgcttccatcaattttctatgtgccacataaaaatccgaaattgagataattgccttggctcatttgaccgagttttcataatgctcagtcctgtgttcatggtgtgtgattactgatatttactgtacttcactctctaagtgactgttcaagcaaggcttaagtggcaagtagtacaactattgcccgagagattaaatcattaaaatgttttgcttttctagtcaaacgtgtattgcacaagattaagctaaacgcgtcaggcacaaaggtagggagattcagattgcgacagtgagaagcagatacttcagatgcgccacaatcctgcactcactcacgaacgcctttttatttcgtgccaatacccgcgttcgtttcagtacttgtcctcactactcgtctaatccccctattgattagtaattcattaattcacagtcacagcaacggctatggaattaaactactgtgtgaaaggaagacacaggaactcaaaagggttgaaaaaaaatgatagtggactttctgacagaactgcaggtaaatttcagactttcagtgcaagtgtgcaactattcaacgtttctgaatgccctggaggcctggactttgttctgttcttggcgagagtaactacaattactgcgttgttgccgttgtcatactctctgaagagttggtctacactcgagagtctaccggttttgacgtgagcagatgttacctgcagtacattcacaaccaggccatgtaataccagaattactgccaagtctgcgatgaatgcagcgaataaatttgaaaattgaaatttcagcaacgtcaaattcgtgttatggagagtatgtaagttgcagatagtggaagtgttttacgagtgctgtaactaattacagaaattaattattataaaaacaaatgaccaaatagaaagtcaaaaatcatcgaagggaagttccagtttggttctggaactttcagtcagttttgaggtcacagctatcgtcttcgtcggcgttcctggccgcaagcatggtcaacacagcatcttctcaattgcttatcagtgttttttgaactttattattgcatcagccaattaataccaatcttaatttttgttttttgctattttgtcactgcgtgattacatcaggatctccatgtcatccacgctaatctcctcggcacagacgagctgccgctcgccgctcgtcctggcgttcgcgccggcggcatgcgcgtgagcgccgtacatcccgcggcgcgccagctcgtcgtgccgcgccgtcgtcgcgccggcgcagtgatccgggcgcgcgtacgccgtcgccggcgcgggcgcgggcgcggcgtcccgcgccgccacgagctgcgcgtcggcggccatgccggcgtcggacgccacgcgctgcacggaccgcggcgacaggcgcgccacggcggcgccgccgccgtacgtggccgccgcgcgctccgggaagttgagcgtcgcgccgccgccaccgccgtcgcccgcgcctccgcggaggaagtagacggccgtgtcgtgcgcgacggcggcggcctccggcgtggcgtaggaccccagccacagccgtcccggtgccgggcacccggatctccgacacccacttcccccaccgccgccgccgcacgcccctgtacctgcaccgctcctcctcctcgccgccgccgcactccgcccggctcattgcctcctccggcgagctgagatcaacctcaccgtgatctctctccgttcttgacttaatttcaccctcgatttgattcgcgagcgttgggaaagcaagtgtacgtactacgcgtatatatatgcatgggaggtcagccatggcgagttgacctgctagctcgccgaatcgatcggatttttgcttgggatgtttcacttcgagagatttcgcgcgggaaaaaagttaaccgtgtgtgtgtgctgtgatatttctggccggtacgtgagcaacgtaaagctgaggcggcggggtcaaacctctcaggagggtcaaaccattgttaatactgcatagtctcttgaggcattatttgtataatgggattgggaaatgatttcccacccatcaaaaggtatctttaaattctaaccattcattctccatcttccatttagtcctaaccctttattcatttcccaattctaattccactctccatttcccattatccaaacacactctgagtgtctagaaattaattagttcaacccgattcaagtaacttcaattattcggattaataatttaaataaatactaagcatattctgtgagtttttaaatttgttttttcagtaggaaaatcattttaataaaattttcttcaaagtggttcatgttgatttcggagcaccttgttgttttttttttgccaataacaaaaaattgaatgtacatatttaacatattttttgcctgctaaacacactcacagagtacgttttttttaggtatgatcacctagctagtgcagcatcatccaagaccgtagagagttttgccttgtccagtgatgtgacaaaagactacagtagtagccactaacatgggcggcaatacctaaccacacaccaaaaggcatattcgtttcatttaggcggagaatgtctgaataattccattcatacaaaaaaaatgattaaaaaaacaagcgtccaacgaattaaaaagcatgaaaacgtgcggcaaaactgaataaaagcatccgatctgaagtagtcaatccctcccatgttgcaccgcttgttggtattgaccggaccgacagaccggctccagtgatttcaggttgtaatataaatgtcacctccggtttcattttaattaacgttttaaacaatgatacgatttacaaaatatatctttaaccttatttttctattataatatacacaataaataagtgcatgtttacttttattatagtgctttgaaagacaaatctatgttgttctagtttctttaaactaaatatttttaaagttattaatgctcaaagttataaaagtttgaccttaaccttgtctaaagcgtcaattattatagaaccggagggagtacattgtattatccttgacttaatgaatttcactgcatcagtatttatcacaagtaaaccatttactccttttcatcaaaaggaagtggcattttctaatatgtgcagtcaacaaattttaattttacttactaatatgtacttcctccgtttcgaaatatgtttatttttcaatcatcacacacatactaatataaaataaaaaaactataatcctcattctttatcaaatcccaatgcaactattattcgttttatttactctcaatacaagtatgtcctactttcacaaactccgatgtaatgattactttaaaaataaatttattttggaacagataaaataagctaaaaataaacttattatgggacatacggagtatttgaacatttcgaatcaacttttaaaaattggtctatttagatttatcgttaaatataattattataacttcacaacattccccatatactcatggtcagtagtaattcataatcaatctaatgcactacttcctccaactcagtctcaaaataagagtgcaaattaacaaaaataaaaaaatgcttaaaataatatcgatattgtttttatgtttcaaacatcgattatttatgacagaaggtgaaaccacgtacactactatcatggtcaagggagcggggtgcatgcagtcataaaaatctttactcgttcgcgggtggtgacgtaaggatattttctgtgacggtgacacggccggggtagcgtgtggtttggatggacagggaggacggaggaatcgagcaaagccgatacgaatcgaagctgtcacgtgtggaattgaccatccgatctcatctcagaccaccatgcacgtaacacgccatgcaagaaactttctttcttattgaccccccataggctggcctctacctgagactgacagtgggacccgcatgggaatatatatatatatatatatatatatatatatatatatatatatatatatatatatatatatcactggtagtttttttttttgctgggaatatatcactggtagtttgacggttaaaaacgggcattggactatttggggagttgtggtcggcagctctcgactggtcgaccggttattggtcggctgttaatttggaccctctcgtttggctagacatcgtcttcgaggcctggaaattttgtttgagctctgcttctcctgtagattaattcatggaaggtatatatgtgtcaatattgtgaattttgcaacagaccaatcatgtatagcaagagttcaagaccaatcatatataaggctatgttctttggtaactcattatggaatgattaatcaagtattacctaattttctctgaaaatatattaatatgttttttttaaaaaacaacttttgtatatatttttttttgcaaaaaaagatatcatttagtagtttgaaaacatgcgaaaaaaacaagatagttagattggtgagttgggaaagtgacccaaagaactcaggctaagtgtcgtccacttcctttctgtggtgttgttttgagcagggtagcaatgaaatgagctcaaataacgtgtcacgtaacagtataccagccaaatgttaaagcaggactgtcaaaataaagcagttaccattttttattactaaaatttccttttggactatccttatcttataatttcactttggcaatgataattttaccattgttatattttggatcattctaaactttcttacatgcataggtaggggagttctttggcgtgtagaagtcgatgtgctcaaggctattgatgtgttaaagaagagttgggtggcttaaagttaaacaatgataaaagaagaaaacatatcggcgccggtcatgaatttaggcatcttaccagttctatcgtacttattccactaagtgctcattttgttttaatattagtagtcctatatattattggtatcatattgataaaattgttacgtatatgtagaaagtgatggcaaaaatagattggtgacaatgtgattttttaaaattagaattccattgcaatgcacgggcaatatactagtatactcatatatatgcatgctaatttaaccattataatattaatgtaaatattgccaagagcaccatccatcgaaaaagatcacgatttatctgcttcagaatatgtagaaacgcattgacatgtacggaatattagcaagttttattttagtgtaaaaggaaaagaaaacaaggacgctgcagggaccaggagaaaaaaacgaaacaaataactcagatgatagacggcccatctgacgggtctatggacctatggttgggctggcgacccaactcacaaggacgtcacttgcaacacatcaaaccgacatattttaaagggaaaaactgtcgccactttattagcgttttcgaaagaaacacgcacaatttgatctccgagtccgtcacgactcacgacgcagattcacaatcggattcgggacagaggcgccgcctatttacgtgcagacgcggccgcgggcacacgggaacatcaccatatcgcaactctcgaggcaacaaacgcaccagacacgatcgactccatcatcatggagcacacgagcagcacgtccgcgcacgccggcgagcggccaccggcgccggcgccgttcggccctctgccggtgctcgtctacgaccacggcctcgacccggtcagccgccgccacaccgtggtccgcatcgccgccgccggcggcggcgccggcaacaccatcgccctggagacgacgcacgtcgtcgtgccggagctgacgagcaacgactaccacgtgacgccgcacggttgggtgttcctcagcgagccggcggccgccgggaccacgcggcggactcgcctgtggaacccaaccaccggcgagagcgtcgagctgcctcgcatggagcagctgctcccggcgaactggaagtgctacctctccgacgaccccaccgccgcgtcgtgcgtcgtgctcgtgctggccatgtcggagcccagcctcctctactgccacgtcggcgccaccgccggcggtgggtgggtcgcccacgactacgacatcggcgacgtcggcctgccgccttcctacgcgccgccgcggcgacagttcatctcccagatcgccgccgtgaacggcaggttctacttcgcggacaccggcaagcttggcgtcctcgagttcaccccatcgccggagttcagctacctcgactacccgcacatcgagttccccgaggggtccaacttcgccaagtcattcctggtggcgtcccacggcgagctgttcgacgtgtacgtcttcttcaaggggttcacgccggagatcctcgccgtgcgcgtgtgcgccatcgacctcggcggcgccggcgacgagcggccggcgttccgcgaggtgggcgacctcggcgaccgcgcgctcctcctcggcgacgccaacgcggcgctcttgtgctcggcgagcgcgcacggggtgaagggcaaccgcgtctacttcatgcacaacatattggaggagccggacggtgggccgctgcgcgtctacgacctcggcgacggaagcatggagaccgtgcggccgtgccctggtgtctcggagctcatgtgcaaaccgttctgggtgatgccctccgcaccatgatgtgtcatagatttcagcgaaaccatcttccaaaaccgtcgagagaataaaattgcaccagttttaatagtttgcgggtcgatatattctccagtttagggatcgaatcagattcggctagtagtcaagggagtcacagtggacttattcctaaatacgtggaggccgcgttctcccgaatactaatcgaattaacgcatgggcctagcccaatctttaggtcaacgtgccagttgggccggcccaaccgatggtcggagccaatagaagctagcagcctagcacattgaccattgagcatcgatcgactcataagccacctatactttttttttaatctttacacatgagctatgatcgttatgtttgtctaaattcaaacagctatagtgtcaaagttagtggtcaacttctaagtttttatggaactagcataacaacgatgcaagatggtacgaaagtcggtttactgatataacgatggtatggaagttggtttactaacataatgatggcataaaaagttgatttactagcacaaagagtatcaaaaaagaactccttttcactatagttgaagtttgtacaggaggtttacaactacaacattgccatcagattgcttgctagcttgacatttccccaatgaattcaacctttttgtctgatgtgtaaaacttcttaactacatcattcatacttggtctttggttcctttctttctccaaacacgacgtagccacctccagcatcaacgccacctgtgagtaaacgaagctaccattcaacctacgatccaccaagctgattacccatgtccgatcaccaatcttcaacccttccctgatcttccacaccaactgtctcatcgcaatctccgcatcaccaacgctatccgtggccaaatccgccattctggcccctctaaccagctccagaagcacgacaccgtagctgtacacgtcaaccttttcggttatcggaagactcgaaacccattccggagccatgtaccctctggtccctctgatgctaaacgaggcgggatcatcgagatccctcctctgttgcatcttcgcgagcccgaaatcgctgatcttgggctcgaaatcctcgtcgagaagtatgttctctggcttaacgtcgcagtggatgatccagtcgaggcactcatggtggagataggccaaacctttggccacaccaacggcaatgttgtacctttggttccaattgagagtctccttggcgccaaacagccacgtggcgagcgacccgttgtccacgtactcgtacacaagcagccgccgccggcggtggcgctccgagcagacgccgcggattctcaccaggttcatgtggttgatccggccgatgacgctcacctcggtctcgaactcgtcgtccccacgctgcggcgtcgcggccttgagcttcttgacggccacggcgcggtcgtcgccggcgccggcgaggacgcccctgtacacggagccgtaccggccatgaccgatcacgtccttgaagttcttggttgccttcctgagctcgccgtaggtgaaccgccggaaatggtcggtgaccaccctgtacccttcctccgccgcccattgctccgacgtcgccggccggctcctcgccgtgaaccaccacccgaaggcgatgaagcagagctccacggcgaagaacgccgagaggaacccgtagtagtagcgccacgacgacgtgtccggggaggcggccgagaaggagaggagaacctcctctgttcgcgcggcgtcgcaggcgagattaacggcggcggcggcggccggggcggcggtgtaggtgtctgactccgccaccaagttcgccggaagcttgaggtacaccgtgccggggtagccggggtaggtcttgccgttgaagagcgccgacttgaggtagcagtcgctgacgtcatccttgtactcgaacgccacgcagttgcagagctcgaggcacgccgccttgcatccgtcgacggagatggaggagaagaggttgaggtcggagccccagaagtctgtttgcggcagccgcgcgaagcccatctccggccggccaccgccgccgccgcaggtgaggttgaacgtcggccggcagcccttgccgcggtcgccggcgtcggcgggaacgtagcctggagggcacgagcatgccggccgcggcgtgtacacgcagaggccgttccagccgcagaggccatggatgccgcacggctgggagaaggccatccaagaaaccgaccaccccccgtcggcgtcgcgcaggctgtacagccggaggttgccgtcgtggtccagcgtcagccgccgccacgtgacgccgccggcggcggcgcccgtgtcggacgcgacgaacgtggtgttgtcgctggcgaggaacctgccggcgtcgtcgagcacgccccggcggctggcgttgtaggagatcctgccgttggcccagctgctggcgtcggggtccggccagtagatgttggagatgtccgggccgtcgtacgccagcgagaggaggtagcggtcgtcgaaccggagcgcgtagtggctcgtcgggtggagcacgtccgtcgtggacagcctcgccgtcgccgtcaccggctgccccggcagcagcgtgtcggtcgggtagtcgaagctctgccacaacacgtccccgccatggcttgtcacgacgaggttgccggagtccgtcagctccgcggcggcggcggcgccggagctcgagttggtctgccacaccggcgtgccgtcgtagtcggcgagcacgaggcggccgtctcgccgcagcgtgagcttcgaccccgcgccgtgcaccggccggtcgcggttggccgtccaggcgacggtccggccggcggaggcggcgaaccagatggagacggtgaagacggtggaggagaggttgtagaagccgaacgcgaagacgccattggaggacacgaggatgtcggaggcgcgttccacggagagcgattcacctctttgaaggcggctgccgccatgagccggagaaagaagaagaagagcagagaacaagaacgcgaggagcatgatcaatggaggattgtccgccatggctggcatcaatcctgcaccaccgaagctaatagctgcagctgctgtaaactaaggtgaaatctcgcatctcagttagttatgaattctaacaacccaaggacccaaaattgcagtactaattaggagtatgtcattgtgtcagcgctaatgaccattgcttggtgttaattgtgtcaactcggcggcaattgaacaatggataggtagctttagagaactgacttgttaagaaactactaaagaacacgtttttcaaaaatgaaaaaattatccatatgcgtcgttttttcccagctgtcagttgagaacctgagatcacccgtgttatccagggagaattttcacttacctactcaataagaactctttgtttgactttttattttgcagagctcattgtttgacttgacagccatgctacgctgatgactagtattaaactagtaggaattgctgtgcaaacaattttcggtatagaagattctttgctaaaccgtagttttagcgtccggtattatgaatgtgtaaaacaagaactcatggagctttcttgacctcttgacgagaacagtactgtagaattccgttcatcaaacaaatatgaaggatggagcacagctgaagagatcttggacgaaggactaatttggacgagtcagaggaaaatagcatatttgatatctcaagtgaagactgaaaccaaaatctgtaacacctacacatctgttcattgcatgagaacataattacaggtttttcctccaagaactgcagccgactgtcatgttacatacaagatcgaagaatcaaatgaatgaacaaatgacccacacacaacaatgttggcagttagcttgatccctcgctgaagttttttcagctcttcatattctacaaaactgaatacaagtttgtgttgatgcctttcatgtgtcttctctcttcatgtaatgtattgtctaccctacgcacgtacagtagtactgcatagtgcagaagctgttttggggcttctgcacctcaattctgcatccctcttatggtagcctcgatgcggaaggttgatgagagaattctaaatagcccatcagggttatctgcatgaacctgaaaggagataagaccacaattaaatcttatttattgtcagtaaatctgtattatatgcaacatcataattagcacaggtatgtcagatggttatgaccctgacccatgagcacatggttaatataagggtatctaatctaagctgtagtaaagaatactactttttcatcacagtactatcttatggagaatgctgccagaagatctaggagtaattacaaggatatagtaagcatacccaatgtccagcatcttcaagcacgtgcatttcaactcctccaccctcatctgcagccagttcctcagcagtatgaattctctggagatcatcaagagcccatctatgcaaacttctttcagctttaaggaaattaatatgaacaccccttggtacattctctacaatccccctgaacggcacatccaaatagtttatagcttaatagacaatacatgttgcaggtctagatgattacaaaaaggaatcatgaaggatttaccataagttagtctcttcataggacttgtacatgtcagatatgccatttaggtcaaaaatccatgagaagcttgaagacgatagtgaccctaatggactgcttcgtcggagatttgtagccacccactgaaacaaagaatcagttatgcattgaaatgccttttgtttcatggcagatgaaaaatcaagtgacgtttttatgccagtcaaatcaagtaagcttggcagggtgccttgacatcaggggagtattcaagcatacccgtgcaacatccacagaaaattgttctttgactagagcatccaccacttcttgctttgaagaaacctgggtttaaagttcagaaaacagaaagcatatggtgaaacatatagcatccacttctgcagactcaattttgcagtcatataggtgtacatataacgctaaaaggccaacctgcataggcattcttctgagggactcaataagttcagcagggtgatcttcgccatctcccccagcacgaaccttgccaggagtagcatcaagaacccatacctttaggggacacaatatacagaataaacttagacaaaagattagaaatatcacccataattgtcacactaaaaccattcagaaaagtactcatgattaccctgacaggacgtgcaagcggttttgcagcttgttctaccatgctcagagccactgcaaagaaaatccgtgaggactgggatgctcgtggattatttacaatctaaatcataccataaatgtatggtaaggggagacaaaggaaacaggaaaaccttttccaccaaagctgtgaccaaccagcacccgtggggttagcctgagctgcactatctgttgcattttggattaattagcataaggtgacagataaatgggaaaaaggctgaggtgaactgaaagctactaagatataaaataacaagaaatgaaagcccagtcccaggaaaaccttttggacaatgacatggcctccaaaatatatctttgactatgtttttctgttataatatgtacaataaataaaaacatttttacttttattatagtatcttgtaagacaaatatatatatattgtttagtgcctttaaactaaatattttaaaagttattgataatcaaagttacaaacgtttgacctaaaccttgtcctactaaggctgtgttctaaactcccatttcccaacttctatctcctcattttttgcgtgcacgctatccaaactgttaaacattatgttttttgtaaaaagtttctataggaaagttactttaaaaaaaatcatattaattcatttttaaagtttgttttagctaatatttaattaatcatgcgctaatctgccgtttcgttggaaaccttcactcacaaactcagcctaagctaactgacatgtgcatggcggcaaaaaaggtatgcaaagttctcaagcattttgagttctaaccattctctcaatgcaacaaaggcatataacacaactacccaagcacatgcatatatattttgtgattccatatattgatatttgatatcagtgccacagacatatttaactcagtgtgtagataatagaagctaagacagaaatagcagtaagacgaaaacacaaaccagctttagaacatcaagagcagttgaggcaacagtatgcggtcctcttttcttaattgacgctgaatctccatggcaacgcaaatcaaccaagaggaactgcatgaggaaaaggcaggtacagtttctttctttatgctgtgaaataagtcagattgcgagcagaattttagataaagtaacctgccacatcggaaattcctgagccagcctctttgcaaaagatccttcaaatcaacacagttaattaattttgtgattaaatgcatttatacagccaaaacagctttaaaatgtgtcagtatttcactctgcaaactgaacacaacaacaaacccaatacaccaggaaacaaagtatgcaataggaaagcaagcacttctcaattaccccagtttttcctgctcccaaggatgccatgaaggagaacagctgttggtggatcaggtactgatttgtccataaatgagttccattgcacctgaggtgaagtgatggctatgaatagcttgtcttacaccataacatttgaccatttaacttctagctaacattatttaacaactagtgacatgtcactgagttcgtatgaatgcaatacgtacaaggctcccttgaaccagctcataggcctgcagggaatgaacagaaacgatttgtcagcaaggaatgaagtttgtatacttctgaagcttcaatcttccttaccaaaactccactatgcttctgaacatcaggctgataagcaatccttgtgttggccaatgccatctgaacacaacggcatggagggcacagcaatggccttgatttgatattagtcgatatcaactggccacgacgaacattttcctaaagccaaaaaagcaaaatacacaatcatgatcagaagctcacaaatgcatcagcagctgtagcaaaaattcataactcaagaaggcaggccagtatccttgcagcaaggttctcaacactgtaaataattcggtaggaatttagagcactaagttagccaccagacacacttcctattgcactacacattatatataagaggacttttacggtacattctactgctagtatatactaccagtatatttgatctaatggtgtaaattcatctgatcttcctcccaaatatcctgcagtataaattgtttagggtatatttgtctttttatctatttatgtgtgtgtgtgtgtgggggggggggggtttaattttttaaattcacgtttcctcacttggtcagatccgatcgatagccgcctacccagtcgaagccctttttttttctcgatgctgcgcgcatgggcgatcgtcgccgctaatttcttctgcaagctgccgacgaccacaatcggcgccgtcgttctttcttaattaagttcaatgaattaaggacttggtatgtgttagggattcagacacttagaaactgatcgaaccaagaaatgtatgagataatccacttcattgctgtgaacagatcaaatctatttacactatcatgtggttttatccctgaccagttttttccctagtgttcttacgcaaatcatgcccattgcaaactcaatctactagattaaatccgaccgtcgaaggaatcgctacgcctccactcgcgccgtcgccacgcgcgatgggagcgctacaacgcccggacgacgagatcgaagaactcccgattgaattaaatcgcaagaaataaatctcaatttcaaattactaaacagcccttttcatagttttaacaaataccaaatctaccttttcacatactgctagtatatacttgtggtagaatgtactgtaaaagtcctctatatataattaccaaagcattattgctcacacctacactaataacagatcacgacctaaaaagagtcttaaaaacacataaccggtgacaattagaccctttagttacctaacaatgtttccctgtgcatcctactccaaatgataggtttatatatcagggaaatttgtatgagcacgacaacataacgacaaacacaatccacggtgtgaactaaacaaagactaagggttttcaaacacgcaagaaatgtgtactacaaaaggtgcacttaatagtaataatgcatttctgcttctgccctgcttgcatctgcattacgctgatcacccggtcgccacccgcctaccactttaccaaaaattgcacccaaaagcctagcgattaagctccaatcaatcaacaacagacgaaaacacccacaaccccacaacgcattatctcctaacaacagtccattactacgaatctgacgagcaagccaattcgatcaccgaaagcaaaggggaaataatgggtgaggggtacctggcgagcgcgcgaggcggcgcgaaccctactccccggtgacagccgccacggggggactcccacggcgaccggatccctcctcctcggctccgcggagaggacgcgcggcgccgccgacgccgccgccgccatcagatcaccgacgcagcgagagcggagacgagcgaactcggcgtggcgttgtccgtatgcgcgtgccgtgtcagcgaaatggagaaaaacggaaaggaaaaaaaatcgaatttattttcgtggtggggaagtcggagacggaacagcggaggcggagaacccgaagagcgtgacgctgacgcgtgggggccacccgtgacatgtggcgtgccgcagccgggttctgacctgtgggacccgtttccgtaccaggcggtccagcgtggcggcggtgtgtggccaggccggtgggcgggtaggcggggggacccgacttgtctgtaggtttggtgggccttgggctgggctgggctggccccacaacaaacgagcgcagttacatgggcctccagcataggcccggcataaaaaatatatttcacccctcccctacgcgaggtttaattatccccccacaacctaggttttctttgtgttgggtttacagcatctgcggcgagatggagaaggaggtagaggaggaggaggaggaggaggaggcggaggcgagtagaaagaagggagaa

SEQ ID NO: 40695 - DNA, 8834 bp, Oryza sativa
agcaatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttattttttttgttgaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggcatgttaagtgaacagggcccaagtggccatggcccaagtcggcgtaggagcgctgagagccaccggattcgatcgaacggttaggatcactcgtgatttagataaagcattgcactgttgaatcctaaaccctaattcattctccttcctctcagtggcacattcctccaccgtgagcggccgtggcggcgcccttccctaccacgtgttgccgcagtgccctcctccctgtgagtagcggcattgccttcccccaccgcgaccgcgtggggcagcgcccttccctaccgcgagcggcggtggtggcggtgccctcccgcggcttcccacgagtggatccggcggcgacggcggcttcccgcgggagaatcaggcgatgacgaagatttaagataaaatttgtgcgtttttttattattcttcatattccttttctcttttgatgaattgtccgattggattttgtatttatttttgaatttgtgctttatccacccttacacgatgtgttactcgcgtgtgtggaacggaggtcatcgttggatcggacttacggaccaaaaaatgagtgatgaacgaaaagttgtgttaacgtcaacttttggtaaaattatttagtggattcggttaaggaaagagcacaatcaactgatggaaagcttatccagaagagtatgagttcaagaaagaatcatgaagactatgccgtggcagtttaattctatctattaattacgtaggatttagtaaatttcctttatctttagaaagttttatctagtatccgattagtacttgtatattttcttttgtatttaggaaacatgcgtcgtgtccaatatggactagtatctacccatgagtataaatatgtatatacagggtcattgtgatctatcctcgatcaatataactactcccggcgtatcgccaccctcttttccaatgtatttatttattatcactgacggaacttagcacctgacgcgggctgcattgacttcgatctccggcgaaggggtaagccctatgttccgttggccctggtgaatatatcggctacattggtgttgttcaaggctacatcgcttcgatctcttagatcgttctagttcggtcgatatatttgcctacctgatgtttcgattctattttaatagcattgtgtttagagacacatcggtttagttgggactgtctcgattaggtctgattttatgtcttagcctatatatctctacaatcacaatgttgttttaaatagatttgttagatccatcatattagacaaatttatcggctcattgagtattagattattatatgcaatctcgtgttgcatcgattaggttctacctactaaattgttgttaataatcaaagtcttgtcaagctgatatgttcatgctaatgtttcattggagggttagccgcttatataatatgttaaatttattgttgatggttttattgtcttagttaaatttaagacatgaccactctgaaaaacaatgaaaggcttggttgtttagatcttatactttcttttatacttagtactgcattagtcgtacttggaattgtaagaactaacttgctctttggttgacgataaaggtagcatcagggttttcagccgatgagttgtctcaatattgcactggcttataaggattatatacaagttgattttagccgattggatcattacttcattatatcatcatcgactcttggattatttgttcaagttctttcattgcttatctaagcatcggaatatacattgaacatatagccgattatttaaagccttatcgacatcggctaagtaccattacatcggcttgtcaaccaatcggttatttgatcataactatatatatattgttgttacataatcaaattgactagcacatctgcatgtaatcaaagtttaggatatgcactagagttaagcatttctttcattcattcgttttttttcacatcaataagttgtaaatttgttaagtagttaagattttcattgctcgagagtgaacggtctttacttgggcctcgccggtgcgatgccacagagacggaaacttagccgcgtcatgacgacccgacacgaaccaccgaatccaacggatcgacacccgttccacgcgtctactcagccaggaaaactccccgatccccatcccaagcggaaccaaaccgttcatggcgatgcttataaatgagcgcctccacagctcctctgccacttcacaaagcaactcatcaacagccaacaattcgagcagagcagatattagggaaggagaagaggtgagacttgaaacccatatcgtctagcccacttcattgtggagctagcccgaaaacctctagttgtttctcccctgtccgccgatccaccatggcgttcatctggccgggccgccgggagcgcagccggtgggcgacctacgggtggcgcagctggcgctgctcgtcgccggcaacgggctgatcgtctcgccgtcctacctcagcagctgcccctgcgacgacggcggccggtgcttcttccaggacggcgtggcggagcagaggtgcttcgacctggccaacctcgtcaccgccgtgctcgggctggccctcctcgtcggagacatggcattctcgacggcagtgcccggccggtcgacgcagtcgcaggccctggccaccgttgctaggtggctcgtcgggctcgccaaggtcgccacggttgggaccttccagcattggatcaatgccttttacctttgcctcaaaacgtggtccatcacgtcttatattatccacccgtctttgcatgataaccctgtcctcgtctttgcataactctttgtcgtgctgttgtgatgtgattaggctcaaattgtttcattttgaacattaatttatgttcaaactatgaggaaattgattatatttgtatacgaatggattaatgttctttacaacgttggtatatttattttaaccatgtttggtatgttcacttcctgggttgttctttacaactgaagcaaatttatgattggagctacatttggagtcacttttttttccttgtttcatagtagtataaaagttactccaatgtagtttattttctttgcaaattgtttgtccgaaacgtcatctaattatacatgtcatgcgaaaactacaagttacttaaataaaatctatttttcaggtttaaataattataactcaattaatcatacgttattttcttattttatctgcacgcagttacatcttcagcagattcaaaagggacatctagtagcataaacactcacatactcagagaaaaccattgacctgagtaatgacccggttagtcactaaccgcgtccccgtaggaccgtaacgaaccaaatggagcagcgtcccacgcggataaaccacgtcgtccccgtcgatctccacgcgcggctgccagagtcgatcgtcacctcggctagctcggtctcgccggtgacctcaccgtagacgacgacttgacctgacgaaactggaaccaacccaacccaaccaacatatacgagctcaccccgcgctgtgtgtgccgccaattcacaaatcacaagcaagaacacaccaagaacccgaactgtcctacctcgatcgatcaccagcagccagccatggcggccgtcatcgacttcctccagttggagccgccgcgcgagccgcggccgcagccggccgtgcaggcggccctccccgtggcgaagtcggcgctgttcgtcgccatcaacggcctcgtcgcgccgtcctacctgtggtggtgcctggcctgcgacgacggcggcggcggcggcggcggcctccgccggcgctgcttccgcggcgaggccggcggcgacgtggagcagatgtggtaccagatggccagcttcgccaccgccgtcctcggcgtggcgctcctggcttttcacgtggcctcctcctcggcgccggcggcgatggcggcgtggctggtctggctcaccaaggtcttcacctgtgggactctccagtttggcctcaatattgtccacttttgtatcaaaataatttacttcaagttgatacgggggttggattctaatctttcgaggggataattataacacattttttttactgcttggatgcaatgccgatagctgtaaatggatttgaatcgatttgagtacataataatgtacgaaggtagattcaattttgtcagagctgcggcgtgctaatgtagactccatcgtggctaattgacggaataaacgaaacggtatatttgcaaacggaaaataatttgtaaataaaacttttatatacgtgttcttagcgattcaaaacaaaggctgtaaaataaactacgatgaaaaaaaatcccaaaatcaactctaaatttaaggttgaaaatttaaattttggtttataagcataagccaaaagatagagccgatggttcttgagatattttgtctgctctttgtgagaatttcttctattagaatcgtgatcagcttctcgatcaatggcgttgaccgatcgacatacaacggctttaggtcatcagaaaaagaaaaagaaaaagaaaaagaagaagaagaagaacacgtcagtagagggtccttgacggaaaatgatcttatcaagtcaaccatcgattctgggccgccgaatagtgatcggacgggtacgaagatgttatccaagactcccaattatgggagggttgaaacgatgaatcatcctcatgaaggggtctctaacgtaaaatcattgcctggctggcataacatacttttcctagtcgatcaggattgcagaagcattatcggacggtgctggagaacccatgttttgatcgaacctgtgagttaggcccattaagaattaggcccatgcaaatcaccctcggttgaagcccaaagcagtggctgtggcggccgcaggtacaaagatctaattaagttaagagattatgctgtccaaggcaaggcacacctttttattcctttttattaccatgccagtaagaccaaacaaggttttcaaggcaaaatagcaggcaaccattggccaattctatcttcgctcttgattaaccacgatgaaaaatccacaatcaggattctcatcacattattggcacattacggccaataacagaacactatcaataaaatgaataaatcccacacaaaaaaccaatgtggtgttgtgtgtcttgtatcacaacacctttaagatctagcttagttatgtacagatccttttgtttcccctaattaatattactcctatatcttcccctcttaggtctgaccatgaaattctaggcacccctctccttgagatagctcggtgtccttctgtgccgcctgagcgaggtggtgtacgatccgatggagccgtcgcgttgcagcacgatgtcagcatggattgcagagtttgggttcttctgccggtatcgatcatggtgactctggtgcttctcttccactgtcgcctcgatcctcatgtcaaccttgttctcaccatctacttgcttggttttggtcacatcgtccttcttgttatcttccacaacgacggtgaacacaaatgtaccaatttggaggtagtcattcatgtccaatatgggctctagggccttgaccacctccctcatgctgggcctggactttggtgatgggctcaagcacttgtaggctaccaaagcagcttcttgggcccctttgtaggagtattggccctccatggctgggtccatgacgacccggtgcaactggtcgggcttcttgaggtactttcttgtccaatccaccagactttgctccctatggcgacgagagcggtccaccgagtgccgacccgataatagctccagtagtaccacaccaaaactatacacatcgctcttgtcggtcaggtgccctgtcatgatgtactcgggcgctgcatacccgtttgtccccatgacacgcgtcgtgacatgggtcgcgtcgcctgcggcccatccttggcaagcccaaagtcggaaagcttggtgttgaagtcctgaaatcaaatgaatcagagatcgggttaggcagggatcacagttgacaattacaatgacatgcaggagacagacgacaatgtttctgtcagtatcatgctagtaatcacgccagtcggccagtgccattaactggcataatgattctgtacggatatgatgctagggatggatttttattaggtgctgtgtagccatctattcctagagaagacagcatgagctgggatctctgaaccctgaaggttgggccatccaagaaccttccaagttgcaatcatgtctaacgaacccacacacccagccaacgattttggaacgtgtggcacgcagactttgacagtcaaatctagacttgataacttgacaagtggtatcccatcaaaattttcagaaataagaagcgaaaaatggtctgaaagttagtaaaatttttcacggcagtttgaattttcgctctcaggacatggtagttttttttttcctttaacgactgaaatttctactgcactcgagtgaaatgactgcgaaaagtacacagtggaatcaagaacgggatggtgctcaccgagtcgaggaggatgttggatgccttgaagtcacggtagatgaccggcgtgtcggcgtcgtggaggaaggcgagccccttcgccgcgccgacggcggtctgcatcctcctcatccatggcatggcgccatcgagacctgcacggacaggaggacggttcagcgtcagctaaagtcttccccggaattttttcagagctgaaacttcagcgatggcgtaagcgcgctctaagcgcaaatgattcggttaaccactcgcgtataaacaccagtaatctcccggattctattgacgattgcgacgggggtaaaaaaaaagaagaaaagattcaacagttggtaattattctcgtgtgcttacttttgaagagatgcttctccaagctcccgttgctcatgtactcgtacaccagcatccggtgttcgtcctcgtagcagtagccgatcagcttgacgagattcttgtgcctcaactgaccaaggaagaacacctcagcctgcaagaaagaaaggttcgtagattaattagcacggtgagctaaagctcgagctagcccaacaatggcggaaggaacgcatgaggtggagagtgacgtaccagccactccctgtggccctgcgtgccgcagtcgaggtcgaggtacttgacggcgacggcctgcgcggcgaggccggggcggaggccgtcgtcggcgcggcccttgtacacggggccgaacccgccggagccgaggtagttggcgcgggagaagccgccggtgacggccctcatctcggcgtaggtgaaggcgtacaggttcgagcccgacagcgtcagcgacaggtcctccggcgtgagggtccccgtcgagctcaggctcgacagcgacaccctcgacgccgacgacgccgacgacgacgacgacagcagccgctggtggtgaccaccccctctgaccctcctcctctccggcggcacgtcgtcctcaacgccggccaccccgccgccgccgacgcagcagagcatcgacttccacgacgtccgcaactcagccatcgaatcgatcaaatccaagatgaacaagaagccaagaaaaaccaatcgcccacgaacacgaagcagcagagagccagagaccgaaatgcagagacggagacagcgagtaccagagcttgtaaagaagaagaagaagagaggacagagttgaggaagcgtctgcaccggcaatggcgagatatgtaggcgctgcggct

SEQ ID NO: 40696 - DNA, 1597 bp, Oryza sativa
aaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagcttcgtgaagaccttgaacaaggcaagtcaccctttgatcaattgcccctataattaaaaagtcattattattttgtttgcaacttgcattactagaatcacacacttaacttgtttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcgattcagggaaacctcgcatgccaatagttgggaacgccggggcggggtcggacaaaccgggttcctggtaaggcaaggacgagaagcttgctcacataccgatcaaggtggttggagttgatttgtgaatgcctaaaatggcctatacttacgtgaggatttgatccttctatgtggcatgaggtaaccctgggtcggcttgggaaatgctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagagttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaaggctctgggagccgatta

SEQ ID NO: 40697 - DNA, 1514 bp, Oryza sativa
tatggagtttattggagtaaaagcacttttattttccgttggtcgtgtatacgttgcagcttcggaagatccactcttcgtggaggttgaagccaatgtttgggaaagcgagcaaggcaagtcacatcatccttgaacatattgcatcccagtttataaaattattttgatttaaattattgcattatcgctttacttaaatgcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttagttaggcaacattaggtggttttacaactctagactgtgggaatattctcatcacctggacactatggaatggttggattattgtggaatcggattcacacctccccctctattcaaaaccctaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaaggcaaatgaacgctacacgagctgcggcccggtagtcgagatgtcatggcacagggccggtgtcctgctgctaggggctcagtcctgcctacctgtcccgggggttccggccgtaggtgcggttgggtcgttactcttgtttatggctaggatgggttggaaactatgtcatgtcttctgtccgtataccgtggtggtatgtggcacgtggttacacgtgaggaagatgtgtcttgtgggtaaagatgtacacctctgatcagagtataatctattcgaatagtcgcgccctcggttatgggcaagccgagcaatgtacccaagttagtgtttttaattcttaaaacctgcttaacaactaaaatgtggaatggttggcctgggttggcttgggacgagttaggacccagggttgggttgccagttcggtctgaatcatcgtgggccttgggttaaggcaggttcgtgtgggttcacggccttgattaataatcttgtatagctctaggaccgtgtttacaaagtagctttgagcaactaagtgacttttaatgctgtttactgcaaaccctaaccccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcatgtggtcgtcgccctagtcttccgctgtttcccatttgtctttgtgtgtgctgggccttcgc

SEQ ID NO: 40698 - DNA, 3849 bp, Oryza sativa
ttcccatttgtctttgtgtgtgctgggccttcgccgcccatgtaataaagtaactatttacgcttccgcttgataaactctgaaatgtatcaacttttggtgtaccttgcctcctgggacaaggaataatacacgcacgtaaggaacgcccgttgggttatttccggtcgtgacatccactcatccggttcggcccactcacctgggtcgacccactcgcctaggccggcctcttcccccggctcggcctcctcacctgcgacggctcgctcgacaactacggcaatcccatcgccaccagtgccatggtttgctgcggtgcccacccgaccccggtcggtgcgcgtgcaaatcgctcctccaccgccctccactacggcaccgctcgtgatcaatgatcacaccatgaccacaagtggcaaagccggtctgcgcaagcctgtccagcgactgaaccttcatgcctcgatgctatctccagtcccacacacctaccgagctgccctcgccgacccatactggcaaacagccatggaagaggagttcactgctctcaccgccaaccgcacatgggacttggtgccccgaccatccagcgccaatgtcgtcaccggcaagtggatcttcaagcacaagttccaatttgacggcacacttgacagatacaaggctcggtgggttcttcgcggtttcattcagcgccccggcatctgtcacatcctgattttcgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaatagttcagtaattatttgatcaataatgatttaattatatttgttaagagcttttcttatttaaaaatccttaaattataaattgttgtttaaaaggaattattagaaatgatcttaaaagcctaaaagagaagatctaattttaatttgtgaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctcttttggctttgggccgaaagtcggcccaaaacccctctctttctctctctctccggcccagtcggcccagccagtccgagctgccgctctcctctctctctcgctgtcgctgacaggtgggccccacctgtcggacttgtcttcctcctccggccgccgccgcccgaaccctagccgagccgcgtccgagccgccgccgtctccttccaaatccgatcgattctttccttctccggtgaaatcttttgaggggaaatgatcttctcgatctcctcttccttttctcttttggaatcatcgtctcaatcgctttggaagttcgtggattcgaggtcgaatcggatcggtttctttcctccgaaccccgagctttccatcccgtcgccggtcgccgtgggccttcgccgctgccttccaacccctttaaaaggatccccggtgtctcctctacccgccgcctccctcgccttcgtctctcgccgtcggaagcgccctagcgccgtgtgacctagcgccgccgtcgtcgccgccgcttcagccgtgcgccgccgccgttccggtcgtcgtcgtcgctcggggaggtcgccatcgtggtcgccggcgccatccgttgctcttccgccgttgttttggtcaccggtgagttcgccgcgtcgccctctacccgttggtgtcctccgtttgcatcgtcacgccgtcgttcgccggcgagcttgcgctccccgagccgccgccggtgctgacgtcatcgctgacgtcgttgctgacgttatcgttgctgttccccgtggcccggtcgtggaccgatcgatctcggccatccgttttggataagatcgatctcggccgtccgttcccgtgaaccgctgccgtgcacccggtccaccgcaaacccgacccgctgacgcaataattccctttttcttttcaaaaataattcattattgcgtcataattcaattaaaatctatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctcttcctttgttatggccaatttgcattgattactttattccttgataccttgggttattataattggactagttgagctttatatatattggttcaactagatattagatataattgcttagccatgcttagaaacattagcacactattgggataacttatgactcactattatttaatgatggcttaatgatagttcacgatggtcaatcgtgattggttaattaattacttgccaactaaaatatgattaatggtgggttgtgagcacatggttttgagagtcgtgctcatgacaattaaggaccggttcgcgagctactgttgtgaaacattaaccgtgccaaccacaagccagcatgggcaacggctttaccttttgtataacatagttcattgcggagcaccagactgagaagtggcggagataagcccacgggggtcgctggggagtccatgcctctggtttttgagggggtgattatgatccaggaatggtgcactgtggtgagttgtgttgtgcgaagggtattgtcacgatttccccctttgcagtgccgtggtggtacttcggggcatggcaacatgtgtgaaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgtttagctcctggtttggagttagatctgtacagccgggtatggttgttcaggatggttgggcctgtacagcatgggtgtgctgttcagtgttgattaaaatttctgattaattactctactgttttactactcttaactctttgctaagtgctgctttcgcaaatgagcctatattatgccatcctttgttatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctag

SEQ ID NO: 40699 - DNA, 9322 bp, Oryza sativa
  unsure (1)..(9322): unsure at all n locations
aatttccgggcgtgacagcatcgactttgatgagacgtttagtccggttgtcaaaccggccaccgtccgcactgtacttagcctagcagtctctcacgattggccaatacaccagcttgatgtcaagaatgctttccttcatggcaccctccaggagacagtctactgcattcagcctcccggcttcgtcgaccccacacgacttgacatggtttgccgcctgaacaaatcgctctatggtctcaagcaggcacctcgggcatggtacagcagatttgctacttttttgctgtccattggcttcactgaggccaagtccgacacatccctgtttgtccttcatcgcgactctggcacaatatacctgcttctctatatcgatgacatcgtgctcactacctcctctgctcagctcctccagtggaccatctcatccctgcagtccgagttctccatgaaggatcttggtgctctcttggtgctcttcatcacttccttggtgtcaccgtcgctcgcagggacaccggcttgtttttgcatcagcggcagtacagtcttgatatcctggagcgtgctggcatgacagattgcaagccgtgcgccactcctgtggatacatgtgccaagttatcttcgaccaacggtccactagtggcagatcctacagattatcgcagtcttgcaggagcacttcagtacctcactttcaccagaccagatatttcgtatgcggtccagcaggtgtgcttacacatgcatgatcctcgcgaggtctatctcaccgctctcaaaaggattttgcgatatgtccgaggtacaattgatcttggtctccatattcagcgttctcaggccactgaccttgttgtctattctgacgctgattggaccggctgtccaaacactcgcaagtccacatccggttatgcagtttttctcggtgacaaccttgtgtcatggtcatccaagcgccagaacactgtctctcgctcgagtgctgaagctgagtatcgcgctgtggcaaatgcggttgccaaagccagctggttgcgccaacttctccatgagctgcattccccgccgtctaaagccaacttggtgtattgtgataatgtgagcgcagtttatctctcctccaatccagtacagcatcaacgaacgaagcatgtcaagatcgatctacacttcgtgcgtgacaaggttgctctaggtgttgtccaggtgttgcatgttccaacttcatcacagtatgcggacatcttcaccaaaggtcttccctctcttgtcttcatcgagtttcgctccagtctcaacgttcgctccatcgacgttgcgactgcggggggtgttagacaatatggtttagatatgcatggttgagttttatctctctaagcctagatccttatcctcccgattctgttgctataaatcggtagagtggttatggacaggcatatatatgtacgcactacgtgattaatccaatctacgttgagttcctccatctcacaaagaactcaatggtcgttgcgatgttgatgaacttgtcaaatacgactcgcagcaacttcttgatgacggattgagatcctctacaatcaaatgcagagtgcttttatcactgacatgtgagaccgcgtgccagtgacgcatgacttcaactgcagagcattctgatcccttgacgacatacttttgtatgtatatgatgccttgggtttgggacacgagttattttcgttctcgattcgcccttgcatataccatatgagttttactcaaatccaatgttctaacaagcacaaaaagaatagtacaaaaccatactgtagtttaacgatctacttcagcataagcatccgccggcacagcacggnattgccaccgacgggcggctgcacccatctttgcacctcgggcaggagcacgagcagccgcaggagcactcggggcacgacggcgccggcgtcgcgcctccgaggcagcaaggcctgccgcagcagcacgccgacgatcccttcccgccgccgcagcagcagcagcaggaaggctccccctcgcagcacgacgactggcacttgcagcaggacggctgccccttgcagcacgacgaccggcagctcagccaccgccggagcagagccaggcagccgacgcacggcgccgcgcaggacgagcacttggggcagcagccgccgccgcaggacgagcaccccgtgccgcagccgctgcagctcggcttgcagccgccggcgcagctgctacagcaccgcgtgcaggacgagcacgagcacttgcagctggagcagcagtcgctgggcggacagcagccgccgccgccgccacacaacggtcggcagtggccgcagcctgtgcagccgcagctgggaaggctgcaggtgcagcaatcgctgctgcagcagctgcagttggatttgcagcagcacgaagaaggggccttgaggcagccgcagctcggtctacagcacgatgtgtcgcagcaggagcagcaagaaggactgaagcagctcggtttcttgggctttgggaggcaccggcaccaacagcagaggcataacaagcagttgcacaatttcgatctgataaaaaacaacaggtttaagatcttttagtctttccaagggagcgttgaaacagcatgtcatttgcaagaagttcagaacgaaaaaaaaggcggtatttgtcgtgtaaatagcgctgcagttctgggaacagtattggctccacaaaaagactgcgaaaattgctttgatgccaccataactgatgtcagatatcctgacttttttcatcaaagaaggcagtactccgagttatcatgtagtattaaagtgtgacatttctgacaaatcactttgttggtgtattgaggttctacaaattgagtgagcatttgataaaatgggctaataaggtgaaattcagttcgggcatttgacaggaacagaaacaagtaggagtatgagtcttaacagtgttgactgttgaactagtttattcagcaacaaactgaaaccagcatattgtcatactttgccctatgagtgttacctacttattcactaatggcttgaatttaataaactctcaaattataaacaacaatatattccctcggtttaaacagcaaagcttttagaatgtttttatccgtacacccaaaagcatggacaagggaagagtaagggacctgatccaccgatagaggctgcaagatctgtgtttccttttgtttctggaataaataaggcacagggagaacactgatcagcaaactttgaaaaaagaaactctgaaatgcaaaacataaatcaatatattcatacattggtataagcggatccgactttgcaccaacaaattcgttgacactgccaaatgtgataatatagcattagtatctttgtaatcgacaatggcatttgaacgttacatagtacagttccaaaaggagcaaaattgaaatgtaggtcatgcatgaacagttcacatgttgactgttggaccaccaggtcagaagttactagcagagattattattggcattcaagaaaatcgaaaagtatagtaaatgtcgcaattcatgtgggccactttcttttttttcaaaaaaaaaataagtttgaggaatgtgtcaggattcagcaaataaaaagaacacaatggaaaaaattctaatttttagtgctctcctcggaaaaagaattgtcttgtttatcaataagaccactacaaatcaaagaaacaacaacactaatgactcaaacactactgacattcagagtagctgtgattaaatggcatttgagcctgaaaggctgagactagatcactagaatgaacaagaacttgctagttgcccatccgagcgaaacaccagcactgccggcgacaagatttgcagagagaagcgaggctaatgaggaaagcagaaaggagaggatagggcgcatactctttgcaacacctcgagaccggctgaatccgttcaagtccctgtagctcttgctgcaaaaagggagcccccagtcaggccgaggcacatgcacatggcttccacagacctatacacagtcctgctccatgtgccatgaatggaagcagtaaagaacacgagcaatgcgcagcagcagcagcagcgtctctacctactgattgccattgccaggtgatgtcacgctcaagagaagcagaaatctgaaagtagagttctttttatttttaattatcaattgcaggtactcccccatacccctatagttccagaattcatcagactttacgcatgatgcaatgtaatgaggagacttcggaagtactactcctatactgcacttgctttgcaattctgaaatgcctgatgttgcagggggaaaaaatacatattgcagtagaactctactactactactactccagaagtaaaatggcattggttcatggctgcccattgttcttgttctctctgcaagaagacggcagtaggggcagccatgacagccgcacgtactgctagtacaacatgggagcctgtcgcgcatcggttgtcgcgacagagcgagctctcgcctcgcttccgtcgcgaaaccccaaaccgatgagctctccacatcaacttttttccccggagatttcctctctctctctctctctctctctctgtctctccactccataggaagaacaaaaaaaaatgcacgcttttcttcatcactgtgaaagaaagcgaggtgacatgacggggaagtgaagtgaggtcacctcgaggaagccgacctcccggttgaggatctgcatctccagctgcagccgccgccggccgcacaggtccgggtacctcggcggcgacttgggcctcggcgcctcccccatctcaacccaacttatccaccggagacgcaagacaaccaccctcagcgccgcgagcgagcgagcgagagagctagctaccctgcaggctacagctgcgtagctaaggtgggcgaggagagcggcgaccgacggcccgcgctacggtgagctcggctgcagggccacgtacgtacgtacgtacgtacgcacgctcgccaccggcagggggcgggggcgggggcgtcggctcggcgaatggtgtggatggtggtggcgacgcgcgcggcgttgggttgggggtttaaatgctggcgcagtggctcatcgcgcgcgcgcgcacgggaggaggacgcggaaggcgaggcgctgcgagtgcacgttgttgcgtacgcccactctgctctgctctggtgtggtggtgtgtgtggctcggggttgggcgccgcagactctctcgcgggcgcgcggtgggcgtgggtttttctgcgtgcgcgggggcgcgggggtgcgggtgcggggggagatgggatgtgcggccgtgtcgcggttggcagtcgtacgagacaatgttcagtcgtgtcatcatcgctacgcagaatcgcagacgggtggcccccgcccgggcggacgcgtcacggcgtcagctatagggggaagggaaagtagtaggacggggacggaacgacgattgatccagccgtagcggctttttcaccgattgattcatcactgctctaagttcctttttatttttcactcaggtcctttctgtccggtatgttatgtgtttattctttaatactttttataaggattgttaggctgtgttctttttttttcccaactccaccccactcatttacagtgtacgtgttttttaaacggctaaaagacgtgtgttttgaaaaaaaatgatttaaaataccatattaatccatttttcaagtttattttgttaatacttaattaatcatgtgctgatgaactgctccgttttctgtgtaggaggaaaacgttcccaacacacccaacgaacacaaccttaatcatcaactacttcaagagttctacgaatatcaccctctttttgggatttgtgtttgaattcatattagagcaagtttaatagtatagctaactgctgtctccaaatcatctataatcaacttaatagccaattcatacaatagttacatataaatatataccacgcaattaatatctggtcccacatgtcatacacacatgcatcttggagtccatgctacagctgcatacaaatctgtagcccgctgctcttatctctcatcttttatctcctcgaaatatgtttgtagctggtttatagtctgctattgtatctactctttatcattcacattgtttgatactttgagggaagcccgcataagatggtgttgtttctaggctagggaaagccaatatgtacgagagttgttagagctaaaaaatcaatctagatttggtaatacaattggatgttaatggtattaaggatggttagtaggaaaaatcatcggagacgatgaagaaagaaggttgaagcagaacattgtgtgaacttattcatcaacagtgacacggaatgatactactgatgctagcaaaggttagtgggatttgtgtgccgacaagttcatgactaattaggcaaccagtgttttggcttccaaggaacacggatcctctgaggctctgacttctataatctaagtcaaagccatacaatacccgctcactcatcacccgtttcaatccaagtgttgatgctttatttcctttcttcccttaattctctatgggtatgaggtgaagtgagaataaggccgtgacagttgaggcaccaagtaggacgaaatcagtggcaacgagagaagccaaggcacgcacaagatgttctcgggacagaatgggaatggttaggatatggatctagcctaaaacgtttcaaatgagtttattgaaccatggtttaatagggtcaatccatcatgagtctattatataaataggttatccatggatatcaaaatggatcatctacgctcctaatagataaaaaaaaactcttattgcatgcatgtaaaactcgggtccaaaatttttaaactcgcgttcacattataaagccttatcaaatttaattgaattttatagagatgatttattatatggagaagcaactttgttcaaattttaagtcatttagacatgtgaggcccacgatacattactaagattcaaaaattatagttaccatcctcctaacatcaattgaggagatccaacgatgccatacgccgtaggatggtccgaatagaggtgacagaggcgccgacaaagatctaggtggtagtaccgctcgtctatcgcccgccgccggccgctcgtctgctcccgcctccggccgcccgtcggcgccgcatcgtccactcccgccgctcccaccgttcccgagtccgcgcgggaggagaagcgagcggcgcggtcgacggcgaggcgcacggcggcggcgtccccggcgcggtcgccggatccgcctcggccactagagggaggggaaggaggcgcaagggagaagcggagcggtggcacgggaggagaagcgaagcggcgcgggaggagaagaaggcgatggcgatggagtagaggaagagaaagtcgttaggggtaggtggggaataaatttcgtcccgtaccccgtgtccacacgcttgggtaatgctgcactgtgggtccggttttcttcacctgtggctccatccaattaagccacacatagtatgggtgcttgcactgtggggtgggtgtctttaggccaactttttttgctagagctacgggccccataacttgcactgtgagaggcttaatagccttgagcacgaatgtcaaaggaagacgaggccaaccgttgacgaagctggcaacaacgtagagggctatgaaacagtggtctggcagtcgcaaaaatgggtggcccagagttgcacaggtaggggcgagctggaggcagcgacgatggttgcgcttgaccttgacgaggagaccattctcctgagcggtggtagcctgaggaagggatcatagatgggatgaccgaagaagaaagactacgagcgatggagaggagaggaagagggcaatactgaccggtgggccctaccattttttatatttttcgttgatatgattgccatgtcaaccaaaattctgctaaacgtgtgacatgtaggaccaacaccgctccggattgggccaaagggataattcattcgggttgaagagcttagggttcaagatgtttagttttgtagtttgaaaggattatttgaattgctgtaatagttcagggatagttaggatttctttgtagattgaaacgaacagtgtataagatggtattgcacacatctgtcttagcttaagtaggtcagaggatccatatcacatcaaataccatggatagtcttcgatcgttgtcaattgtgcttgttcaacaattggaacgccactcaacaattggaacgccactaagtgagcccacccacttagggccctttgaatcataggaatgaaaaaacggaggaataggaaaacataggattctaatatgaatgcaagtgcaaaacagagtactgcaaaacgtagaaaaaacacagggatgaccgtttgattgaaccgcacgaaaaacacaggaatcggatgagagagagattcaaatgaaagtttccaagatgttagagttcttgctaaatttcctccaaaatctctatagaattgtccattccataggaattttaaaggatagcatatgattcaatcatttgtttcaaagggcttcatagaaaattttcactatagaattggaatccttcaaaaattcatatgtttgtcgtaagtccagggatcatcgagggctatttggagtttgggcagaggaaaatcaagtcgtcgtggtcttcttttaattctacctttactaggaagcatcgatgcacggctacaacttctgtaaggaaaaagtacgaattacccccccccccgaactatcgcggtcgaccgaattaccccctaaccatagaaccggatatttttcacccccaactttgcaaaccgaacgaattacccccctcgacccaatccgcggtggttttggtctatgtggcgtacacatggcaatccagtcagcattctatttatgaaaaaaaaatgtgggacctacctgtcatacactactctctcttctctctctcacacacacactctctctcactcttcctctctctctcaccatctcacgggtcagcggcggcaggggacacggagcactggcggcggcggcggcgggggatgaggaggcggccgctcggctcagtggcatgcgcgcggggaggacaaggacacaggcttccccctcccccct

SEQ ID NO: 40700 - DNA, 7918 bp, Oryza sativa
catgttcactcccagcgtaggaaaaataagaaatgacgatgtcatgtggaagtctttcttaggcagcccggcgaagacgcaagctagctagcaccaactccacttggctgttcttctattgaaatttgcgaaggtttgcgttcagccgccagcaggttgtgacgatcaagcgatccgcaaccatgagcggctgagcgcacattacatacacatcagcttcatataagcaaagcaacagtgttaagagtctggttacaaatcacaaagatcattaatactcccaacgtcatatatacactaaaacacacatgaccggaggggagtacttatttttttaaaattttgatcttaccgagagagtacttgactgtcgcatatatggtcgatatgattgatcgtttcccctttccttttaatgatttgtgagctcacgaagtatgaaaagaaagagtgaaagaccattcagtagtagttactactctttcctctttctgtactaaaatataaggatttttagttataaatttgaacaactgtgtttctaaattcatagccaaaagttactatattttgggatgaaggtagtacctccacctctcgacgatatcaaatgatgacagttcccacaaacacatgtgaaaaccaaataattttgtcaaaaattatattttctttgaactggatcgatccaccgagtgaatttatttccgtacctggtgatgggcacaattaccatggtaaccgcgcggtaagagaaaccatacttattcattgtctttcgttttcatttcaattggttacaatgaattttttaatatctaagtttttattcattttcttgttttattgtaaacttctaatttacggctccctttgattcaaagaaaaatcatacaaattttggaggattttatttctataaaaaaatatttttcctatataatcatttgaatcaaaggaataaatcctatgaaatgtctcactccatgcaagttttataagaaatttaatatgggttagaacctcatgggacgtttcttttgagtctttatctctcttaaaatttttgtgttttttctgcggtctaatcaaatgactattcttgtgtttttttctatgtttaatcctatgttttataattgcatttatgtcagaatcctatattttttttattcctccttttttatttctaatatttaaaggggtcctacataagattgtgtgacaaaaagaaaaatgagttttccttttttttaaaatcttttcttgaaggtttttatgtctcccaaagggtatttctgttgtagtgtctcgaagcaaatgtttccaatctgtattgttgatactttttgtgataagatgctttagagtctcctcaagtgaaagttgattgacctaagatttcacgagtttgactgcaactgtttgaagttattagaactgttttcgtttgataatgagctactagaactagcaaagggattataatagatcacccgagtaaacatcccctcatttactaggcaactaaattattatgattcttttctaaaagattgatacgacatatcaatatataacatatcattatatattactgtataaatatataagtataaattcgacttctccaagttataaaaaaaataacaaaatggatgccaactcaagtgactaaaaagagtttctcgatcaacataatctatcaattttcaattagaaaattgactctgacttggcagcataattgagactaacacatgcacatccaccataccaaagtacaattactgaaccgtccccgtccactacactgttgtacgatcgattaccagtagtagctcactcctaatctcctacaaatacgtagcgtcactcgcttgcattgcatcgcatctccaacccaaacccaataaatcctctcccattgcccatggagccatcagcattggccaccttgctatccatggcgctcgccgccttcctgctactcgggctgatcaaacgcaagggcagccgccgtggctacaacctgccgccgggtccgacgccgtggcccgtcatcggcaacttcaacctcatcggcgcgctgccgcaccgctccatccatgagctctccaggaagtacggcgagctcatgctcctccgcttcggctccttccccgtcgtcgtcggctcgtcggtcgccatggccaggctcgtcctcaagacccacgacgcggtgttcatcgaccgccccaggacggcgtccaggaagcacaccacctacggctacgccgacatcacgtggtcgccgtacggcgcgtactggcgccaggcgcggcggatctgcgtcaccgagctgttcagcgcccgccgcgtcgcgtcgttcgagcacatccgcgccgacgaggtgcgcgcgctggtgcgcggcctcttcgccgcggcgtcgtcgggacgcagcggcgccgtgcacctcaacagggatcacctgtccacgctgagcatgaacgtgatcacgcggatggtgctcgggaagcggttcttcggcgagggcgcggacgcggcggaggggcccgtgtcgacgctgtcggagttcaagtggatgctggacgagctcctcctgctcaacggcgtcctcaacgtcggcgactggatcccgtgggtggactggatggacctgcaggggtacgtgcggcggatgaagaaggtgggcaagatgttcgacgcgttcatggagcacgtcctcgacgagcacagcgagcggcggcggcgcgagggcgaggcgttcgtggcgagggacatggtggacgtgctcatggacctcgccgacgacccctccctcgagatcaagctcggccgcgtcggcgtcaaggcgttcacgcaggacctcatcgccgggggcacggagagctcgtcggtgactgtggagtgggcgctctcggagctcttcaaaaaccccgccatcttcgccacggccaccgacgagctcgaccgcgtcgtcggccgctgccgctgggtcacggagaaggacatcccgaacctcccctacctagacgccatcatgaaagagaccatgcggatgcaccccatcgtgccgctcctcatcccgcgcgtcgcccgcgacgacgccgccgtcgcgggctacgacatccccaagggcgcgcgcgtgctcatcaacgtgtggaccatcggccgggacccggagctgtgggacgcggcggaggagtttatgccggagaggttcatcgggagcaggatcgacgtgaaggggcaggacttcgagctgctgccgttcgggtccgggcggcgcatgtgccccggctacaacctcgggctcaaggtgatgcagctgagcttggccaacctgctgcacgggttcgcgtggaggttgccggaggggatgaaggaggaggagctgagcatggacgaggtgtttgggctgtcgaccacgcgcaagtacccgctccaggtggtcgtcgagcctaggcttcccgttcaactctactccttatgaatctgtgggtcagtgtgtgttgatgagtgggacgtacgtgattgtgcactgctgtactagcttacttgctttcaagtttcaaggtttcaagttgcgagttgcaaatagccgttggtgcagtccgtttataggtggccaaattggccccctgacccgacctacatgtcgggtcgtgctgtgccaaccaacgggctgcacacacggcccaataagattcgggtcgtgctgggccagcccgaaggaatgacagtatattgtgcttctccatagaataagtctactttttcatccctcaactctttggggtgtcttgtatggctagaaatatgtctattttgtattcctcttctctttgggccttgccttatatggttgattaagtctattttggatcccactactattttctttgatcatgccatgccggccggccgactgtgtcaaggcatcggccccggcacagcccactgttgggccatgtcatgcttgggccgggccaaatggccgttccttgggtcgggccgttgggcctcgggccatatggccaagtccgtcctctcctccatcccggtgcacctctcccttgccatcgggttgccgaatgggtcttgaaaaccgttgacaaatggcaggaatccttcctttggaatggattggactcagtctatggtaggagttgccttgtcgcttaacccaagatgtattagatcaagtagctcggggccctggaaatcatgaacctacggatcataggatgggtcctgcaaatgcaatgcgatggacttggctccagcgcattagagacccctgctaggccaacattaacctaccacaagtgcagtgtgtgtcggagattttccatgcgtcagtcaatctgtcatggtcgtcatcggagatggatgtcgctcgttgttctggttggacaactggatcgacagacagttgattcaactgatcgccccagatctgttccttgtcgtccctgtgcgtcgtcaagactccacttcggttgttgctggcctagccggcaatactaggatatatgacatcaccagcgccctgactgtgtgcatgctctcccaattccttacgctatgaaatagagtatagaacttcctgactctatccaaaatgagttcatctagcgttggatggatgatgggtacaacattgcctcgacctacaacgcgttctttgagggattgatctccttccttcctttggcgcaacgcttgtcccgcaaagtgtagcttttttctcgggcttgcactttagttacagagttggacggctgataaaatgcacaaccgagggatggacagtcataccatgtgtcctatgtgtgcgtaggagctggaaacgactcattgtatcttggtagagtgtgtcttcatgtgacaagtttggctcaagttgctacctaagattgagttgacctccctctcaccctgccgacaatatttgcttcatatttggtggagtcttctcgccagcggctactggatcataataggaaggggttcgattccctcatccttttgattacctggcacctgggctggaaaggaacactcgcgtctttgaggggatactttccacagtagagacaatggttgattgtattgtgcaagaaggaaagctttgtgtgggttacggcgatgcatagtcccctaggagtttttctcggtgcttagacacaaactctttctccttttcccttgttgttttcaggaatctagttgtctttcctagttagttttagaggcggatggccccatacggtagggtgggccggctggcccagcttgctaccagcccataccccatcccctcccctcccgggtcccgacgggagcattgagccacgcgctaggtcgttgagttgggctaggcccttgagtgcattgaggctgatcgaagtacaactactcaacgcctcgactccatgaacgcacgtagccacgcaccgccgtatgtagaaccctatccgctagtgctgccacaccagcaccacattgtgaacctgggagccgttcactgccgccttgttctctgccaccttattctgcatcattggcctcggttgtcctcaatttttttctcaatctacatcattagcctatgttgattgcagcagcaaaggaaaaaagaacattttttgggtgcgtatctccatccatacgtgatttgctcttctgggatttgtgttgttaaattttggtgggtgttgtcatgagctcaatcattgcttggtctctgtgtctctgaattattggtagtgttcgtgtgtgagagaatattagtggattgaaaacttttgatgatgctaattgggttggtttatggataaacaggtatggtatttctgcaattttgttgatgttctttgaaaccctcatcattttcagttcaatagacactccctcatcattaatatctcatggtgtgacccacctaattttgtcagtttgatgtatcctccttacccctcatgatcagcaagtcacggtcataaaatctcgttttttttcttgctaatatatttttgatgaaaatttcttgctaatatatagatgcgcaagattttaagcaaataaggacagtgccgattattataagttgatgcctcgcgcgtggcagttttattgattactatcatggccttgctttagttaacctcgctaaagaatactacaacctccatcctacaataagggtatttttgaaattcaaatttgttccataaagtgtatatttctagagttgtagttgtccattcaattcttccatttcaaacaataagatgttttgactttttatcaagttaaactatttttaagtttgactaagtttataaaaaatagtaatatttttaacacaaaataaacaaaataaacatgctaccaaaatttatccgatgttagatttaatgagactaatttggtgttttagatgctatatttttttataaaattgaacaaacttaatagaaatttaaaaaaaatccaaaacatcttgtaatataaaaaattacaaaacgaagatagtacctttcatttagattattactttcatttagattattactagttcctcctcgattataaaacatcttgtaatatactactgcctcctagttccaaccaactcctaatttagtaaggagcatttacattttttttcttccctaataatttttctttcaagtgctaaaaatgcacatataatgagatgaaggtaaaaaaaaacccccccccgcattgggaagaagagaaatagaaggaacagagcagctagcaatggaggtcggacaaacgacatgaagaaagggatatggaaattacatttatactgctttgaaaattaggtttaatgcatccgtggcaaagatcttgaattgggacttgagaaattatggaaggaaaaagtacaccgaaggtccctcgacttgtcatcgagttacaaaatcgtcctataaccacaaaaccagatatccaacgtcccttaactaatcgaaaccggtcacgataggtcctttggtgtttttgactccggttttatcctacgtggcagttgagtcagcgtggaacccacgtggaccccacatgtcagcgtggccacatcagcctcctctctcttttcccctcttctctctcttcctcatctctctcccttctctgccaccgtcgactgtcccaccagcatgaaggacagctggagggcgcaccggcgcgtcgcgtacgacggcgaggccaagaacctcaccgtcgcgctctcctacggcgacgcggcggcggcccaacagatcccgtgctctggtacgccgtcgatctgatggagtacctccccaatgccgtcgccgtcggcttcttcgccgttacgggcgaggccgccgagctgcagcaagtgtagtacttggagttcaccaccagcatcgaccccaaggacgtgtgggtggtgttgggactctacagcttgcttctcgtgctcgttgccataggggtgctctggttcgtgtcgcaatggaggaaagccggagagctcgccgatggcgacatctttgacgagatggggtacgacgagcttgccgacgaggagttcttcgtggagagcgggccgtggcggttccggtacagcgacgcgcgtccgcatccaacgcgcgcgccggccgccgccacaccttcctcctcccccgcgcgccggtcaccgccacaccttcctcctcccccgcactccggtcgccgccacaccttcctcgtcccctccgtctcgccgccgcccgaaacggcgtcggctggggcacccggcgcccatggtggaggcggctagatccggattcgccgtagcctctccgccatcgacggtggccggcggcggcgccgtgctcacgctcgtcctcctcgccgcggctgagtggtggcg

SEQ ID NO: 40701 - DNA, 1928 bp, Oryza sativa
gtattttaacaataaatagtacatatcattcaaatcactttagctattttgtgaagagaataatataccaattattatttttgaagtaagataatatatcaattttatagtctcttactctcttttgcctcatttatcatctaaatgtataagaacgcaaaatttctgttaaacatgcatgtaccaaccgtagactaaatatgatatacatagcagatgaagcaattcgattcggcagcatgcaaccttgtaaaattataatatgaaatataatcatgtttagtggatatatattaagatttgagatgaaagactgtagtatcccttgtgagtgggagggtggttgatgcgataagtagtactattttagtaatgcttataatgtgtataaattctgaatcctaaaaatgcttatatttgagctagctgtgcgattgtgcagcatgcaaacatgtactgttgtttaatttttgttccgtgcgcatgcactacatcggtcctagctacctcaaagtatgaaaactgaataggacataaattcaagcgtctgatctcagacataccaaatgaagccatccaaccgtatgttgcttacatactcctcgtttcaaaataactgacatagattaaagggtggttgggaagaaatttaaatgaggtgattgaagggaaaaatagtattctaggattgcttttttgagacaagatttaaatgttacaataattgttttgggacagagaggtagtccatgaatagatggccaagattttttttttctttttcctgatttaatctgagtatttctttctttttcgatcaatatgggaatttctagatttttttttccttcactagattaatgtgaggatttttaggagagccttagtatatataatgctattgaagagtccaatagttcctacattttcaaattagagttagtttggtcccataaaaacaaacgttgcatctattttcttattactaagcactgaaaagtgcaaattcttccttcaattcatatcaatgagttcattgaaaaccattcaagactcaagcatcaaattagatattaagttagtctagtataaatcaatgtgatcatctgcactgtaagtttgttaaccgcaaaaatcaatgtacattatccaaattactcatgttgtgtagattctacaggctgcactgaacttactggtttcgtagcggcccagagggtccatgttcctaaccaaaagagcaacaccataaagatacagtcagcgggtccagaagaatgtataatataaggtactagaggatttagttaatttacaaatgttaatttgcatgatacagacatacaccttagggcttaggccatcgatatcagtatgtagtatgctaatttacatacaacacagtagccccaatcatcttgcaggcacagacaacaccatcaaactccccccttatttattcacaatacagaaagacactagcagccccagtaaaacatcaagaatactacgctactctgtcgttttctgatctttgagacgacatgaggatcttggcctatgcagacggcgcaaatccatcattgaaaatgacctcacaggcacagatgatgttttaggatcacaggatcctaattgtagtgctggagcattataaaccgcagaattttcatcattagcaagcgacggaggagaatgaagctgctcagtgagctcggtttcttcgatgctgatactactgctgctcctggaactgctactagccaaggtcaccaaagagtttctgctcagactggcaagcctcttagggggtccagtttcataaacttctgctgctgtctcctgtgaagtttcatacatgatgctgtatgcaaggagattcttccgttttctcgaatatgcgctctctgccttcgcgatgtcctttg

SEQ ID NO: 40702 - DNA, 2519 bp, Oryza sativa
catggcgatggcggcaggggattcttccttgtgaagcttcttccgatctggctgagcagcatagtgttcgccgtcgtcgtctcgcaggtgtccaccctgttcaccaagcagagcagcacaatggatcggcgcgtcggcagcggcggcggcggcggcctcgtcttgccgtcggcggggctgcagtgcctcgtcagcttcacctacatcgcggtgctgccggtgtacgaccgcatggtggtgccgctcgcgaggcgcctcaccggcggcggcggcggcatcacaatgctccagcgcatcggcgccggcatggcgacgggctgcctcgccatggccgtggcggcgctcgtcgaggcgaggcggctccgcgtggcccgcgacgccggcctggtcaaccggccgggcgcgacggtgccgatgggggtgtggtggctggtgccgcagcacgtgctgatcggcgtcgcggaggtgctcgccgtgatcgggctggaggagttcttctacgaccaggtggccggcgagctccacagcgtggggctcgccgtgtcccagggcgtgatgggcgtcgggagctacgccagcggcgcgctcgtggcggcgatcgactgggcgacggcggcgaggagcggcggcggagagagctggttcgccgacgacctcaaccgcgcgcacctggactacttctactggttgctcgccgcgctcgccgctctggaggtggccgtgttcgtctaccttgcgcagcgatacgactacaagaacaaatccaagccatgatcgatcgtattcttttctgattttgtatcttcttattttagatatgaacaatggcgtgacgttatcatttagaaaaaatatcaaacatattcttttaattgtatatccctactattataaaaagagtaaagtgcacaggtagtccttaaactaataatggtgtgtcatctagatccttaaactcttaaaatgtatatccaaattctagaacttgtcatagtgtgtcatataagtcccaattcaccacagcccctttctacatggcgctgatgtggcatgccacacggacataacgtgacaaacggaacccatttaaaaattttcctttttcctttttcttctgttcttctatttttcttctcctttttttttctttcttctcctttctctgcgaccggagcataagaaaggaaagaaaaaccgaagaatgacaagaaaacaaaaaggaaaaagaaaaagaaaaagaaaagaagaagaaaaaagagaaaatgacacgtcacgttcatgtggtgtgacacatcagcgccgcgtaggatcctaaaggggctatatcgatttgggacctaaatgatacactttgacaagttctgggacctgaatctgtattttgagactttggagacctagatgacacaaccttacgagtttaaggaccacatatgcactttacttttacaaaaattaaagatatttttgccggtgttttggtacgtcattcgtgtttgagtcggtttttaaatcactcgcttttggaaatacagatctgtgtttgagtcgtttttttaagttcgttcgcttttgaaaatacaaaaagagtcgtataagaaatctctttaaaaaaacatacatgataattacttgagataatcaaacttctaattacagctcataattttgtaaaagaaacaaatccaagtgaattcccatagtaaatttcaccttaactaaaccgtataataataagatgattaacttatctaaaaaataataatatgattaaaataacctttccgttgcaacgcacggatattttttctagtgtagataagagagagagagagaagagtaaatgatgccttctgtttattagcatacattctaataggaggagactatatcaaatggtgtgcgctgaattgtcctaatcagcgaccttgttactaaaaatagcaggcatgtcgatgggtacgtgccaaataagcgattgcatagggcctccaatttttttcccatataaacatgaggcccacttccaattgcccagctatagcttgcaactgccaatagcccaattaggcagatcgatcagcaaggtcatgctagattgccaggggtggggcactattggactgtgcgatggcctaacttggccctgctgctagctggctgctctgcgattctgattccgcgccgtgacaactgctgagacgtccatcccaattccatgcacagtgactggcgaggcggcgacacaacttgctgcttgtgattccgaggctccgagcggcaacggtgacggcaaaacagctgcctcgcctcggctcctgccttccccctcctcgtccgctcatcatcctcgactcgactcttgacagcttgacctcggaccggtaagattagacagtgattgagtacatatatgatagattgtaaattcataatatgcatcaaattaccatgagttcatgattgtagtttataatttgaatgatccattaaatcaaattacaatgtttgaataaaat

SEQ ID NO: 40703 - DNA, 6919 bp, Oryza sativa
gatatacaatcagattgtatcattatgttcattgcaacttaatttttataacaagatctcacataattatattttaatggaagaagaatatgtgtagtaaattacttttgtgtatctataaattacttttagattggattagattacttcttagacattctcataatattgtgaatatgttacttttattgttgtttttagttagttctataatttatgttgattcaatttaatttctagatagacacatgtttttaccaccacaactgatttactttaaattttaataccatgataacttacttttattttgtgttaagttacttttataatttgtgtgaattattttcaggctttattgaatttactttcataaatatctaagaagtaatttattcaaatctaaaagtaattataagtagttatatttagaatcatgcaaaattatcccacatcctttaaacatgtgccaaataatgcaaaagacatataaacaaaacaaactgtaccataaaactgtcaaatcgacataaattttatcattatttttaactcctctaagaacatagttacttctaatactgcgaagagttacctttctctagtagtatagctacttctaataatgtgaagagttacttctattttttagttacttccctctagcatcaagtggtacttaagttacttctaataccatgaaaagttacttctattttttgagttatttctctctagcagtctagttgcttctagtatcatgaagagttacttctgtttttcataatttcttccctctaacaatgtattacttctaataccttgaagagttaccttccatatgttgcaaaattacattttttgaaaaaaaaatatagtggttacttcaaataaagaaaatatttgtatttacttaaaaatcttcgtacattttacttgtgaatttacttcacatagttattacaactgacctgctacgtaattagttctattactatggagagttatttctattgaataactaagttacttctaaaatttaagtaaattacttttaaatatttgaatatattcgatattttgagtgtagtaggatggttcaaacgaattttaaaagtaatgtgtggtttaaaagatataaatcatcaaaagttctataagaaagatagactagtataactaatcttgttggttggtggtggcctcaatacgtagcaggtgaaagggcgcacgccgtgacagtacttaatgtcaaccttaaatgcatccgtcgctggataaagacaaaatagtgtgcacattacttgttgactcgcacggatggatggctggtagacgcgtcgcgctataagacgaaacgagagcacgcacgatttagattttgcaattctaaaagatatcttgatagcttatatatatcctataatatgcctatataaaaataacattcattatactatgtcatctagatataacatgaaaatatttcaaaaaaaatatccatggatatctaagttatatatgtattattcctatcacttataataaaatctattttgggtgaatcagtgaaaaaattcattgaaaatgctttagtgaaaaaaatgcacaatacaaacatcgcatgaaaaatgcatgggttgataaaattaatcaaatctaccaggttttagcagagtaacgacattgctttgtgaagactctacttcctcctttcagactaaatttgtgcatgtggtgcttgcagttggtcgggtgactcgtcacctctgtacgtgcatctatctcgcctacttgtcgcagtacccactcagtagtcaggagaagctattgtggcgcctccgcgtgagaaatccatgttgctaaagcataaaaagcccatcctgcaggcgtgaacaagctatatattcctgatgcatacgacgatgctgcatgtgttgcgggtaatagaactgtgccgctctattaatgcaggtacagcaaggattgttactcctctatatacatatccgatgtatagaggcaaccaatgttataaaaccagcaccgaaatcgacatcggtagctaaatgtggaagaaaacaccgtagtagatccaaacacgatgacgacaccaaggcactatatttgataacggagttcagccgaggcttacatctccgaagcactgattacgggcgctcctccccgatccagcatattacaacgtatcagagtgacaacgactcacgaccggtcaccgccggcagccgctccctctcgctatgctatgtcgccatgcggttacaacaggcacgcccttctatttatgagagatcctagaatagagtccgactcatactctagtcctacacctaatacaactccaagtcctaaactctaaccgactacgtacacatattcgacacaaactctaacaaactccaccttggcgaatatgccacgccaatccaaattcgttacttgctcgaatttcagtgtaccaggacttgagttgatcctttttcgccgctcacaccgagccgccctgacaagcctccaccaggctcatcgtaacaagatactccagtatccctgtaatttcttccttctgactccacccgcaacaatgctccaccttctctcatatcaccacagtcatcttgcccagcgaattgaattcttcctagctgtcacatcatagacttctcgaagaccatgttcacctctatctaccgtcttaagtatgacttgatataatccatggctagataaccgatgtcataaccaaatagataaatcaaactcaccagacatggagaaaaccctttcttccttatcatcttatgaaccgagctaataaatccaacatccacactttttcgcatccgtagactgaattcctgataatttgagaaaatcaccgttgctttgaatcattcgaagaaattaccaccatagcgcttgctcttctccttcagtgacgcagattctatatatccccatcatgcaaaccctgcagattatggatatattctgtactgccaaacgattttcacccgctgttgcccgggacgttcttcacgcacgcttgttgtcacacacctacacccgagctgcaccttttgcactgatagcttggccacaattgatcgaagggctccccgaagtgctaatgtctaggtgttgttgcttttccacggcctcggcatccatcacagacactgactcggctggcaaaaatcatggactcgggttcggagtccctcctaccagtctccgtgttcatctcgctccaacatctatccgcaccatcagcctcttctcttggcccactcctgatcttagcaccttgcaccaccacgtctgcccaccacgcccgcgacatgcactaatccgagtgctaatgcactagtgccgctctgtcgcctgtagattagtccgtagccctgcacaccatgcaaaaacttcttttatctgtacgtctcatgcatccttcccatcatagccaccgtaagattaccaagccaacaagctcctgcatcataattgataccttgcatatacatgcaattaatttaaccaatgcactttggatttgctcctgtacatgactggctatgactcattgcacgagttccagacaacttctgctcgttctatattgtgtgatgttcctgcgcgtgccgctgccgcctcctccgaccggagctggcccgacgaacttcgccggcacctgcacgacgactacaccaagccgtgctcctaccactcgacgctcgtcgtcccaaatcaccgccgccaagaggtcccaatccgatctccttttgccttggtgatttgttcgattgcaaagcaatcccatggaactcctttgctgacttcatgaggccaattgcatccgatttcttcaaatcagagtccgcatcgccgcctcttctcgtgttcgacttggcttcgtcttctacaattgtgccgcacgcgctgtgaccggactccgagtccgcatccgctactgcgccgcgaaccccatcagaaaagataccgcgtaatcaccgctcaaaccgagcctgctaccaatgacgccgctttggtctacgccgccggcttgaccacaacgcgaggatcgctcacaccgccgcggccctgaccatctccaagcttcatgtacgcctccacgacttcctacaccgccaccaaacacttcgggtcaattccattgacagcgaatgccgccgatcaataaccagtgcctgccacaatgcaatgcttgtcgtgcgtacgtcgtcactgtagcaatccatcacgcactgcctcgttatcaacacctccacatcagcaccaaggatccatctgctccgacttccaattgaccacccctcaatccagtcgcgagccgaagccgacaaatcacatgccgtcttcccagtcgccgaacaacccgagtgctatgtctagccatctccctgtcgaacgcaactcatcgaaaggccccggccaccccaccaagagtgttcgattccaccgaccgagaacgccgatcgcctccagtttcaatcaaccccgagcgtgtggccacacgtctccctgttgagagtagctcaccggaaagttcgagccacccgcttgaagtgtccgacccaccgattggattgccaatcgcttccgccgccatcaacccgagcaccacgtctggtcatctccttgttgattgcagccatcaaacggttcaaaccgccgcctgaagtgtccgattccaccgatcaaattccgttgatcgccgccgtgctccaccttgcatccatgtccgtccctggacaccctgtgtagtcgtcgcggcgtggagcacctccctcgtacctctaccatggatctcccgtaggctctgataccacttgttataaaaccagccccgaaatcgacatcggtagctaaacgcgaaagaaaacaccgtaggagatctaaacacgatgacgacaccaaggcacgatatttgataacggagttcagccgaggcctacatctctagggcactgattacggacgctcctccccgatccagcatattacagcgtatcatagttacaacgactcacgaccggtcgtcgccggcagccgctccctctcgctatgctatgtcgccatgcggttacaacaggcacgcccctctattcatgagagatcctaggatagagtccgactcatactctagtcatacacctaatacaactctaagtcttaaactgtaaccgactacgtatatatattcgatacaaactctaacaaccaagtgaggatcgcgtacgcatagcacggccggcagcatctaagagtgactgagcgagtgcatgcgtgcatgggccgctcggtgcgccgctcacctcggtgacatacaaaaatcagacaacagataaagtactattagccgaaacaatatctacaatcataatcatgaatcattttaatcattgttcatgtactacaactgatattgtgtatttgtcatcttctaaactgtaattgccatctgtcataaagaaagctgattgagaacttatatctagaaagtacttattggcccatatgccaaagagcccctatttgatgaacatccatgtgcaaacagaaatagcaaacaccttattttctctctatctgtcaagtacattagttcatcacttccttacttgcttcgcatggcttgacaccacctcgtgcctttacacaagccatcacgtcacatgttcctgttcctcaccatagcaagacaccatagctacccttcctcctcctccctagtgacacggcgtattacaagaaaaatattttgtagagacatttttctaatactatagagacacttttcaaaaaatacctttacataggcattcaaaaaaatgtctaataagtgtcttatggtgaattatctctataaacgaagagacattttacaaaatgtctataagatggtagagatattttctagagacattagattgtaccacaatcatatgaaaccaatgaaaaaaacaataaaatattttcccttgtttttgccaatcctcgaaacttatgatcaattgcacaaatcattcttatcttcaaggtactaaccaactcaaccccaagtcattacttatatgttgttgccttgagttacttatatttagtcatttagtatatatttttattgtaagaagtgtctttacagagtttaaaatgtctcaagaaaatgtctttatatatcaggcacagtttaaagtaccgaaagaatgcctctacaagataaaatctaataaaatgtgctgaaaatatttctaaagtgttcatagagtaaaagttttctaggaaatttttaaagtgcctctataaaatgtctctacactataaaactcccgatctaagaggcaatttgcaaaatgcctctacaaaagtgtctttatataaaacttttgttgtagttgcggcaagtgcgaggcccttctttcttccccaagttgtgctagtagcaatcttggggtccttttcctagcgagacgaccattgccttctttctctgcacccccttactttatatcttctccggtgatgagctctgcaaccggttgaaagttcaagatttgagcaaaaactcagagattcaattggaagaagttaaagattttgaatataaagatgttttagattttggtataatgtttgtgatctcagttgaaagtttgaggagttaaaaagttttatatgtttcacttaaattatttgaaatctaggtatgaaaagcaattgtgaactgaagatttgtacaaaggagaaaaacgtatggcatataggtagagtggaagggaaccagtcgcgtatcagcatatatgcttaaaacaacagaatatatgagtaaagttggcaaatgcgtctttatcgtccaatattctgtttagatgct

SEQ ID NO: 40704 - DNA, 2857 bp, Oryza sativa
tccgtttcaaaatatttgacaccattgactttttataacgtgcttgaccattcgtcttatttaaaaaatttaagtaattatttattttttttatatcatttgattcattgttaaatatactttcatatacacatatagttttacatatttcacaaatatttttgaataagatgaacggtcaaatatgtgctaaaaagtcaatggtgtcaactattttaaaacggagggaatactatatataattatatattgtttcattgaatcacatcacatgagtaaaataattaggagtaccatgtgtacacgcacagttacacacgtccagtgcggtgcggacaataaaattacaaggtacggtgcggttgcgatgggccctggccggcgactttgccggcgatgaccaacgcaactgccgtgggatatcatcaaccgggtcggcggggccgccgtacgtcctcctccgcacggagcacgtacggtgcattgtccaagcggcgtcacacgagccgcaagcccaccatcccctgaacagggttcactctatcggttgagccgtttatatcgggggtcaccgaaattccgaaatttcggaaattttaaaaatttcggtctaaaatttccgaaattttgagtaaaatttagttgaatttaaacaaatattacctaaatttatgaaaaaaatttaaaaaataaaaaatttcagccaaaataatatcgtatcggaagtgaccgaaatttcggtccgaaatttccaaccctgccctgaacacactgtcagatgggctaggctgggttcggttctagaggatggaccgttaaacgagccatggtagaaaaaaatctaggtaaaataacccaacaaatggacaggcagttccatcggccagctcaactggtgggtagactattgctgcaaaagacttgtaaattaacttcttattgcagatcattttctttatgaaatgttatttgaaattttatatttgactttaattcctttttaaactattttggcaatggcacaacaggaacaggaaaagaaaacccaataaataccagcatgataaaattttgaaaaaagattttagctgtttcaaattttgttacacgttaccatctaaactccttgggaaaagaaactgttgatttggatatatattagtatatatggtcttcaagataaaagtttcaccgtcaatttctattgcaaggtatttaaaaatgctgataaaattatactaacagtattttttttaattcattctaaatatttaaaaggacattaatatcgaaaacttttaaagtttgccattaaacacatctaaactgcaatgagattccattaaagtcaacagtatagttgttccttcaacatatatagcagattgttaaagtaggaaaacacttccagaaattcagtaaaccactgagaagttcatttggaatatctgaattaatataattgaattaaactgaaatgttacaataaccctctttttgacagcgacacaataaataaaggttagttttaaaatattaacagcaagaggaccaacagggcgacaggacagagggcccaaaaccaagcaggatcaattgataacattttggttaaattttcattataaactgttggatctagcagtcaaatttgaggttaaaaaacaatatatacatgaatacccagaatccaccacatctctttaatagtacctacatatactgctgaactgaagacatgaatacctttctttctctatggtgacctacagaatgtggcacagatgtagcagtgccacagatgtaacagttattcaacttgaacaattcaagttaaacctgggaccaaattaaaatctgcggccatgctgcaaatacaccccttgtacttccaacacaatctcaacaataactgttctttcaatgcagccaattgttgttgcaaacttgcagttaattgttcatgcatctctgcatgcattgccctaaaggaaagataattaagttgcccagtgccagatgcacaatggcaagaattgcagatctgagaaaacagagagaacaatcatcaacttttaacggcacatttactaacaatctgcaaagccggtgcctgattgaactggtagctcagctgatcactactatctactacctagctagtcgcagtttaatttaacacaccatctacctagttgcaatttaatttactctctcctgcatatgccaaatgcttctgttgcacttgcatggatatgaacataatattgcatgtagctttgcatgcatatgctcttcttgatcactatataaacccatcactgcctctcttcttgctcatctcccaatccactacttcttgctgatcatcatatatctcttgtgagcttcagcaatgggggctctgccaagggctctagtcctcggcgtttgcgccgccgtcttgctggtgaacgtgctcgccgttgccgccgacggcgacgccgcggcggcggcgtccatggtcgtcggattggccaagtgcgccgactgcaccaggaagaacatgaaagctgaggccgttttcaagggtatgttgatatcataaataatcacgcaatatggtccaattaatcattgtcatttatttaaactactacctgaaaaatgcttgttctaagttctcataaatgcaagacgtttttggttgtcctaagtcaattttttttaaattaaaccaaatttatattaaaaatatatatcgcaatatttatgacaccaaattaatttcattaaatctatcattgaatatattcttttatattgggtatatattttgggttgaaaatgctgctgcatttttattcttgattttgtt

SEQ ID NO: 40705 - DNA, 8714 bp, Oryza sativa
aaggcttgacttgaccatgggtgaaaacgtctggcgacgtgttggcgccaatccgggctcgacgcgcggcagcggcgagggttaaaacggtcagcatggcggtggtcggtttgaattgtgataggggaaaccaccgcttatcttcaatccaacagtgcggcaagaattggcgcgattcaccccgggtagaagcgaattcggacttggcggcggctttggacgggcgtgcacagcgtcgagcggcggtaacttgcggcggaggtcatcctggcttcgtcttcatcacgattggtgcggtggcggtggtcttagggcgtcgaacgactagcggcgcgccaaggcggtcgggcacacgcgaacggccctgaagccgacgcgcggcggctcggcgtgcggcgatggaggatgccagggtggcgcaagtaaagggggtggaaaaggcaaagtgaaccacagttttggatgggttgtggtccccaaggatcaaacttagactttgcaaaggtttgggtagatgttgggctgagatagttgggctgggcatttcatcgaacaccttgagggcaatgaatagtgttttcagaaattttgaatatttttcctagaaaagaatgaatttaatctataagtttgaaagggtttcactagggtttagagtatagaaaattctcactaatgaaagggggtaaactaaagaaatatactaaagttcgaaatttgtgagaatttgctaaaattcactaagttttaggataaagggaataattagggtaagttaaaagagttctaaaggaataatacttgaaccaataaaaggattcaaataaaattttaaattgtactaatctagtcaaaaaccagcatgatgcagtcaaattttagtttaaaatttgaggatgttacattattatacaatgcgaagaagcctagctagtagtattttgaaacttaggcttttcccattgtctttatttggtgatgcatttacttgggtttatttcacttgcaccaactctattcatgattggtctgagttagaacaaaaatatcatgattacttctttaattagtggtgagtccgaattaaatttgtcgtacttaatatcggttaaaaaaagtataatgagcctacttttgatctacattagaagattttatatatacaagaaaccgatgttatagtttaacactttctgataaggtcttggtagatttgccttattctggtttacttgaatatttaaaagaaaagctagatggtcatactttcttagatgtaagccaattacttcaaatggctttgactcaagagagccaagttaaagaggccaaaatctcatagaaatttatgtctgattgttcccatgttaatatagtttatgaacaagaatctttgaacaatgagacagttgatgtatacatagacgaatgggtttggaactccaactctaaaccattcgtttgctccgttcttaagctggttagtcgtaagaatcgacaagaggaaataacgttcacttttgatgtggccaaatgcaattagaaacaaaggtagctcatccacctgcattaccttttcctatacagactgctgaattgcaagagaaggagattcccgatggcaaggagaagaccacattgaagacttcaatacttagggggcaaggtgacaatctggagatatcaaaatatgacaagcaaccaaggagatcaagttcatctaccaagcgagtatgcaccaccggcaactaacttctccttcttcatggtattacacttggagaccacattgaagacttcaatacttaggaggcaagatgacaatctggagatatcaaaatatgacaagcaaccaaggagatcaagttcatctaccaagtgagtatgcaccaccggcaacttacttctccttcttcatggtattacgcttggtttgcattatggagttttaatggtatgtggatgatgcctatttatataccatattatcatccattatgggcattgccggttgccacattgaccgattttaaataatcaaccacactcatctcatagccggttgagagaaaataatcagtcacaaaagaatccacacaagaaagtggcgaggcaagagtggaggctaaagaaaaacaaaatacaatctgaacaagaggggcctctcgtagctttcttacatcaccattaaacatttaagccttagaggcattcatggccggtattggtggatatcgcccttagatgatctcatgcatagtattttttggctcacaagtttgccgaaaagacaggggggcatgtgttgataatcaaatttggcagtagagtcgagttatagcaagtttgagccaaatttataaaatgccagagctttcccgcgaagactggtgtgaccgttattatgtggccggtcaaaccggacaatgcactgtgattagaccataggtatccaggcggttagaccttaatcacatagtccgagtccaatttaatttagatacttctcgtgttttcttgttttacaccaaaatttttgagtcctagttgatttatatgcctaattgcatatgaaaaaaccccaggaagcaagtccacccctcctataaatataagggggccaaggacggggggccctaatgggcgatcgatcgccaggcgatcgcctgggcgatcggatccagcccccctccccctatactccctcctctcccctattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaattcaaatttgaataggatgtataaacttttgacttataaatttttggtctctaaactttagatgtgtaaactttaggtgtataaatttactaaaataggaaagtaatgcggtgccaacaaaggaaacaaggtggagagatggagggaaggagggggggggggcgcaaaaactgatcgccctgagcgattaagggcgatcgctcgcccagtagcattcctggccaaggacgattgaaacaacaagcaaccaatcgtcaaaatcaatttatttatccaaaccctctatattctacatatatctccctccttcttgctacctatctcaaattttattatcctcaaatcctcaattgcttggcatctgtcgtttccacggtattagaagatgccctagcttgcctgccgagcttaggataaaccaacgttcgttcaccctggcaggtgggtgttcgttgggcgcaagttgcacataacgtgctaagatgtggtgttgtgattctacgtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggcctagctctcgtactcgccgtcgccgttcctgcacttgatcgccacctggagacctgaacatcaccaaacaattaatcaacgacggtgatatatcgatcgatcgagctgagtacgcaattaattagcgatgaacatattatcatcatcatcatgatatatatacccttgaaagcatcctgccccttcatgttcttgctggagcagtcgccgcacttggccaacccgacgacgatcgccgccgcctcgccgtccgcagcggcggtgacagccatcacgagggcagtgcagacgatggcggcgaagagtagtgctcgtgctacagctgccattgctgataaatcctcgcaaactctatgtagcaagaggctagagctgtgtgtggatgagtgaagaaaaagcaggctatgcatgtggtttatatagatcgataaaggctactagctgggagtgatctgaggtcagctaattatattacaacatgattagcaatttgcgccgaatttgcaggtttaaaatcattaacgccgtgcattttatttgatttgatcagacaccgatcgattaagagtagcagctagtagttcatggaggcactgtgaacattcacactgcatgcagtgctgactgttgatgcacttgccgccgattggtggtgtttaacaaggaaagttaagctttaatcgactggtactcctacagcgcacagtactactagcctgttttataaaaagggagaatagttctatagtataggacagctccaaccaaattgcatgattgatactatttttcagtaaatgagtaaatttcacaaaaactacagatactttgatcaaactattgcaaaactactgatttaaggtgttatatcataaaaactacagatttagtgttaagtttatcacaaaactacagatttaatttgaaatatatggtcacaaagctatagattaagtaacaaaattatcataaaactacaagtttagtgccaatttaatcacaaaactacaacatttatagctcaaacataatggtggtgctatagatttgacctcaaaattttgtagttttgtgataacttcaatgttaaatatataattaattacgtgatacttgaccttaaatatgtaggtttctgataaatttgatgctaaatctgtggttttgtgatagttcgatcaacatatccgccttataaacatatgattggaacacagtcgtgagtgtataagtgcggtgtatgtatttagtggtgactacgtgcatcttgtctgtataatggtagagaatatacttgttgacggtatataatagtttttttaaagtatagaagatgttggtatcaaagtatacgcgagattgccgtaaagtaaacgagagacagagatttttatattgattcaggccccgatgtgggtaatagccataatccagtttatatgaatatctctagaatgtatcaaactgattacaatgggggagcaagctagctaatctagcctaccaacaagcattcaccaagaattaatccaacgacttagaatcatcggctagctattgacttcctcctgattgatattcgatgtgacttgtggctatggcttatgattcgatgctctttgatctctcctaggggctatatatttatacggacaatcaatttcttgttaagtagaattcgaggagttcatatgggatacgagcaggtaagagttttgccagatcctgtagtcagcggtacacgagcataacccaagagtcttagcgatgagattgccgaagctttcaaaaacacttttggcatagatactagggttaaaaagcgtatagatcaaaaactctaccctgaccactattataatgctccatatcctcaagggtttagactgcctcattgtgtaagttcactggagaacatggctgatctactttagaggatatcgaccaatttatttgtcgggtcccaaaattaaaaacttggatccggctgagattaatgtatcaacccctggatcagtaaatattgatacataatatgcaactggttcttcattgcatacgttaaattttacaatactaaggttttacaagaataggtactcacataagtaagactattacatagaggttttatacattctgactagggaggtataacctctagggattttctatgttattggagtcatcgtagtaataatcataggagtcttcttcttgacccaaatctgaaaaaggggttataagagcaagggtgagtattcacaatacccggcaagttaccatggaaacatgttatgtgttggtatagagtagagttctttgcaaaagacaataataaacaatctggaagtattaaagcaagagtttgtaaatacatagactttaggtttctaaccagagtactatatgggtctcggtactcaattccatgagtacggccattcgaatagtttcatgaatattctactacagtagatgtacgctttactcgcagtccacgacttgccaatattcattagcttagtcatgacccagtattaggttattaacaattgtggtacctgttccatgaactctagtcctcatgcgctctgaacgtaacgttatcagcagcgagaggagttctggtgttcccggggtatttaagggggatctcgtatgacaccacgtcatctcgatcagggtttagaattataacataataatttatactcgagtatcatcgaccatttacttgtacatggtaatggtaaaaattgcccttcgtggctatagttgcctcttgctcgaggacttaaaaataagaaccacgatacagaggtaccacattgctaattaatataatgactaggtatgtccctattctagaaactatggtcgtacctgttcgttcgacataagtacctggtaataactatatcgatcgagacagtactagccacccgaaaatcatccaattcctacgtactgtcccaatctaagtatgaaatatttagaccagattgtaagcaaaataagcaatactaaattgtttgggtttctatggttgaattatgcatataaaatagagtattgaatagaaggctataaataaataatttgtaaaatataggcttaaatgatcaaaaggtagaatagtaacttgccttgctcgatgtcctgagattgactgatattatctaatatgtcagaggactcttcaagacctagggttaaacatataaaattcaaattcaaaaggaattcaaataaaatccaaaaataggaaaaataaaataaaatagaaaaatagcaaaagtagactcaaaagatagagaatgattttagaagaattttggtccaagtttcactggaattggatctatattttaaaagatatgagcttctaaagtttgaaaatcaaattaaatgtgaaatgatactgtgtgcgggtcccacctgtcagtctctttctctcttctcttcttcaacctctagccgttccccatttacggccggcggtgctagggttagcgatttcggcggtgatagagggggaaagggggttgcggccgaggaggggaggtagctagggttctccggcgacggcgagtggcggcggaggggttaatttgatgtgtgggtgggctaacggctagggcggcggtgacatggataggccgtgaaggtgatcggggtggtgagagttaggcatagcacggggagggttcctagagcatctacggggtacttagaaggatttaggtagcttgccgactttcggcaaggtgtggaagaacttgccgacgagcacctccattggcgacggacgagctcatgtcggcagcccagaaggtggcatggtaatgctggccgattgcgaatatggaatctagggagtacgtagatggttaaaatgaaagaactcaccgagataggctgagacgacggattgcggccggaaaaacttctcggcggtgagaaccagagcagagcaggggcgacagtgcttagctcggtgcgacgaggtgaaactcgacgcaaagcttcggttaggctccaatatgctagagcatggttgatattaggtgttctaaggattagttaggatggagagtggatggaggggcgtgaagtcaatcgcacacaaggtgttcgaccgacgggcggaagtggttgatggtatggtttggcaaagcagagcttcaggg

SEQ ID NO: 40706 - DNA, 10801 bp, Oryza sativa
  unsure (1)..(10801): unsure at all n locations
tcctaattaatagataacttaccatgccgtattctctttaaactcggtctcttctggataagcttcctttagtagatcaatttccttaaccgaatatagcaagaatccgacaactgacgacttgacaactctcatcggctaatctcaggacttcgaagccgatgctgactctacgccgatgactactccgggcttaccaaatttcactgttaacaactacgtggcggagctggagcgcgcgttggaggtggtcgagacggagtccgcgagggcgcgtgtggagctggagatcgaccgtgcagggaggaaggtcgccggggaggagatggacgacgacgacactgacagcgcctccgccgccgtctcgcgccccgccgtgcccgtggtggcggaggcgacgaccgtgctgttgctcccggtggtgcacgaaggcgacggcgacgaggcgctcgcccacgcaccgaggcggaccaagacggacgtggacgtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccgccgccgctcacccagccgcgcccgcagccacctccgctcgctcagccgcgcccgccgccaccgctcgccccgccgctgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatatcctatcttactataaagttatcccccactaacttcttaagcttaacatgcaaagatgccacatcatcatccactaacaagatgccacatcatcatccactaattaacaagataccacatcatcattcactaacaatcatcacatttaaacatcatgcaaacatgctatatctttatagtttttataatttaagagcttttcaaatacaaacatgttaaattataatctaacataattatgtgaattcacatcatgtttcaatgtatatctttattatgttttatgatatcctatatacttatatagttcatcctcacttagttagtgcttaaatgattaatctatggttcaaattatctttctctttttttcctctaattaagtcatatcacatcaattgtttttagcctttagatgattaatctacggtacaaactatctccctacttttcttcttccataaagtcataccaccttactttttacgtttgaatcaccattctacatactatttaaatttaaattatcgtaaaccacattaatttacttaatctgatgttatctagttatcttacacgttattttttttattgttatcatactaaatttccgcagtaatgcgcagagtttcatctagttattgaaatattcatgaagtaacagaaaaaggaacacctgtaactgtcgatctattattaactcaataaaacaatataaaagccaccatattcactctcatgacctagaatttcccatattaataaaaaagaaaaaaatagagtccaagtgtatagattaaaaatatctgtaattcggaataataataaaaggataaaagaagtacatgtagaaatgcaattttgaaaagaaaacttaaattcgtatttaaaaattaaattaagacaagagtcaacgtagaaataccttttaggctgaaaaatatgaaattcggattaaaaatttaaaataaatattgaaataaaattatatgtataaatataattcaatctaaaagtcggaataaaaattaaaactacaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaaggaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacctgcatgcagtgtgcacgttcacagtgcactactcttaatcgatcggtactgcctgataaaatcaaacttacggcattaattttgaacctgcaaattcggcgcaaatttctaatcatgatgtaatataattagctgatctcagctcactcccaggtagcctttatcgatctacatgatgctatgcatgctggcgcctatataaaccatgcatggcctctgcttcttcttcactcatccacacatagtaaggaggaggggcaatagagtttgctaattgctaggattgnnnnnnnnnnnnnnnnnnnngtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaatttcaacatgtagcacgaacactactactcttcgccgccgtcgtctgcgccgccgtgatggcagttgccgctgctgcggacggcgaggtggcggcggtcgtcgtcggtcaggccaagtgcggcgagtgcaccaggaagaacatgatggcgcaggatgctttcaagggtatatatatatcatgatgatgatgatgatgatgatatgttcatcattgattaattgcgatcgatatatcaccgtccttgattaattgtttggtgatgttcaggtctccaggtggcgatcaagtgcaagaacagcgatggcgagtacgagagcaaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtaccgctgtcgtcaacaacggacaacggcggcgacaaggctaacaccttcgtcgtcgtcgctggcaagaggatgcactcctccacatcgccggcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaatataagttgtgagatgtgagaggagtgtgactgtgtgagatcgatcgatcgtgtaggatcgaatcacaagaactaagccaaccagagggggtgaatggttggtatacccaaaaaccgaaaacttttagcggaaataaaagttaccctcgaaatcgatggagatcggtctgaccgaagtagattagccggtctgaccgaagcgtagcccccggtctgaccggtgttgatctaccggtctaaccgccgtgatcgcctgccgcctactgtcgccgccgtcggtctgaccgccgtgctcccgccggtctgaccgccgcaatgccgctggtctgaccaccggtgagttgtcggttagaccgccgaaacccggtgaaacacaaatcgaagaactcttaaagtgaatgacgactttattaattctctctatgtttacaaagtgcaccaacaacactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcgtaccaaatttggactccttccaatttcgactccgcatcccatacgcacacaataactccatcgtatgccatatggaatctccatcaaccacgtgcatcaactctagccttagtatcccgcatgatctctgaccacaacggacgtcgtcttatccccaagccaactcccggtccatcaccgtaaatactctcccgagacatcgagtcacctacacatggaatagacaaagaaaccatattccgagaccaagctatctccaacttgactcattagcagtaaacaatagtattacatacgtataatatccatctagaagtcataatcatgaaataaactcggatatccaaataaacaacccgaaaccgaaaccgacacagtgtcggccggtcagaccgcgggctggccggtccgaccgcttgatcaccgctggtctgaccggcaacacctgcccggtctgaccggtccacataaaatgataacctgtagattcacctgtgaaatccaatcatctccaaaccacttcgtgaataaattccaaataacaaaaccaataatctctaatgctcaattgttcatcacagaataattatcaaaaacacctttgattttacagatcgatgtatgtgttggagacttggagtcagtgcataagcattggctttcaggtgataaataatttcagagtgcttatgtgtgtcgtgtctgtatttattcgcacatgtaatgcgacatgtgttctacataatgtaatttaaatatttataagattgttcatgttgacgtagaatcgcaatgccacaccttgagcacgttatgtgtaactcgcggcagcactcggagacgcgccatcatagggagtgggtagatgccgcccaacgaccacccgcgaaggaccccatcaggatgaacgtgcgtcggtttgttctaggctcagcaggccaactaggacgtcctctaataccgtagagacgagagatgacaagtaatcgaggatttgaggatttagaatttggataggtagcaagaaggagagagatgtagaatatagagggtttggataaataaattgattttgatgcatgattgattgcttgttgtttcaatcatccttggcccccttatatttataaaaggggtggacttgcttcctggggtttttccatatgcatttaggcatataaatcaactaagacttgaaaatttcggtctaaaacaagaaaacacgagaaatatctaaattggacttggactatgtgattaagatctaaccgcctggataccaatggtctaatctcagtgcattgtctgctttgaccggccacataatgacggttagaccagccttcgcgggaaagctctggcattttttaaatttggctcaaacttgctataactcgaccctactaccaaatttgattatcaacacatgccccccctgtctttttggcaaacttatgagccaaaaaaatactatgcatgagatcatctaagggcgatatccaccaataccgaccatgaattcctctaaggcttaaatgtttaatggtgatgtaagaaagctacgagaggcctctcttgttcagattgtattttgtttttctttggcctccactcttgcctcaccactttcttgtgtggattcttttgtgactgattcttttctctcaaccggctatgagatgagtgtggttgattatttaaaatgggtcaatgtggaaactggcaatgcccataatggataataatatggtatataaaaaggcatcatccacataccattaaaaatctataatacatttataccaagcgtaataccatggaaaaggagaagtaagttgccggtggtgcatactcgcttggtagatgaacttgatctccttggtcgcttgccatattttgatatctccagattgtcgtcttgcctcctaagtatttgtcgaggaatgatcctctctagcaggtggtcgtgagacccccccctttgtgagttcggccgggggaaatggcacgatgatcaagggcctacttccgcttgcggtctaatcgctagatcgctctcgtggctgtgtgggagatcaaggattatacaggttcgggccgttattgagtgtaataccctactcttgtgtatgggattatggtgaatttttacatgaggttttgagctctaagggaaacctagctgttcttcctccgagctcaagttctctgagagtcgtcccctttctcggtgggcgaggtcctccttttatagtccaaggggataccacatgcactgtttgcacctacccctccatcggagggggggcacatggccctaatcataccgctatcctttgcttcaactggaagcaacatggtcgcctggctccaggtggggcccagcgccgcccccgcctgacacgggggacatccctgtcattccctattattgtatgaagacttcggcggctcaccacgcgcgtggggcgcccctggaagcgtgccgatgggacagggcatacctgcccccactccgcctgacacagggcggaacgtgggggcactgcccccgtcccgtcgcctgtgaccggtcacaggccggtcaagctcgattgatatggtgttgacggtccttaaatcataatatcggaccgtcaatacctgcatataatgaaataaaacatggtatccaacttagtggtaggtattattactaatcatttccactagtattggtgaaatatgtgtatgcaagtaatttgaggagaaaacacatccgtcatgtgacaaaatgcacctccgcgcattcaggacgcgtttacacggattagaggcccaataagtcaataaaaaccatttagaattgggccaaaacatagcccaggttgttgggggcccaataagcaacctcccggctgaaggagaggccgggaggagagtttttgggtttggccgaacccaccagttcggacaaaccaatcctggcgcttcccatcatctgctttcacctggacggctcggatttctcccctaaggcagttgcagggtgttttggtcatttcccatacccctaaccgtcatttggagcctatataaggaggtcacattctcatttccaagacacacaattttgagctgaattataagaggctctattgtatcttttgtacattataataaggtagagagtgaggggaagctctggaggagtgcccggaagtttggcgctcatccgacttctatctcgacgagtgtagcttcctaggaggaattcggggggagtaccggagctgtcggtacactctgctctgggttcggagaacctcttctataaagtaagcattcgtgttcctttcttatattatttaattactttgtctaagtaagatagattttcatctttgcgggttctttatctagtattcatactaagtgctctagtactaggactctggataaagaaggaagttcatgtacaagtattagagtagtaattaataacttagacgtggtgtctaggttagagattacctttgtttgttgtgtatcccacggatttgtcagaggtaggcgacaagtggtaacagccctgaatcccgtcctaataattctccacgttcggatacatcatagagctatagccggaaccacgctggcagaccagcaggggtcggtgcccgaaacaacaaataggaaattaccttcaacttagcttagataattaaaacacatagaaagtcctctctagcttgcctagcctatctatagttgttgtcattggatcgtcttagccttaggtaaattacacacgttccctgagttcgatatctttttggggtcacccgaaggtgaagtgctacaacagtattccgtgcgcttgcggatttatctgtggacgtaagaaataccaacacatgggtcaatcgagcggcgccgcacatccctccacgccgcattaaatgctgcttggggcggttggtgcaccgcgcattgaaggcgcggagcagtgtctttcgccccgcccgctctccccgccacgaggtggtcaggcgagggcctcggggtagcacgccccgaaagcccgaggagtgcgacgtggcaccccgaggtccctctggccacctcagcgctacccgaggggcggggggaggcgaggccacgtagccacgcgactagatgggaaggatacttccctctactgtgcgtacccccgggcccatttcaccgacagtattgaagtcttcaatgtggtcttctccttgccatcgggaatctccttctcttgcaattcaacggtctgtataggaaaaggtagctcatccacctgcatctttgtaaaagtcaatcgtcattcgtcaattgccgattgaacttgtctatggaatacattgcaatcatttgtggcatgagaattggagttgtgacacttataatatgctcgccgctctattcttcaagtgaaggtatggcgtggccatgtgacaatttaattttcttcttttactagtaattattcaaaaatcctattgcatttggccacatcaaacgtgaactttatttcctcttgctgattcttacgactaaccagcttaagagcggagcaaacggatggtttagagttggagttcaaaacccatttgtgtatgtatacatcaactgtctctttgttcaaagattcttgttgatcaactatattaacatgggcacaatcagacttaactttttgcgagattttggcctctttaactcggctctcttgagttaaagccttttgaagtaatt

SEQ ID NO: 40707 - DNA, 743 bp, Oryza sativa
tggtcaatgcttgcaataagagaaaaagggaactgaagtgaaaataagtagccatatattcctagaaaatatactacaacaaggtaagaagtgcaagcagtaggcaactagtcattgataaatatttcacatgtataactttcatcatttacagatcagtagatgccaaccattcaaatttgctataaggttttaaacctcagtaaccagtactccttgtttgattaccttgtagcaaagcatacttgaatcaggcttgtacttagccttataagcagtataattacattttgggtttctatattggcaaatctaaaatttggtttatggttttttgatatttcatagagaattacagttgaaaaacataataattttaagcaactatttcacaatttgcttaacctttaagaaatagtatctaaatctagagaaacttgtcacaaataaaaggaacacgcatataaggaaataaacacaacttagaaagaaacaaattattctagtcccgtctatggttcttcccaactaacattgcactgtggcgggataaacggtgtcaagtaacacagtactactacagcacagtcatgcattagaagatgcatacataaaatgtcttgaccaatatatccactttgaatggaccgtttcaggagattactcttaatatgctgatttttagagagaactaacttgcaaatatacataccaattaaaaaatttaacaacatattgtgtgc

SEQ ID NO: 40708 - DNA, 2410 bp, Oryza sativa
atcctcaaactctgttgttatttggactatgtggcaagaggctagagagctgtgtgtggatgagtgaagaaaaagcaggccaggaatgtggtttatatagatcgataaaggctactagctgggagtgatctgaggtcagctaattactccatccatctacttttgatagttatattttcatcttggcacacagatcaaggataagtaattctacttatcatccattcaaacatgctactccctccattccaaattgatctacatatagtatttttgaggttatttctaaatgatctacatatttgtgttcattcattaggtttattcgttgcttgtacattggagtaaatggacattgatgcatgcatctatgcacacaagtatttataacccacatgcaatatcttgatttgctattggctaggaaatagtggggatggtgcctgcattgagtttgttgctagagtaaagatagtataagagagttattagtttttcttggtcttggtgtacctatgaaatatgtagatcaatttggaatggagggagtactagtcattcctcgtaaacaaacgatttattaatatttacatttctcgatgcctatgcagccaatcttatatggaagaatggtgagtcacacattaaatccgagaaagttattaagaggataagttattggattgaaatatgcctatcgaaaataaattttttagatttagaaatataactatcaaaagtagatggagggagtatattacattatgattagcaatttgcgccgattttgcaggtttaaaatcattaacgccgtacgtgcattttatttgattagatcagacaccgatagattaagagtagcaaatcatggaggcactgtgaacgtgcacactgcatgcagtgttaactgttgatgctcttgccaccgattggtggtgtttaacaagcaaagttaagctttaatcgactggtactcctacagctagcgcacagtactactagtctgttttataaaaatggagaatagttctataatttaggacagctccaaccaaattgcatgattgatactatttttaagtaaatgcgtaaatttcacaaaactacatatactttattcaaactattgcaaaactattgatttaaggtgttatatcataaaactacaaatttaatgttaagtttatcataaaactacaggtttagtgccaatttaatcacaaaaatgcaacttttatagctcaaacataatggtagtgctaaaaatttgacctccaaattttgtagtttcgtgataactccaatattaaatatatagttatgtcatacttgaccttaattctttaggtttctgataaatttgatgctaaattaatctgtagttttgtgatagttcgatcaacatatctgcgctattaacatatgtttggaacgcagtcatgagtgtataagtgtggtgtctgtatttagtggtgactacatgcatgttgtccgtaaaatggtagagaatatacttgttgatagtatatatccgataacagtgtttgttttaaagtatagaagacgttggtatcaaagtatacgcgagattttggtaaagtagacgagagacaaggatttttatattgattcaggccccggtgtgggtactagccataatccaatttatatgaacatctctaggatgtatcaaactgattacaataggagagcgagctagctaatatagcttaccaactagcattcaccgagaataaatccgacgacttagaatcattggctagctattgacttcctcttgattgatattcgatgtgacttgtggctatggcttatgattcgatgctcttctctcctaggggctatatatttatgcggacaatcaatttcttgttaagttgaattcgaggagttaatatgggatacgagcaggtaagagtcttgtcggatcctgtagtcaatggcacacgagcataacccaagagtcttagcgatgagattgccaaatctttcaaaaacgctttcggcatagatacttagggttaaaaagcatatatatcaaaaactctattctgaccactatgataatgttccatatcatcaagggtttagattgcctcaatgtgtaagttcattggagaagatggccagtctactatagaggatattgaccaatttattattcaatgcgaagaagctagtgctagtattttgaaacttagccttttcgcattgtctttatttggtgatgcatttacttggtttatttcacttgcaccactctattcatgattggtctaagttagaataaaaatttcgtgattacttctttagtggtgagaccgaattaaatttgtcatacttaacattggttaaacaaaagtataatgagcctgcttttgaatacatt

SEQ ID NO: 40709 - DNA, 722 bp, Oryza sativa
tggtgtgccgataaagacacccgtatcagcaacagttttagaggaggcattgaatggatcggttatggtttctcagctccagcttggaaactctgttcacaggaaggtaggtaatggcaactagctgtccatcatccaatgcttcttttcttgatgttagcaactaaataattgaaagctgcatgtggccaggtggaaaagcaatcagctcatttttattctgttgacataacagaaaaggaagctaaaatggggttagtttgtcgtgtgaaatcaactgatagaagcaaatttaaggttggtttttgttagcaaatgttttatcatgtaacctgtgtttcgtaagtacatttcatgcggttctggtgttgtcagttctgttttaatttattttgatctagacttgttcaagttgtgtacatttatcctgcgtagtgaagctatccttgtttgacaatgagaaaatttgcccttcagttggtgaaatttagatgatttactttgacatatagtactccctctgtttcatattataagtcgtttgactttttttctaatcaagtttgaccaagtttatagaaaaatatattagtatattcaacacaaaataaacatattatcaaaatatattcaatgttagattttgtgaaactagtttggtattttgaatgttgctaattttttctatgaacttagtcaaacttgactaggaaaaaagtcaa

SEQ ID NO: 40710 - DNA, 848 bp, Oryza sativa
atgcccgcggcgagcgagcgctcgaaggcggagttgagggcggcgtgggcgcggtgggcgacgggcatggcgcgcgcggcgtcggcgagctccgtgaggtacgcgtgccacagcttgtaggagcccgggagagcccgcagagcgcgctcgtagatgaccgagcgcttcgccagcggcgccgagcggatggccgacaggtagcgcgtccagcaccgtagccggaacggttcgcgcaggacgtcctcctcgtatggaacgtcctccggcgagatcatcatcgccgccaccatctctctaactcttttgactgatgaagggccggtctatcttctcttctcgtctcgtctgatcgttgcgttgcgctggatttggatgggcgattgtcgacgaggcggcacgaaccccagatttatagagaaggatgaccggtacgagcccgagtcggtttccacttccagcattccgcgtgaacgccagaagcccagaagtcggtgcccccctcggggttgcgaacaggagtcgtactccgactcgctggcccatgttccccgttgccccgctcgtcaagtcgtcattgggcagtacaaatatcaaggcaaaagccctgctaatcagctaatgtaaaatcttattttaatcttatcttatcttaatctatacctacacctatacctatacctacttttttaattaaaaaataagctaatttttcatccgtcattaaaacatgggcccacgcgatatttcaccactaagagcaagtttaatagtatagctaactactagctctaattcatttatagccaatctaacagctcatttatacaatagttatatactacactatt

SEQ ID NO: 40711 - DNA, 707 bp, Oryza sativa
caatgaaagattttgttcagaattagggttttgaccacggcaggattactagctgaacaaattccgtccaactacaacaaatatcgcctgacacaaacgacaaccaattcaatctgaggactagcctagtaaccaatggcatcgacatctcccatttttagtttaatttgtgtcgaactgtcgatgaacgacacactctagaatatcccaagtagtagtcttaaacagtgctttattacatatgttgaacaagatcactgacaacacgataaattattgtagtagattgcaagaatcattatatgtcacaattggtactttgccatttaagaaattaaacatacaaccacgcaacatcgataggagtaaattggtttgcatatcaaatacagaaaactgatcaaataagaagaccggcgcatataaaattgttctcccaaaataatttgcatagctttaatacataatgtaaaaagatgtcaaactcagagagcatcgatgaaggcaagtgtgtctgtgccatcaacaattaaacatatgattggcactcgacatatctaagaaatatatgatggaaaattatatagtaatgcagcatgaagcatgcagcttcctaatcttatatgcttcctcatttgagaaagaagcatctgcattaaggaaatcatccaaggaatgcccaacaagggattagcatatttccatgg

SEQ ID NO: 40712 - DNA, 59431 bp, Oryza sativa
  unsure (1)..(59431): unsure at all n locations
ctgcctcttcatcaaaataatttttgatgtcaaaagagaatagatcggctaagacctgcaagagagaaaacttgagacagttaaatatcgaaataagttatgtagccgatctaagatttatgacaatgaaagacttactgggatggcaggagcagctggttgttcttcctcttcaatgttatggctgcctgcagctgatggagtacgattacttggtgtcggctgcacatgaggtgaaggaggaggaggctgaaaaagacaagtgttaattaacatcggttataatcaaacttaaaggattttacagataacaccttaccggatgagctggtttagatgttgctggtgttgatttcttcttcatgatagttttctttttctgcaaacacaagaccaataagcaatcggctatgtaagttattttcaagaagtgatcaagatgagttatttacccttgaaaagtgagctggagtagtaggagtcggaggagtctgtttgggtgaagccgatggtgttttttctcctaagtcactcagttcggctgccgcttggtcgacatcttcctcgatctcttcctcatccaaggcttgttctatggatggatctaaggcaggcaaatcatcggttggcttggatttcttcttcttggcctttttcttcggagccaaagccgatgtatcaacagccgatgctttagtctgtctctttttactagcatcagctggttctcttagttgcccttgaagcagacttgaggtcctgggggcatgatagccgatgaccatgggagatggtccacctctgtttggaataaggccagaagcatactcgatgtccttaccgctgttgcttttgcgaggaggggaagattctgttgtctgcaagacagaagaagagattagccaaaatatagatcggttgacaattattttacaggattgacaaagtaaggattttacctgagggatgacatctggaaagaggtctgtcatgtacatggaagccaattggtggaacagatgcagcttccattcaccccaccatctgtcaaatgccttgctcctgaaccttgccagctctatattttcgatgctgcctagtggaggtcctgggatgttaagcagccgatccatcattaaggctgaagttatatcacctcggcactggattttgtctacaaagtacaagccgatcggcatttgtcccattccaaattgcctagcagaactcattgggtgataaaattcgtatgaggtttgaatgtttctgccctggtggatgacgactagaaggatgcatgggctgacggcagtagtaaaaatttccctagattgatcatatttctcagaattgatttcctaaaatctaaagtccgatggcagctcaaaatccatcgagtcagcataagggaaccagactcgggcatctttttgaaatccatcgtagaagctgaagaaccagtccttcagaaattcagttgatagctttgctcctgcatcagctggtgtgaatgcatattctccataagacatgcacctacggtgggttcgctctaccccatcatcatctgtaatcgactctaatctggggaactcagcttctgccacagatggccaattaacagctttcatggctactaaattcagccaagtttgtagcagccaccatggaccacctgctccaaccactgagccgacagctatcttggctgatgcattgttcaacatttggtacagatagccgaggaggattttgcccaaggggaattgtctctttatttctagggcttcggctagaaattgccagttagttgtagggccgcagcttgatccacaaaagagaaatttctccagccacatcagcagaaaggctacatgctctcggggagtgacatgtcctttgcccatatatgctacaatataccctaaccagcctccaatactcttggtcttgaattcaaaggtatttttggtgttcaagctcatggtattagccgatgaagtcacatccaagccagtaatcattgtgatatttagcaaagttggtgtcattggcccttggttgaagaggaaagcattaagggcattcgaccaaaaatatgttgcagcggctatcaagggctcatccttagtcgaatttgctatggtaagggctagtgcttggccgattccaatttcatcccagtgggcttgtttgctagccgatacccactattaccacacagaccagtttttctcgggagaagttttctcaagagcaggccaagacttgaaggtattcttccaatgacctagattcgggttggccaatctaaaaggaatcctattggtttcagctatgataaactcagtagggtcagggttgccaatcggaccaaggaaatagtgatgctcatgagacaaacttggaatcgcgactagattggacaagtgctacagatgtaaacaaggatagagaagaagaaaacaaggtgaggcaaggaagaaacaatctattgcgaaaaaagaggatctagccagtgagcacgtacctctgcgtactcggccgatggcgcggcagacgggctggcggaagtcgacatcgccgcgagcggaagcttggccaggagaagatcgccttgaaatcgccgtgtgcaccgaggggatcgccggagaaagagaagacgaggtttgcttaagcggtgaaaacggaagtgacggtgtgaaatttctcgggggtagcggttaatatttaaagcactgtgtaacggtcggaaaacggcaagtgcgagtttctctcggagacggatatggcaaatccgaaacattaccaaatattccggacttggggggcatgtgttaacgaccaaatttggtaatctaagtatcggagataaagattagattgaagcggaatccaagatcaagattgtttcagaaacagagcaagaatcggctggagtccaaatcggctacgaccaggatcggcagagttcgagtcagacagggttagccgattgagccgatcccgacaatacaactctacgtcatcggatagaattaatgtgcttcgcatggattgccacacttggactgagtcctgaataggcaattgtatctattaattaggatattttatgtaatttccttagagataagtgtgggcaaaagtctgccgcaatgacttatggtatgttagagtttattagagataagagtcatgtccgacaaggacatattgtgtaatctcgggtataaatagaccccgagccccatgtaatacaacaacagacgttcaacaacaatctcggcgcatcgccacccttttactttcgttttgtttcgacgagttcttgctttcaggttgagctgcatcggtttcgatcttcaagtagaggtaaaacttgttatggcggcttgcgttctcaggattagtgcttccatctttatgatactctaatcttgtttatgtaagttgtcgagttatcatgtatcttatataatctccggcaatatcgttatctaacctccaatcggctaatatctatcattaggaagcagccgattaggttaaatatcgatgttggcttatattatataggatatctaccactctatgaagcttccaatagtttgattgtctagatattgtcttttttttcatacttatggctgcatcagttgagtttgacctcataagtcgtgtttagaactatagtctctagcctgcttcttggttgctgattagagtagcatcggggtttcagccgatcttacctgatttagctttatgtcttatatgctcaattgttatgctaaatctgccttttatgttaagatcctattgcatttaggtgtattaagctctatgtttgatatattttactttctttaatatcttaatatagagtggtatcggagtattagccgatacacgctatatctatctgatgagcatcggtggccacctgtatgacgcactgccatcgatgtccgcaaccatggccggccatcttcgccaccaaccaccgccccaaaccctagttctatgtaatattgtcatcgagtaaattgtttactcacaccatcaagccccaaaccctagttctatgtaatattgtcatcgagtaaattgtttactcacaccatcatgccgtgtaggcttgtttgtaaaagaattactattctcgtattgccttacaggaaaacatttactatgcaataataagtgtccgtggaaaaattctaatggctggatacatggcaatacaaaatttactaacaatatatggaactaatcaaacaatatatgcacgagtaattgatttaccgaccgaggcttcagcatggtcaaaaaaaaataattcatttactaacagaatgtttggtgcgaaattacccattagtaatttatttactcatggctacacgaggaaagaaaaaaaaaacagaagagctggtgaaaaagaaaagggagacggaggttaccgactgtgggaaaaaaaaaggaaacgtgggggtgttggttaccgaaggtgggtgcgatggtggaagtaagttgtgagggaaggtgggtgcgatggtggggtaggttgtgaggggatattttagttattacgcaccctgngtgcggtatatatatatatatatatatatatatatatatatatatataggacactcatatggggcaccatggtgcccgggcaccatggtatcaaatatacaaaatcacacaaatttttcaaaattttcaaattgtgagtatatacctagttataataactcgattcatacctatacctatcaacaaaacaactcaaatttaactttatttcacaatccatgattacatacctaactaattatatgtatagatgctatatacctagaatcaaaatctaccaaaaacaagttcaaattcagttcaaacttgctttgaactagttagtaaagtagctaatgttaatatctaagtaattgaaaaagtttcatgaattaggtatatactcaatttcaacaatggtgcccgggcaccatggagcaccaaacaaatttactatatatatatatatatatatatatatataatttagattatttgccctatatatattcgccctatccatatacctagattatttggcaagtataatttagtgttaattctatacttaaatcgtaaaatataaggtttataggttttataccgtctaccatattattttttacgaatagtttcctataattataaccatatataaaaactaacaataattatatgtgtaaaatatacattgattacatggaggatctgattttaacagtggagagttaccataaatagctacatataattgcttggagtacggacacagagccatgttgttgtactaattggtactagtaatatacccgtgctaaacgctatggcaatatttgataataaaaatcaaataaccaaaagaagatatatttttaagcatagaatgatatgatggttatgaataatggtgcacataattcttaacaatatataatgtttgatgtaattcggtaattctactgacaagaaaatatatacggagatggacacacttcaagcactgatactactggggatggaaataaagagtaggctaacattattgatcttcaaccacaggactgaaacaataaagccataatgaattttaatttaaaaagagtcatacaggtaatacaaggatgcaaaaagctgtgaagagcaaagagaaaaaaaaaatctattaagagtagagagattactcagccaatactccattgcatggatattatgatgaaagcgacaattcaaggtcaatacgccatttgaaggccatttatcaatagaatctagacaactgcacatcaaggatattatgatgaatgcaaaaccattccatacggcctagtacaggtctataattcttagtaacaaaactgaacctatacagaaataagacaaaaaatcagacttacaaaggtgtaaaagtttatatttcaacttagcagagagcggaaacagatcgtctcctgtataattcatactctacggctgttgtaaagaccaaaatcaactgcccaattacatggaacggtcatgattcacaaaaaatataattttacaagattcttattaggacttaattatacttaaataacaaaagattcctttatgctattacaaaggtgcactgtagaaaatttccatgggagattaacatttccaatatcaaatgagctaagaaagataaaatttaaattcaaatagctctgagaccaatacattcaaaagcccaagagaatacctgctgctgtgcagattttcgatggagcatgtggcttccaaagtcataaaaataaaatgatccaagtttcatagcatatacaggtttacaccacctagagaacacaaaatccaactttcaaggtttataagaaaaacagagtgagaccattgcatgggacccttaatctgttccttcttagctttgatctgttagttcttgtgacattgacaagaagaataagataacagtaaagcgaaacgaagaaatatgcactgacaattaactgaccatttgaccactctagatggtcatcatcccagaagccagaacccttagaaagaaaggaaaaaaacagggagaaaacgaagaactttcatgtcgagcccatatagtttggtagttttgtccacccatcttcaaaaaaaaaaaagtactgacaattggttgatagcaagaagatacaacatttcgtggtttctcgttacatgcatatcctctctcttgtaatacacaattttttttgcaatggcacatcaaaatgaaacaaatatgggttatgagtttatgacagtacaaatgtacaattactgtcagactgcctttaaaaacaaatcaaccatacagccatacaggggagagatgtcttagcataatttcctcacttacctttacctaaatcacataacagaagaattgactcagtgggcagacccatatgtttactatcaacacagcagcgacatctcttccgagttcttcctacatttttattccttgaccacatttgactcagtgggtagatccatatgtatagagttgcattccggccatataagctaggttaatggttccttagcatgcttgctaaacatataattggattattcaaacatctgtcttataggatctttttttttttgccattggtcaatgacatgaaacctgtatattgatttgttactataagtacaaaaaaaggatggacaatttacatgtctctcattcttctcaaataatgaccaggcggtgctattgcatctcttatttctctactaagagtgaatcaaagcccaaaaataataataacaattggaaatagaggatgaattttgcttgtaatgcatcattcgttcgttcaatttttgtaaatgggcattgtactaataccataatattgtgtcttcagggtttatttgtggcttcaccaaaaatgaagtgtggtttcttcatacatggactctaaggataaggttttataccagttggtgccaaatcaaatctagatctgtgtatatttagctcaatggtcttttagattgatatcacaagctccaaggtttccaactaaagcttacttcgctggttgaaactaatgacacatgtgttcaggtgttccagtcaaagatagtagttctaataaggttgttggcggtatgtcatgagacccttcgaccagacctgccgaaaccatgcaaccagcgaggattcagactcaaggcgtcaaggttcgtcggggcgaagccccatggcgaagactatgggggcgaaggcggcgaagggtgaagagtcgtgttgggaccccgcaagtccaaatgcgtcctgggcgaaggctaaatggcgtgtattggcttcgtgtggtgatgatgacagtggaagtggagaggatgagaatgaaggaagtgatgatatgcacattgatcccttcatccaatttgttgtaaacataaggaatccatcgcagtataccatcttgaggcatcatgatcagttttgaggcctcgggacaccccggatccccgttttcacaccgctttcctaaaaagtgtgtatgagcaggtttatgctgggaaggcttttgcatagcataagtggatttcttggagagacatcaatgagactccagagtttgagagcttacaggatctcttcaagactattggcattgaccggattgtgaccctaaagcaagactacaatgaagatttgatccggcagttttatgctacagtgtgggtggctggagactatagtgagatgaagtggatgtccgacaccctccagtgttctatctctaggaggcaattccggcggctcctcaatattcgcttggactttggagatgacttgcatgaggagcacacccataattcgctctccatagactatctctctcagttttatgaagatggagcacggtacactcatgggaaggttgtcggcttgaggactatccccagtgtggtcaacaggattatgagagccactatcctccctcgccttggaaacaatgatgacattaggggagtggcttggcacgtcatggatgcaatcattcagggtcgtcagttcgacattgtgtctcttatgatgcaagagattgccatctccaaggggactttctctcagggaatctattatgccccttacatcatgaggttgattcaagataagcttggggctgccgagccaaatttgaagaagcacaagcagtacaagccccgccttcagcttggagctccccgtgctcctagggcggcgccctcctctcatcctggagctagctcaagctcagcacctcctcctccccatgggtacgatccaaatgctttcttccatccacagtatgcttattttggaatgcaacccatcgaatacttcaacccggtacttggggctattaataccctaagtaaaagcattcaacacttgtctaccgggcatgaagctttgcatgaggatgttcgtggcttgcgcaccgatgttggagacttgaatgcttccatggggagattgcacactcgagtgggtacattggattctcgagtccaaatgttggagagctcccaagcatttgtgtatcatcgtcgtcgtgatgctcatcatccttccacttcggcgcgtcctccttctcctccacaagaatgaagacctttttggtagttgatgccaaaagggggagaaaaatgtcattaggtgtgctttttgtcttgtgggttgggactagtggtagtgaggttagtcacctcatatctaataggttaaggaggtttgggctatattatgtatgggtatgggctattactctatattgtatgttccttttcattttgttgatctctatgtcatttggacccttcgtagtcttgtaatagcctatatttatttgtgagcccttttagaatgatttgtgacttatgtgatttgaatggttaagagatgtgaacttgtgcgatgatagatggtgtatgtgatattgatatatttgtgaccatcttatgctcatgaatgaatatttcttgaagttcacattgagatattgctcttgtgtttgtgatatgttgaaatgtgaaattgaaatgtgcattggctccatatttgctatttgtgattgttatgcatatgtttagggggagcttttgcttgtcaatgcaatatatgtccatgtgctctatgtttgattatatatatatttgtggtgtttgtcatcaattaccaaaaagagggagattgaagcatctaggcccccggtgttaattttggtaattaatgacaagcgctaattgtggactaaccattgtctttgagctatatattttaagttaggtccacgtcatatgtgtgcatggatgattatcgatggattaaaattgacggcgcaaagcaaagggaaagaagacggtaaaactagcgctttaatttagaattgatcgaggtgtagggcgatcaaatttgcaagtttatttttagtttcgccgtattattaagaggggtagtgacctagcaaagagatgattttaattgccacattaggtcattatgcatttagacttgtgctcacattttcttcacacacacactttgcctttcactgggttcggcctgaccaggggcggtcagaccggccacatagtggcggtctgaccggctccaagcgggcggtctgaccggcccatatggccggtctgatcggcggcacatgcgcggtcagaccggccccctagaggccgggatggtgctgctcagggtggccgatacagagccgacggagccgtattcggtcagaccgagccgaggccggtctgaccgcccactcaacgccggtcttaccggccgggccgatggggccctctgacagcactacaacggctagttttctagccgttgcagagtagcacagtctgaccggccacatacctccggtcagaccgacagagcacagagttgggggatttcgcccccaacggctagttttggagggtgggagtataaatactcccccaccagcagcaagggggctctcttggcacccaattcaattgcatacaccccttgcacctctctcacactcacttgagctttgtgttcatccatctagtgtgttagagggttgattagccaagagtcaagtgcattgcttccatttgtagagctagtgcggcacttgattgattatctccacgccgggtcattgcttgttactcttggaggttgccgcctcctagacggcttgtggaggggttgcccggtgacctctccgagaagattgtggaggaggcccggcgccgttttgtgagtggtttggagttcaccaccttcggagtgaaggaagaactaccccgagtgatcgaggcttgggtagtcctctccgtgggccggctcccgccttgcccaccccttgacgaagggggcgtgcggtggctttgtggttgagcggtggagttgggctcgcctcaacggggagtaggaaaccggcgagtttccgaacctcggtgaaaaatctcttgtctccttgtctcatttgattgtcgcatttacatttgtacaatttacatttctagagagatacttgagatcatatcaccctatgattgctaaacattgacataggagtgtgatttactttcctagagatatatttgagccactatcaccctacgtttgcaaaacataacttagttgcttagagttgatcctcacgtgcctagcaacttaggttagttttgattaggtgtcatttagttttatatcgcctattcaccccccttctagttgacatctcgatcctacaccggtttgcccgtcttgccgcctgccgcgatagcagctggctgaactcagcgaccgacacgtcgccgatcaactttcgggcttcggtgtcggcctgagcaagagtcaacactacgaaaacaagaagtgtcaccacatcaggcgtcgaacggggaaaaagagcgaaacatagatgcacataggaaaagcatagactcaccgttcgcccccgcaggcatgacgagcttcggcaagccatcgacctcgacttgccacgactgggagagggggaaatgcgaagcatgcagaactcctccaccaagtcgcgacagctaaggcgggagcagaccttgtgcagcaaggcgaaccgggcttccatggcgccatcgacggcgaccttgggcttcctgttcggtgcaatcaccctacgccgcctccggagggctttcgccgcatcggacccagcctcgaaggggatggagaggtagaaccacttcgccacccaattgcgatcctactttgacatggcggcattcaccggccagatatcggagcgctcggggcgaacattaaagttcacactcccgaacgtcgttttcttcgtcccggccggagtgaccaccgtcttcgagttcactgtggcgtagaacatggtgccgaaaagatcggcgctcggatcaaacccggcgatccggcacgcccagtcgaagatggcgatacggacgagtgccgatgggcttagctgggggagctccacctggaaaaggcgaaggatctccggaaacaacatgttgaacggaaatcgaagcccctcctcaaagaagatgacgaataccaccgtccggttttcgccgggtttcggcaccacggcctttcccggagcgaaggcctgcccctccaccactgcgccggagctgaccaacttcaccagctcgtcatcgtccacgagctaagctcctaaaaaggcggtggtgtcatcgtcgatccggccgggatcggggcccgtcgcggaggttgggttcggcttgcgaggagccatggcgaaaagtgtgcgcggtggtgaaaagggagaacgggcgaaagacctaatgactcaaaaggcgccgtgaaagggaagtacagagaaagagagagcgctcgcggtgaaaatgacgagggtgcggcggtgaaaaaggggaagggggaatatatagcccacccaggcaacggttcgccttcccacccaatcatgagccgccacgcgtcataagggtaggcgaaacggtaaattcccattaaccgagccgcatagggacaagcccacgaaggaaagcccatcactgttcatttcggtccagtgaaagaataaggacagcttcgccgttcgcagaaggcaaaagctgcaaaacattactaaccgcaagaatacatgtacacgcaatgcacacattctttgcaggaacccaaaataggtttcggcaggagcgtcggtcgaaagggggcgcctcataccataccacatggtttgcatggtctcggccgaagctcctatctcacccttgcctgtgaggggcttgttggcggtatgtcatgagacccttcgaccagacctgccgaaaccatgcaaccagcgaggattcagactcaaggcgtcaaggttcgtcggggcgaagccccatggcgaagactatgggggcaaaggcggcgaagggtgaagagtcgcgttgggaccctgcaagtccaaatgcgtcctaggcgaaggctaaatggtgaagggtgcttgccgaaggaggatgacttcgcggtatcaagcccagctccaaggaggcccaaggggccatcccagccgctctatcccattggccagtgggccaacattcgccaaccggcccattggaggcccatatatttcaattacattgtatgcccatacaagtgtccctctcatgagggcaaccatgtaaattcccctgtaaaacctaaaccctaatagggggatctgtaatagaactataaatagacccctagggccatgtaaaggggcattcaaaagaaaaatccttaaattagtacacttcgttgtttccaagaacccttgagcaaccacatccttcgacgtatgcagttgtcacttcgacaacaaaggtctaaggaatttctgttcattatgtgttccattagctgatctattggttatcctaattgctcctttatttcaccaacttgatggggtaatctgttacaatcctctctattatttgattttgttatgctcttgatggattcaatattgcacttgagtctccagtagagcaaaggattggtgtgtatgagcagaagtattatttctaacttctacacatggctttgaattccatgccacctcaatttttacataattgtatcagtctccagaacttgcaagaatcaaactgatggaggaaaaaaccaatgctcttgcttaactcaaaaagagattaaattcaatctggtaaggaaggaggttttctggacctcctatcaatggcggaggggatcagcttgcgacgacgagcccggcgactccggccgacggtgatctgaggggcgcacaggcgtggatcgggggcggagacagcgactctggcggcgtggatcgatgagatgggcggaggggcgggaacggggacgccgacggtgactccagcgcggttcggcgcgatgagcgggacggcgacggcggcatgatttgtggagctgatgagggtggtggaggcgatgtgtggtgggggtgcggcggttgcgggagaaaggaaggtgcgtgagagaaggatgatgcgggagaggcgcagatgcgggggaggtggtgtggcgattgcggtcgacagggaggcgcgggacacacgcggatctgggacgttggatccagattcattagataattttagaccgttggatgtgtcacacgatgaatgagtaaaaccatttgttgaactatagggtagaagataacttgcagtccatgacttttagcacctccttataatgttcccatcaacctatcaggaatgcacacatcaatgtatatttagcaacaacatgaaaattaatgtgtaaaagcatgtgtatgcacatatctattatatatcagcacttgtgctgcccgatgcattcattttctcaattgacataaagttagaaacaatattatgacccctgattgtcttaagatcaatacgttccatcgaattatcagcaattctttccaaaggacaagcgccactgatggaaagatgaattattgatctgtatgagccatactttattccaaaggaaagttacaaacaatagtattctgtgctggttccaaataagttttagtctttataatatactatttattcgtacttgaattgaaagaactttcataggcctctttgatgcctgttgatgctctatatgccaattctaatgtatttaagacaggaatgcatctaccatgtatgactgaagctaagactccatataattaatctaagaattgctccattcctttcacggtgacatctatgcatatcacagggcaatggataacctacaagaccgccatctgtgatcatctcaaggcatccatttcaggttaaataccaataaccactaagcaattccatcttatatattcagcccagtaaaatgaccagtaaaaggaacagaagaaattgttgtcaagtcctgattttccaacccaaataaacatattttaagtggagtatatcatcatgaaattttagtagcctcacattcaaagatatccccggcatagtttattttaccaaaattagtgactaaaattagcagctgagctctatctcatcgtgagcatgacttcaccacaatgcatagctatattttgattattaatttggcagtgattttacgacattggattaaacatcagaatcaagacacaacatttaaacgcaaacaggcaaatgaattaacatattggtttgcatattttctggcagaaaagagaacagaacatcgagaaaaaaaaaagccccaacattcacaaacaagctataacagatggatcttcaaatgtgttaataaccacagtaccattctctatcttggtgtgattttgctaaatgagaactgtgcataaccacattatcattctttctcctagtgatagcatggaagcaagaagtgttggtaactacacatgaaacatggatcatgactgagagaaacaagcaatgagaaccagtgcaattcagatttaatagagaaatatcaaatcaaaatgtaaaaagtttgaatttgaaaacaagtaaaaggtttgactactgatttaatcaggtatagttggtaagtggcaaaacaattcaatgggttgattagctctccagggaatcaacagatgataagccaatctaggtattacatggaaaattattcacttatatactatcagatgacattcttcccaattatgaactggatatagagaatccttctgctttgtgttttacacttttactgaacccagtggacaaattagatgtaatatacccaaaacggtcaaaaaaacaaaagaacagaacaatgccactgcttcaagaagagccacattacctgtgctatgagatgtggagcgtaaagtagaggcatggtgagagcgtgatggcggcaatggggatcggtggcggcggggagcagatcggcgcggaaggcggcggtggtgacctagcaacaaaagggattccggtggcgggatcggtggcggcgaggagcagctcggcgtggaaggtgtcggcggcagggatcgatggcggcgaggagcagctcggcgtggaaggtgtcggcggcagggatcggtggcggcgaggagcagctcggcgtggaaggcgtcggcagcgacctagagatgaaaaggcttccggtggcaggggcggtggcgccgatttgggcaaggacagtggcagaggacggacaaaaaatgaggcattgcgaggctgcgagggctaaaatccttgtcattcgagattgcacttataatagatcaaagttatatataatagatcaatgttcatgttacaaacatggaatatatagcgaaaaaactacaaagtaataatatgatatcgaaaaagagttgcacgctatatgattctgcatccaactttaatatctcatagtccatcaaatacatgaaatttagcaaactacctatgttttatttaacagtgatagatggatgctagaaaattggggtcttgttcctggatggatgctagaaaattgggatcttattcctctatttcttgtttcatttctttctttcatcgagaaaagctcccaactaagctactgctgcctccacacgtgagcgtggctcgtgctgctagctgttgctgatttccgtcccagtctccaggatgcagccgcagtctcgactcacttgacgagaaatacgaatacacgacacaatttccgttccctgagcaatgaaagaatgagtgattgaactgtagagtagatccgattaaccatcgaagaaaaaaaaaggaaaagtagagtactaagaaaaataaatagtgcatgcctccatgtctatacactgccatatgcattcgtaaatagctagcctagcactcctggagaaaattaaatgtcatacatttttttgatagattgatgactagcacggcaaattggaaatataatctagatcgtaaaaaaaactaacatacatgcacctaaaaaatatcaaacccggctcctgtataccgcataggagcttatcagttttgctatgatgtctaaacctttaagaaattaccacgttaattagagaaaaataaaaaaaaatatcaactgtttgattggagtatgtctaatgcgcaatcaaccgcacatgacatccatgcagtccacacctgccccttactgagtatattatcaaacgaaattaaaaaataagtttgagaaaaataaaaataaaagttaaagtaagaatacaatttaaatattaataaaattcagaattaaaaataagtagtattgaaaaaagagttcatctagaaacaaagacaaaataattaaaatttaaaatttaaaaaataaatcccaaatttagatttcaatacgattttcaaagagttcaagtaggaaaacaatttagaatttactaaaattctaaattaaaaaatattggaagagagtgcatttagaacacaacataggattaattaaattttagaattatgaataaaataaatcccaaattttgatttcaatatgaattctacgaattcgaaagagttcaggtaggaatgcaatttagaaattactaaaattcagaattaaaaataaagaatattagaagcagagtccatctacttattaaaaatatttattaaaaataaaattaaaaataaaatacatccccaaattggattttgatatgacttccaaagtgttcaagtagtatctatttatcatattattgaatttaaatattactaaaaaataattgttagatgatagcatgtcaaaattatagtggttaaatttaaaaaaaatcaaatagaatcccagtgatgattaagagaagggatgacaggcaagctgttaagcagcacaatcacggtgtttggcaagacttttggaaagtaaaaattaaaccaaaatgataatcatgttcgatttttaaaatctcactaataattaagagagaaggcaacggatgggtcatagaggagtacaataacaaagctacggatggtttgccgggacttctagaaagttaaaatgtacacagatgataattatgttcgattttaaaaatcccaatgaaaataaaaagagtaggcgatggacggcttaggggagtcgagtgacggcgtttgacggaggatgaatagaaaccgtagtagatcgagcaataaactctagaatttataagatccaattttaaaagttgcaaggaggatgaatagaaaccgtagtagatcgagcaaataaataaaagggtaacaaataagtacgaggtagcgcctagtgtgactttcaaaaactataaaattagaaaatgcagatgataaggttcggtttttcaaagtcctaagacaattatatagctatttaactaattttaagcaaaatcatatgtaaaaaaaataattttgtatggatgctagctgcgcaattgcgcggctcacctagttagttgtatgcaaatcaagttgcattttagaaaccgtatcaatataaaagcgtcacttgttattgaagggagtgattttaagcttttctactcctataaaaaaaaaaggaaccagtagttacctcgtgattaaacatgtgggaatccatctctcaagccgatcagacagattgtcagcgattattgtagataaatcatccctagatgcatgcatagcaagttagctacatgtcaacatagctaattaactagtctgatcgatcccacgccaaaaagctcttcgctggaggcttttaggccctccaattttgtgagttatgaggtgcatgcttagccacaggacaaactaaagctgacctgcattttatcttatttttgttcagttcagttcagttgtgcatgcatgcaaagagggatcctttgatggcctgatcaactgtaaaattgtttataaacatggttaataatatagaaatgacagagatagattccatgagttggtcttaaaaaaatcattctaaagaaaatgggattttgttttggagtggaaaatatggatatatgataatattatataatacattgaaagaaacaaaactgcaagcctaaaaaggacaaaaatggctgaaattccatacggcctagggtcacacgtaaggttggtaacatagctaaaaatagaaagagaaaaaaaaactagaatgccatacctacactgtcatcccaagatccggtttttcctagactccatgctacacattccgtaacagaaaacgaatcccacgatctgatttttcgcagtcgccatcatcagctcgtcgcatgtggctcgcacatgcttaacaaactcgtaacggcatgatctccacaattagatcccataagtttaggagaataagaaaggcatgaggtgggagttcttatttggaggaggagaaaggtatgaggtgtgaggtgtgactttttattttgaggggattatctccatgagatatcggtgttcatctatcgactctatgtagtaagtatatcattaatacagtaccttttagatcgatctggatattctcaggatctattaatcctgttcatctttttttcgccaatttcaagatgatagggtgggtggacattggaaaaatcttgtccgcgatagcaccgctctatttcgcccttgtattggggtactgctcttccaagcggtggtggcgaatcttcacggcagaagattccgaagcaataatggtcgcttggtttgctcttccctttttcacctttgaatttacgctccaccttgatccctacaatgtgaggtacagccttatagcagctgatagcatatcgaagttaattatagtcatcgtaatcggcattggtgttgggttaatattccggaaagagggattatgcaccgctgtcatcgactggtgtataagcggcttttctcttgcgtcactcaccaattctctggttgtgggcgtgcccatggcgagggccatgtatggcaactgggcagggcaagtcgtggtacaactatcaatcttccaggcaatagtgtggctcacctcactcatggtggtcctggaagtaaggaaagctttcgtctccgacgctcatgacgagtctaatagacatgaagaagggtcctacatagatgatgatacggttgtcggtggctcgggtaccagcgaagatatgcaaagcctcgaagagggggtttcagatgccacgaaccaagatctcaagggggaggaggcagtgacagtggcaggggtgaatggtgctaggttaccgctcttcaagtcggtggcacgcaagttagcctgtaatcccaatctacacgccagtgtaatcggcatctcctgggcttgcatctccaataggtaaacgagtaataagtatccccgtacgtacatgctcataaatataattaatctatatgtactaatatatacatctgtgcctaatattatagcaggtcgcacctcactttgccaccagctttggaggggtcggtgcaaataatgtcaagatcagggctggggctggctatgttcagtatgggtaggtttgcacacatgcacttctaaacatatagcagtatgtcatttagtctatatgtatgtaagggctataatatatctctgtccacagtatgtcaagaaaaaaaatgcacgtttacattaaaagtactaaaccagcttattcttttctttcatttttcctaaggattattcatgggccagcaagaaaggattatgtagtgtggaccaagacttacacttctgggcctttttctgaagttcataatcgggcccgctgccatggccataggatccgccgtcgttgccatccatgatgatgccctccgagtagccatcatacaagtacacacaattaactactggagtactagtttatgtcaaaagcactccggacctcttattatgtttgatagttgaatagaatggttcaattcacccatcaagcataataagacatccgacgcttcgagagaaggatattagagatattgctggtcctttagcctgtcagtcaacttcagtctgagatgtgcccgtcaaaccatacgaaggtagcgacaagatatgttacacattcaggagacttgataaatggctaaagatatacgacttgtcaaatatctttaactgatagtcatgtttaatattttcctaacataaggaacatattaaacattttcatccaagcacttgatatccaaatatagagggttctgggacttagataaattctcacaacttaggctgtgtttagttccacgccaaaattggaagtttgaaaaaaattggaagtttaaagaaaaaagttgaaagtttgtgtgtgtaagaaagttcaatgtgacagaaaagttgaaagtttaaagaaaaaagttggaatctaaacaagggcttagtactaagatacttatggccgaccggccaaatacttaagtttgcggaagcattttctacctaaaagatcttttatgcaactgactagggtagaccttagcaagaaccatcctggaagaacgaatcatcaccaaagaagtcatcctcctccggagtgacttcacctgcaaccatctctaaataacaacaatacaacaacaaatgcaagagtcagtacattacaaaaataatgtactagcaagcacaaggcaatcctaacacactacatgcatggcatatatccaaggaaggcatatatggttctttttagcataaggcaagttttatttgcataaaacgctttcaaatcagatttgctttcaaataattttttttcagcaagctagtacttagtatatgggcatcaaagtaggcattattcatgtataaatatgcacctcattgccatccatggcagcaatgtgaccatttccaagttttccatacatccaaacttgtggattatgacagtttatgagtgaaatttgcaagtgttctgaagtctaaaaactaaatgagtgtaatcaattcattcattgatcttttttattataatcagttattttttgtcactgttttctttttgaaaacaagatatattgtgatcaattgtttaactttttcttcatattttttaatttttctcatgaaatgagtgcaggctgcaatacctcagtctatttcatccttcatatttgccaaggaatatggattgcatgcagacgtcctgagtacagcgtaagtttctactattagacttaattatcagagttaattatatatgaccatattaataatatatcttaaaactgttatcttttgtcgttgtctttgttgttaaagggtgtttttgggcatgataatgtccctaccattcatggtgggactatatatacttttggaggaaatatgattatatatctggttgacaaggacatatacttttggaggaaatgtgattatatatttggttgataaggtcatatacttttggaggaaatatgattatatatctagttgacaaggacatatgcatcggtatcatctaggagcagacaaggattatcaccatggataatgtaatctatattatactcattgaatagtttgttcatgaaatcttcagtcatggcataaggtgcatcttgaatgatatcgtgcacccattttacagcacggacaattatcaacctacataccagaaaagaaaacattaaaaaatcattctaaataaaatgagattttttttttgtgtggaaaatatgggaaagaaaaaaaactgcaagcctaaaagaacaaaaatgcctgaacttccatactgcctgggggtcacacgtaaggttggtaacacagctaaaaataaaaagagaaaaaaaaactagaatgtgatacctaagagcatcaccaacagcatcttgatatcattccctgtgtggtattccggggattttgatcaaaaattgcttgctgctagttggtgctttgttgcctgctagaattgctggtgtacatgtagaaaactgggggtgcacgtgtaccagtcaggttgatctgccggcatggtactgcgtggagaggggcgacgaaggggcacgtgcgagagcgtgatctcgtgagagcgacgagtggaaactaatttctgttggaagttttctaagggctcagtctttttgtttttaggaaatcaattatagctaatctgttgcaggaataaaaattttaacacctcaaatcttgtttagaattaccataactgaaatgttggggatagaattttaggatgcttttgatgatgctctaagctgccatcccaaatacagtttttcctaaactacacgctacattctgcaagagaaacacgatttggtttgatttggttttcacagtcgcttccgcggtcgccatcatcagcttgttgcatgtggcttgcgcatgcttaataaattcgtaatggcatgatctcaacaattagatccttaagttggggtgattaggaagaaagcgaatcccacaatttggttagatccttaagtttgggtgattaggaagaaaacgaatcccacaatttggtttttcgcggtcgccatcatcagctcaccgcatttggctcgcgcatgcttaacaaactcataacggcatgatctcaacaatatctccatgagatatcagtcttcactatatatatgatatcgagtcgtcatgagatatcagtgttcactcgtcgacctaaacattctcaggaagtattagtgttgttcatcttttttttcaccaatttcaagatgatagggtgggtggacattggaaaaatattgtccgcgataacactgctttatttcgcccttgcattggggtactgctcttccaggcgatggtggcaaatcttcacggcagaagattccgaagcaataaatagaatggtcgtttggtttgcttttccatttttcacctttgaatttaccctccaccttgatccctacaatgtgaggtgcagccttatagcggctgatagcatagcaaagttaattatagtcgccgcaatcagcattggtgttatgttgaaattccggaaagagggattatgcgccgctgtcaccgactggtgtataagcggcttttctcttgcgtcactcaccaattctttggttgtgggcatgcccatggcgagggccatgtatggcaactgggcagggcaaattgtggtacaactatcaatcttccaggcaatagtgtggctcacctcactcgtggtggtcctggaagtaaggaaagctttcgtctccgacgctcatgacgagtctaacagttatgaagaaggatccttcatagatgatgatacggtcgtcggtagctcgggtaccagcgaagatatgcaaagcctcgaagagggggtttcagatgccacgaaccaagatctcaggggggaggaggcagtgtcagtggcagtggtgaatggtgccaggttaccgctcttcaagtcggtggcacgtaagttagcctgtaatcctagtctatatgctagtgtaatcggcatctcctaggcttgcatctccaataggtaaatgagtaataagtatccccataagtacatgctcattaatataattaatctatatgtactaatatatacaactgtgcctaatatttttgcaggtcgcacctcactttgccaccagctttggaggggtcggtgctaataatgtcaagatcagggctggggctggctatgttcaatatgggtaggtttgcacacatgcacttctaaacatatagtggtatgtcatttagtctatatgtatgtaagggttataatatatctctgtccacagtatgccaagaaaaaaatgcacatttacattaaaagtactaaaccagcttattcttttctttcatttttcctaaggattattcatgggccagcaagaagacttgcacttctgggcctttttctaaagttcataatcgggcccactgccatggccataggatccgccgccgttggcatccgtggtgatgtcctccgagtagccatcatacaagtacacacaattaactgctactagtttacgagtgaaatttgcaagtgttatgaagtttaaaaactaaatgagtgtaattaattaattcattgatctttttaattataatcagttatttttttgtcactgttttctttttgaaaacaagatatattgtgatcaattgtttaactttttcttcatattttttatttttctcatgaaatgagtgtatgctgcaatacctcagtttatttcatcctttatatttggaatatggattgcatgcagacgtcctaagtacggcgtaagtttctactggtagatttaattatcagagttaattatttataaccaaatcaataatatgtcttaaaattgttatcttttgtcatttttgttgttaaagggtggttttcggcatgataatgtccataccatttatgatcggactatatatacttttggaggaaatatgactatatattagttaacaagggcatatgtatcagtaccatctgagagcagacaaggatcatcaccatgataatgtaatctatattaaacttaccatgggtaatgtaatctttattatactcattgaataattcaaactcaccatgggtaatgtaatctttattatactcattgaataatttgttcatgaaattttcagttatggcataaggtgtttctggaatgacatcgtgcacccattttacagaacttacatattgtaacataatttgtaacactttaagacatatgttacaagatagttcaatataaatttgtaacactttaagacatatgttacaagatagttcaatagcaacacaagctgtgtgttataaaacatacgagttatgttatacttgaactgtatagtaacacctacatatatgttgctgtcgcctgtagtaacacaatgttatgaatgctgaaacagtgaacaaaagtaacacaatgttatgaatgctgaaacagtgaacaaatatatggtaaaaaagtgttgcttattatggagggagttaaactctagacctttggcatacgcaattctcaaccaaccaagtgggcaagtataccttggtgttgctaggtgcatgtaaatgattttactttcttttttgcgccatcacactatcaactgttgtccaagttttttttagaaagaataataataatatctaggctcaaacatgtatatcgcaagcattgcgatccagtggcacctgaaagcgcatggctgtgtttggattatgttgtgataattttactttgtgtgttttttaacgggagtagctatatttatggaaccatatttttcattaaaaaatagtcagcatgtatttacattgtaagtccctaaattacatatgtaattatagtgtaagtgatatgcaagtgctgtgtaagtgaataaatacatatgtaattatagcgtaagtgccgtgtaagtgaatgtggggggtaattagtgtataagtacttcaaaattcaatattaatttgttttggcaataaagtgaatgccaataccgtgctcggttgttaggagctctgtctgccgacttcgaagttctgggttcaaccctccgtcacgacactttgcactagcacgaatctcgatgtaaatcgtactgtcacaaaatcgactattttttgacaaaaactggcgacatatttttagcaaatctgtttttttactctgatttgcgacatgtctccaaatatatatataaaaaaaaggaaactgctaaccatagagcaaactattcgaactcacatgtctactgtattcgtttgttcggagatttacatcaaccgtttactttccgttgcattgtttacttaaaaattgtattactcttctattttctctcatacctctcattttaatcacctcagtttttgccatttttctataatagaccagactaaagttcccttgagcttgtgcagttctcaatatgcaaattattttggagttcataacattgtttaatatacaatcgaatttccatatgaagtcagatatatatattacagatagcatgttgatcttagtttaatccattaacatggtcaaaaatcaaataatcatccaccaacaatggacttaattaacataccctccactagcagagtagaaagcaacaatgtgcaatctctgttgatgaataaccatgggaaatacaggatagcaaagctttcaaagccaatacactccaaggcactccaaatatcacatgagttgatgacatgattacatgggttatcaatattttttttgcggggatacatgggttatcaatatgacattgcaaggttaaaaaaaaagtaggtaatgaatttcctccgtgcaataccaacagccttgaacaaattgaaaataaatcctgcaaaagaggttatcaaaacaagcctttacttgaatttcccaccttgacaaaccaaagaatgggcttgaaaataaacagttgatatcacatagatgaaaatttgtactttctataccaacaacagtgacaaacatgtggtggcagtgtaaaaaaattccaccacttcaaagaattttaataaacatactcaatgatcacacacttctgctgtaataatcactaattcacacaattgttaaatggccattggatcagatcttagtttcaagatatttttttccacatatgaaaactcctttattctaccaaaaatgctcataaatggtctgtagaaaagcaatgtctgtttactagcatttaaatccatagtttgctgtgttgaaatagaaagtaaaggtaatgtaggtgtgttataaatttaataaccacaagtgaatatatttgactatacaatttgatcttcatctcacacaaagtttgtcgctaaatatgtggagatgaggttaacagcacctggaggcttgtgttggatccatgatctagtggacaaagcttacatgcaaccttggagatcctgaattgaataacaaaggacaatctctgtcacatgcataattagaataattgaaaggccacagatggctgattatacctatacaagcctgaaagcttagatcatggtacaaagatgttgttactaacaaaaaaaaaagataaggacgaatgaatagaatcctaagcaacatgaacaaccttgatgaggactgtatataagactgggagtgtctacatcatttcacatatcttttgataaaaaaactgccagattttccaccaaacgatttaaaaaacagaacttgctaggttagttcacactacccattcatctagttatttattatatttatcctaatgtatgtattaacatgtacattcatgtacatatgagtattattcatgtcgtagttcgcagctctatcctgaataaaaatagctatgtgtttagcagaatttgcatccattcataccttactgattcactggttagcagaaatcggccaattgcaaccatcaattcttcattcaaaacaacaataatgctagcaaaaacaggtcacaagttgcatattattcctaagaaagttccagcatgaaatcttacttcatctgtataactataataattactagtacatatggtagagaatggtaatagtgagggggcagtgctggtggatgatgacatggatttgcacgtttggaacacttacttcatcacctcctaatgtaatctgacattccaaacaattatggcatgagcaagatagccaaagcttgggttcaacaaattctaatagatcgtgtgcacatagtatgacaatcactgccagcactaatatggtgtttgggattattaaatagtgttctcaccagatcttgcaaatatatatatcacgtccatgctgcagcttctagtagatgcaaatgaccttcgtgtgagtagctaactggagctgcctaaatccacaaaagtatacagcggtgagtcagttcacaagaatatgaaacaataagaccaacgattttgcactggcccaaagtatcgaactcgtggtgtgcataaagaaatagagtgctaactattgtaacctgccatcgattggcagaaacaaattcagcaagttcttactatgataagcggtcgttgattggcaggaacaaattcagccagtgaatccatcacggtgaggtggttgctgctggtgctgaaactgaaaacataggggatgcgcgcgggcaaagccgccagggaccacccgttcaacacggatgatgcactcatgccagcgccgcgcggctggaccggatcacgtcagttgacaacatggggctctttatggacaatttcacaaacacattgcatacaagacgagatgctggagaaaaaaacgacagcttagggtggtgataggtgttaccagcgtcttggctccagccgttcgggacggggcggaagttggaccacttggaggagtttgccttgccgaggatggtggcagcggcggcgcggaggccggccgtcacgctggcgtcacgacagacgacgaagccgagcagcgcgaacgacccggccgtcgttttcagccggtcccgcgtcacgatgttgtccttgaggatggggacgccatggagcggcccgcagtagcggtggctagaggcgcgctcgcggtgtcggcgcgcgccggctgctggagcgcgtcggagttgacctcgatgacggcgtggagaagcgcgttgaggcgggtgatcttgccctggggacgagcgaccagggctgaggcactgccgcaccggcgacgtcgcctgggctgcaagggattgtgccgtcggccgcggcgggccccgccatccgctgtggagaagctgcgaaggctggagagattgggtcggtatgtacagggaaggagtcaaggagatgagatgggttttgttctctgttaggaccataactgcttccgagagtggagaagaaaacccggcaaattgagggaggaagcgtacgaacacaaaattttggagcaaacccgcggcaaaatcagttcgtttctgtttttcaggcacaagagagctagattgatggaaatctgacagggtggacctataaagaaataaattagtagtagttttatttttttttagataatggaatagaataattagaaataactttttttattactagtagttttatttggaatgctataaagttttaacaattttgtacgcaccttatcagtaaattagtttaatccatgttaatgaaacaaaatcttcccctctatatcaaataatagcctattacattttcatatacagtgctatttataatgtgtggaaaatgaaattttacgaaaaagtatacatatcgtttttttatgtaatatgacgaaggagaatggaagtaggcacatagtgagaatatctagttattccttacagcaatggcagcggctgacgacgctatctaggcacaaacatatagaggctacttgtacataaataaccagaaaaataaacaagcttgtatatgggatggacaattaacttcgtatcagcagcaattttattaattttctaaagaatttagagggcactttgataatgaaatttaagccaaaatatgcgaaccacaaacaagcttcatttaacctgtaaaaatcatcttccattaaatgctatgtttgtagccacgtggtttccctagcttacacgtaggacgctgaagacataaggctgacttggatggctagtgtctaatagagacagctatgtttgattgtgaaaagcataggaagtaagtagtgatgagatgtttgtactcgcacttcaagctatttatgaagatagccagactcaaatagaccaatagacgaggaaccgaagatagccagactcaaatagaccaatagacgaggaaccaattgagacagtagagcatggtaaagtcaaataacatagaattaaattaatggatgtgtttaccatttaatacgtttgatcaagaaaatatataatgttttagacaagttccaactaaattattataactttaaatataaatgaaaatgatagtttgcacacataacaaatgatacatgtacatttttgttttgaaagtaatttcttaatctcataaacttattatatttctataaatttatattttataaaagaattgtgatcaaacttccatctcaaaaacaagaatgtagaattaaatctcatgttatatatataaacaaaatcaaaattaccttaatttaatacttacatgtggaccaatttttttaacttatgggctctcgtagttttttgaaaaagaaataccgtactattttttatgagcaatttacatgaaaatacttcccgccaatctcgattttccgtctagagactgccgccaaaatttcacatctaacgaaccggctaatttatctccacattttcagctcacgatataataagtaggggtgaaaacggagcggattcggacagataatagctataccatatcctaaacctttttttaagcggatgcggagcgggtgcggatgacgtgcggatgcggatgcggagcggattatttcggacgtcggattcggtgcggagtcggtgcggactcggttcggaaacggacaaaaagttgtcggatgttaagtttgtattcaatccgtacaacaagagggcggcaatacaattagccgcaatacgatggcaaaacaacatatgaacatgatttcagctctctaggaaaaaccaaccaaaacacatcaataatataattttgcttaatataacacatccatcaaaaacataatataagtgttcagttcagcagttcactgtgttgcttaaaatttaaaaatatagtgttcagttcagtagatcagtagttcactcatcaatacgacacgcatgaggcaatgaggcatacagctatctaggcatacagcacacagccacacaacacagtagcacactgcatacagcacacaatacactagttccatacagcacactgcttacagcacacaacacacaacacactgtcggcggactagaaggaggagcggcggcggtggcgccaacatgctgcaacggcggcgcggcgcacctatggtaatggtgccatgcggcagcgcgtgtgggagcaggagaagggactaagagatgagtcacagagagagagatttaggggaggattggattaggttacactagatgggctagatgggccgtccgatgtaaaatgggctaaatagagttgttgtgtggcctgaaagttgcggattatccgccaaacagtacatcggataatccgattaaaatatcggataatccgcatccgtcggatatcgttgataccatatccacatccgcatctgcatccggccgaatatctaaaaatccttaccatatcctcacatcggacggattcggagcggatcggatcggataatatccgctccgttttcacccctaataataagccccaacaccaactaccccatcacctccttaactccaggaggaacccacaattcatcagtcatcacccgagcaaccgaggtttatgcttcccatctactgcaatctggtattctcaactactcagatctcggtgatgagaaaggggacggctcgtcgcagcccccatggtggcaggtggcaggggagaaaggggagttttcatcggtggagcgacatcgatctcgtcaggtgaaccgtgagcgatgtcgagggactatagacgccggcggcaacggaggaagggggagaaggagtaaagtgctcagccgcacacgctggctctccccagaactggccatctatctagcctgtctcacccatccctttcttcatggtatttgcaggatgcaagatcgagacacatctgattgctggagagtcgagaccaggggcggatctacggtgttcctaccagtgtcagctgacaccgacgcccttttgcaaatcctacacgatgctatttgtttttagccaatgacaccatcgatgaaagttcactgacaccggtagattgaccaattcactacagctcatgcaattagcaggtaataaaaacatgcgttgttttatgaaagcaaaacagttatgctattgttagcattacacgtgcaaacaccctattttcctttagttaattaatcaacttctcatagttttgctaagtgattgttagaactaacttgcttggttactttactttgttctgatatgttaaacaattagtaatttaacccggtgaaatgtgtcattacttctttttaggtttaatagataacaatgtagaataataaggtatagaaatagtgcgcaacagataaaaagcttacatgtatgcattaaattttgcaaaaatgttttttaatacttagaagacatggtaagttgctcgaattgttatcaatcagtgatatctatttctatgttgtactagtaattcactaatgttagaacacgtgtagaacattatagataactaagcttcataaatatatgatttagatttatgattatgttgataatattgggatgaattattttgttcccaatcttttatgaaatactataaaaatttaaaccattatagtttaacatatacacttcaaatccagtcatcgattaaggatctagaactatatcaagctaggctataataaaatatgttttacctaatgacaccggtgactgaaaatcctggatccgcccctggtcgagacacgtatgattgttgcatccttcttgtgtacgcatggtgagcacatcacaagaacccaaaggaaccctttttgtggtttatgtactgtttgactaaattcttcttcagtaagagtggatggcttgttctctgtcacagatatgcacatcatgtgtttgagaagcttcactgtgtacagttgcatgccagctccgtaaaaggaaaattttgtccttagacagattattgatgttttcttcacacctctcatactttatctgatcacgtgaaattgcaaaattcttattgccaacatgatcatccacaaaaaaaaaaccctaaatctgtgaattagtagtgcttattgctttcagcttcatgcacgcattgggtgatcaccatcaacagaacagctttttatgcagctagccagttttttcaaggggattaagttgttgactccgacaagcaggcagtatatatggaccgatttgttcgataaaatccagagttatgtctgatcattacttaaaggtcacaacagagggccaaaagagcaaaaccaatataatacgagttgatttcttattgcaaaaaaaatgttgacttgtttgataaaacactagctttgaagaatattttggatcagcatgttgtggtttgtgcatgaaagttcaaaataacatgagctatatctttaaattctgggaacgaaatcttaagctactattctgcatgtcatctattttcttccatgacttgttaagtaaaacagacatattattttctaatgatgttctgagacaagaaactaacactgcagctttaagtgtagagaatgaggcaaagcaactctatatcactatatgtgactgctcacaagattgtaaagatggacccacaggagaagaactcacagagcacatcatttggtgcaaggtaattatggctgcagccttctctggttagtcataattattctataggtattttccaatttattggagaaatgctatataggaaaaggtcataattactttttattttccttcacagatgattgatagaagttgtactgtcattggcaagagtagtaagatcttttagaagtgcatgctcacatgcatattgggaagttcctgttgcaaaaatatttgatgtttaactgttgacatatccagtgcatatatagcatattatgtttttgttctatggtgtgtggctccaaagtttgatatgttacccaatgtattcgttccattgtaggagtagtaatcatttattcttctatatggtggtggcggatactgatatccgatttgtatatctcagtcaactgtagctttcaatgttaagaaatgtgccattcgaactattttcctccattttcaacagcaaactgtgataaattgcacttgggtagtcctgagcactgtgtttttccaaaatcttgtattacactattgctgatacagtaaaataaaatactatagatgttctactgtagtatggaggaaattattgtggtgtgtaggcacgtttggaggaatcatgaaagcatgatgtgtacagtcaacactccacaaacatggcgttagatagtttactttagatggacttaaatactaatgcttcttgcttcaatacattatttgattctttggtgctacatcgtctttcttcccctctcaagcaggtttgcaagaatatatttaagatgactgggacactaccacactgggtttccaatggtatcaaaggttagtgctactctgtttttggttgacagaacagaggagaaagaacatgaagcttagtaataaaatgatctgtccaaaaaccaattagaattctccagtttcggatatatagaggatgaaactatcagataattatattcttaacaggatcattgataatcttgatgaacattagtactcctaatctatttttcaggtggcaattggcctcactttaatgctagatctgtgagcaacttttgtttgtctttgaactagtttagtaaagtggttacaaatcattgtttcaagcaaaacgataaccggtaagacccgtgtgaagtactgcaagacaatggacaatatggctatgttgtttcatgtatgttcatagtagcattttatatgctgaagtaatatatggtcaatattatttcattgcaattgtgaagtgtaataataaatttcttatgtagattcaaattatcagtggctgaattctgacacttgaatcccacttcaagatctaaggaagtagcgaaggaatttgcgaagatgatataggaatagatatattgcacaattatctagcagagcttgctgctgaaaatgtgtacttttttctttttaaaagatatgcctatgaatttctttgttacaagatgtaaacaataattctgtaaatttccttattgaaattcaatatattatgcggtagcgctattcagcgcacttgcgcacggaacattgtttcgagcaccgcatgtcaagcccagtgtccgcaaaaaccgtgttcggttgcccacgttcgtgccatgtagattagatctatttgaatccgggtagttgttaaagatacgcctctgcgtgtaaatcaattagtgtcggatatagggacaccttctagcaaccagtcttgtggtaattgatttactgtatagataaattgtgtgaaggagtttgttgtaattgatttaccgctgcgtgtaaaaaatcgatagtaatcgatttactctgaaaaacggggttctaacctaactcaattaccgacacgtgtcccattcccttctggtggtaaatggattacttattacgttggtaggttaattgggctccttttcacagctaggcatatggtaatcgatttatcggggtagttaaattgtttgccatagttagtgaccgagtttgttgtaaatgtgttactgttgtttcgggatgaggtggttcgcataatgcagtaattgggttactgccacattgtaagtaggcgttttcgtcggtaaatgaattatcgtattatggtgatttactacggaagttatgacaagattgtttcgtgttggcgatctggtcggttgttgccactgcgtgtgggtgggtttattctttggcaacttcacaattttggaggggtgcggttccatgcggtgggaagaccaattgaagcgtcatagtgacacctccaacgatgaactccagcggtgctcgttttggtgaattgccgccaacatctgcatcgccacagcgtgtgttaggtagtcaccacaatgagctagtgtgaggaggggcagtcgtctgtactggccgggatgcgaactgtatgccaccatctctgcgtgagcatgagatttctactccaacacggccagcagtgtacacccatgtaagtagtagttaatatgttgtttgtaaggacaaatttttgtggatgaacagatctatgctctatggcatttatgcatgcagtacgggtgggtagtaatagttttactaaatgcagtttagtgggctggatgatgacatggtgccgaaacaaaatatggtgttaaaagactatgacagtgtatatgatttctatgaganatatgcttaccatgctgggtttgacataaggaagagtagaactaagaagactataagagaaatatgttgctccagggaggggcaccataaattttataaaggcgatgaatttgaacgtgagcgaaaccataggacaaagaaaactggttgcaaggcatacatgaaggtgaaaaatgtgatggttgatggtgaggtgtcgtctgttgtgtacgatgttgttgtgcttgagcataaccacccgctcacgccctctctagcagcggtaaagcacatgagatcccataagcacacggatgacacgataatggagtttgtgaacaccatgcaagaaaacagggtggcgcagaacagcctaattggagtgcttgctgacatgcatggtggacaagagaacatcccattcacttcacgcaatcttgagaatagatttgtatcctgcatatgtcatttgccgattgaattgcattaaacatccatacatcgtggcaccgtgttgaaataaattgtcctttgtaatttggttactaaacaggaaagccgctaatgtgagagctgagaatgcagacgacataaacaagctactggaattctttaaggagtgcaagaaagataaccctcagttttattgggatgcccagcttgacgaagatggcattctgaagaatttattttggagccatgcaagttgctaggcggcgtatgcagattttggggatgttgtcacattcgatacaacatacaaaacaaacatatatgaaatgccattggcaatgtttgtaggttcaaaccaccatctccaaaacacgttgtttgggtgtgcgttgcttagggatgagaagaaggagtcattcgagtggttgttcaatactttcaagacttgcatggcggattggccggaactatgatgcatactaacaggtaatgtattaagcaaaaagtgcaatgttgtgtggttactagtatgcaatgatatttgcactttactatgatggtgaacttgtgtggtaaatgagtaaaatatttttgcagaccaggatgtagcaatggcagctgccatacctcttgttttcaagaacatcatacatagactgtgcaggtggcacatacttcacaaatatgcagatgccctcgcgattatattcgcccgtcatgaagatttagagggtgacatggagatttgtattgaccaaacatataccccgatggagtttgaaggggcctgggcagaatttattgataaatatgaactacatggtgtgggaacaatggagcggctgtacgaaatccaggagaaatggatcccagcttactttcggaagactattgtggtcggatgacatcgacgcagcagagcgagagcacaaacagattggtaaagcgtaagtttgttgaccaccagacagcgctacactggttcgcgcgtagaatgctcgatgtattcacataaaggaaggagaaggaggcagcagaggagtcggcttgcatggaaagaaacaatatatgtgcgcataaactatcagcgtgtcactaactatagaaaatgcagtgattaacagtgttaaatgtgattcatgtaggccgaaatcagctttgcaaattgttggccgttcgaggtgcagttggcgagactatatactagggcagtattcaagaaatttgagggggtgttgggcgatagcaagtcattcaaaattaggtcaagtgaagcatccagtgacacatggatcatctcgcacacaaagagatcgctaaaatataactggtgccagcgggagttccgagtaattgcaaatgttgatgatgggcagtatgagtgcgagtgcatgctttgggagcatacaggtttggtggaactgtacatctgtcctatgtttagttatcgagtggagatagactatttatttgagcgcactaattttggcttgctcatgtttttgtaacaagaattttctgccctcacttgcttagggcatttgtccacgtgcaggttgagaccatcccggccaagtacattctccgtaggtacactatgcaagcgaaaagcgacatgcccttcgatagaagggaccaaaagacaattggttcggacggtgtgcaagagagttacagaacaaaagtactgatgaccgaggctatggctgttgcaaaagctgggagcaaatcataggacgcatatgatgaggcgctgaaaggcctgaagagtttgagaatacatgtcgaaagcatcccgtccagttctggatcatccattgctgttgatcaaacaacaatgcaaggagagggggaaagaaatgacctcgctagccagataagccgaactgcacctcctaagtcgcgaacaaagggtatggccgccgaaccaggacaggggatggtcctcggcacaaagggcaagaaggtttgcaacagggtctgtgggtggtgtcataaaaaggatggtcattacagcactacctgcccaaagaacccccaacaacttcgacaagctacagaaggtgttgaataggggtaaagggaagaggggccgaccaaggggcagcggtaagcgtatagcgggggtttcagccaatgttaggaggaggcttgaagaggaaatggattatggggttgacgaggatgaagagatgattgatggcgaggatgattctggaggtggcgccgacctatgatgtgtacgctccacactgtccatattgacgtatgtgccataatttgtgtaacgtgcaaatagcattgttaagccccaacctaacatcaaatgtttgttatgtagtacatgttagtttaagtgccagcttgataatagcaggtttcagaatataaatgtgtgccgtgtagatggtttcacagttgttgaaaacagaacgttgaatacgttttgggtgctgtgtgaaatgtgtgggtgtggcttgtggaattatacactttgtgggtttgcatatcagtggacacatgcaaaacaaatgaaagcgcatgtggggctgttgtaattggattactccaggttattgggtgtgggggagattcttctggtaattgaattattatcgtgtttggttgcaaagaaccgataggggtgatgaaagtgatgacagtagtgtggtaatccatttactacgtgcaccaaggatggtaatccatttactacgtgtgccaaggatggtaatgagacatgcacactgaatggcataacacagttaacgaattactggtcaatttccacgcattaaaaaagaactgaagtgctcggcagagagattgttgtaattaggttacatgagttgttatgatgcgtctaaaatctatagtaaagcaattattatcatcgttagctgtttaaacttgttgttgacagaatgatggattgtgtctcaagtaattgatttacagggtaaaatcacaaatgatatgatgaggtgcatgaagtaaatcgattactgggccttccactgtaaatgtcagtaatgcataacagcaagtttgaaggaactaaggctaccacacaaagcaaaatgcaactagttgagcaacagtatgttgttccattacaagtacttgggatcacatgaatagcattgttgttcaaaaaacagaagaccacaaggcaacatcacagggacacgcattgatcattcacttgagtctgcgcaggggctgctgggtcatagctcttctagttccggtggcagaggcgcagcaacattgttggagtggaagaccatgttgtacagcatctgcgaacgcaagtcgttgtactcctcctgcacaaaatgagaacagattcagcagggtaaataaggtggctaaaggttttccccggcaacgtaaatggttgtagcagttttaccgattcagcgacttgtatcaggggggagtcatcgccttcatatagctccatgtacctcatgacaaaaaatgcgcaatcattgggctttagcatgactgggcatttgttcctgaccagcttctggttcccaaacctcttgaaggcagtcctggctgctgcatagagcctatcgctgagccgtttcacaacacgactccctaggtcaccatggtgatccttgtactccgtattcaaagcagggtaattgttggagtcaaagacatctatgcgcccatggttccggttgacgcagtacagagtccagtggctgtggtgtataacaggtactataacctacacgtagaacataccatcttccaggattggaggtctttggctggtgggaggacttcacgcaagtgttctgccagacactgctcattaaagtctgccttgagtggtgggtccaggtaatcacagttaagcaggttctgcattgagcacatggtgtgtatgagtgtaaagggaaaacaaaatgcatgcatacgtgcgaatttaggtgttgatgtacgctaatacaaatcacaacttacagatacactggttggcaggaagattcggtccccagctgacatcgggctaaactcctgctcatcatgcagaatcaaatttatgaaagcatcgatgaagaggccttttgtcattgaaccatcagtgaacaaggacgcaatatcgctggcggtagcagcagatatgccaacttcaatgatgttggcgctacattgtacacaattgtatcacgtgacccaatgtataacgcaattaaaaaataagagttgtggaattgtacactagtaacaggaaaatttacctcccaaacctggccgggtcactcaaaatgcgttcgcgaagagcaacaactttcgcgctatccgggagggggcgtgtgtgtccaatcttgagcggtgaaacaaacctggccgacctgcgaggacagcgtataggttctgacgaggggatgtgctgcccaatgtcacctgtatcttgaaacaccactacctgcttcaagccaagcaggtaattctagtcagagtagtgcaattaccaaaatatttatttggactacagcggtcactggaatagtgcatggtaattcaattactaatattactacagatgtattgttgctggcaagcaaacatgactgaataatgcaattactaagtagtttgttcaggctgtgatgttgctgggattaaagtagagtaaatggataactagggcaagtacatcagggtagagaaaatggtcactggaattgtgcaaggtaattcaattactaatagtactacggatgtattattgcaagaaagcaaacatgtctgggtaatgcaattactgagtagtttgttcaggctgtgatggttgctgggatcagggtagagtaaatggattactagggcaaattcaggtgtagaaacaagtagggcttgtaacctgggtaggctgtggggttgtgttctccagcactccagcaggatcaatggtttgctggtcatcattgccttggcctactgtgcctgcatggcagcctgcatgcgatggaatgtgaggtcatctcggtgaatatatatggcaggaataacatgcatgcaacatggccatacctgtgagcggttgcgctccctcttcagtgtattcttgtgcagatgctgacagggcaggattggctgccgccgatggatcatggctcgaccgctcggggctgctacttgcatgtataatgcctgcagtcgcatcaatcgagcatccgccttggtcctatggcagtgttcctccgtcggtctgcatgccttgcattgcgctgatggcaggtcggctttgccattcaagcgtgcccttttccaatgccaaccccgattgttgcgtgtccgcctgctgtggggatgatgggtgcacattgctagccggcgaggaccttggtgaccttctcatagcttttggtggcgacgtactcctatccttgtgttcatcagtgctcttggggctggtaacaagtgactttgttgtaggtggtgatgctgtagctgtcctgggggaccgccttagtggtgtcgcctgtctttcggtgtccctggtagtatgtaataaatgtaggaataattataaatatagagtacccccactaattgcaatgttgacaagataaacatagatgcatgtgctgaaaaaacaaatgcatgtaaggtaattaaacaatgtgataatgcacgtggtaatgcatttgctgtgtcatcagagagctttgtgatagttgcgtataaaattatggtgcagtaaagggattacctccttcgagggctacatgcggtaagtggcagcagtgagcgttgcagcctccttggtgacctgcatgcctcgatggaatcggtagctgccgtcacggcctagtttgcaccgcttgtcgtggatgggccagttgcttgcacgtcggagacagtggcatgtgtgccttcagctgcaccagctccacgtagtgtggctatgatattatcgtacatttttgcctgtgcaacctagacttgcatgatattatcgtactggacttgaattccactgccacatcgatacaaggtcccagatttctccaagttctcaggacaagataatgtgtcgacttatgaacatgtcagccgatttttggctcaatgtggtgaggcatcggctaatgatgctctgagggttaggttgtttcctttgtctttgtctggatcggctttcacatggttctctaatttgccatacaattttatcaatagtttggcgatttggagaaacaatttcacagttacttctacagtggggttcatgagatgaagttaactgatgtgacatcaatcaggcagaagcatgatgaatctgttcaggattatattcaaagatttagagatatgaggaacaggtgttacagcttggttttgttagattctcagttagccgatctagctttccaggatttgctggctccaattagagaaaagtttctggctcaggactttgaaagtttggctcatctggcctagaaggtaggagtacatgagcaaagatttcaggaagcaaagaaggttgtggctttcaagaaggtgaacaatgtccattattttgcttccgaatctgattctgtagatgattctgaagtagcagcggccgagtgggctagaagtaagaaggttattacttgtcaatgggtgaaaaattctgcaaaggaggagaaatatgatttgatatcaccaaagctgataagatctttgatttgctacttcgggagaaaaaattcaacttccagccaataatgtgttaccatcggttgaggaattggggaagaagaaatattgcaagtggcataatactgggtctcatagtaccaatgaatgcaaggtatttagacagcagattcagtcggccattgaaaacggcaagatcaaatttgatgattcctagaagccgatgaaggttgatggtaatccttttcctatgaacatggttcgtacaagtgggaaaacagccgatagcaagaattatcggtctaaacagctcaattatgttaggattatcaacaagtatcaaagaaagcatgatcggcaggaagaaaggtactatgaagatgataacagttttgatccccattggagttgcgaatttttcagattttgctagaacgaagggatgataacaattttgatccccaggatgcagcaattctaacaggggacatgctgcaagttcaagccgatcctatcctagggaaaattgattgcttcagaagaagttgcctgttcatcagagattaggtccaattcatcaagattattttcaagattctgaagatgaagatggaaccaagaagcaatggtgtccttctggtattttcaccaagaaccagaagagaagagttcaaaggatgaggaatagggagcaattccaagaggtacaagaggaaattaatcatcggttgaagaaggctaagccaaagcaagagtggtgtgtgaagagcaaggtggtatcagccgatgagattgaggctgacaaagtaaagaggttggctaaaggaaaatctgttgcatctacatcggttaatatggtttttgtgttaccagctgaatttggaattagtcaagcccatgccgatgcagatgtagttgaagaatctttggctctgttggttttgtcaccagaacaggctatctttgagaagccagaggggacagaaaatcggcaacttaagccattgtatctcaagggatttgttaatggcaagccgatgtccaagatgttggttgatggtggggctgctgtgaatctaatgccatatgctacatttacgaaattgggcaagaattcggatgatctcattaagactaacatggttctcaaagattttggtggtaatccttcagagaccaagggagttttaaatgtagaacaaaactgttcctacaacattttttgtcatcgatgggaagggctcctatagtctgttgcttggaagagattggattcatgcaaattgttgtattccctcaaccatgcaccagagtttgatccaatggcaaggtgacaagatagaagttgtaccagccgacaggtcagttagcattgctaatgccgatttgtctgtttgggagatagatagtaccgattgtttgtctggaaaggtttggaaaggagattttctaaggtatccgattgtgatatatagccaattggagatggagagccccaattgttgctttgagggcgtcgtggagggttcaaatttctataccaaggatacagtagatgatctcgatggcaagctcggataaggtttcatctcggccgatgatttggaagaagttgatattggtccagaagatagaccaaggccgacatatataagtaagaatttgtcatctgaatttagaaccaagttgatagagctattaaaagaatacagagattgttttgcttgggaatattttgagatgccaggacttagccgatcgattgttgaacattggctacctattaaaccagggtatcggccatataaacaaccacctaggagatgtaaagccgatatgtatgatgctataaaggccgaaattactcatttgtatgatgctggttttattcggccatgtcgatatgctgagtgagtttctaatatagttccagttattaagaaaaatggtaaactcatggtgtgcattgattttagatatttgaataaagctacacctaaggatgaatacccaatgccgattgccgatcaattggttgatgctgcttcaggacataagattatatgttttatggatggcaatgcaggatataatcagatttttatggcagaagaggacatccacaagactgctttcaggtgtcctggtgaaatcggcttgtatgagtgggttgtaatgacttttggtttgaagagtgctggagctacatatcagagggctatgaattatatctttcatgacttgatcgacttgttggttgaaatctacattgatgatgtggtggttaaatctagggaacttgatgatcatatagccaatttacgaaaagtttttgaaagaacaaggaaaaatggtctaaagatgaatcccacaaagtgtgctttcggtgtatcggctggacaatttttgggctttcttgttcatgagaggggaattgaagttacacaaagaagtattaatgcaatcaagaacattgaacctccagaggacaagaacaagttacagtcatgggtcggcaagataaatttcattaggagatttatttctaatttgtctgggaggatggagccctttacacctttactcaggttaaaagctgatcaagaatttacttgggggcagagcaacagaaggccttggataatatcaaaaattaattgagttcccctccattattgattcctccatagaaaggggtgcctttcaagttatacttgtcagccgatgagaagtcaatcggctcggttttgatccaggaatttgaaggcaaagagagagcaatcttttatcttagtagaaggcttctagatgcagagacaaggtattcaccactggagaagttgtgcttatgcctatatttttcatgtactaagttaaggcattatttgttatccaacgagtgcactattgtctgcaaggccgatgtagtcaaatatatgctatcggctccagtattaaaagggagagttagaaagtgaatttatgctttgacagagtttgacctcaggtatgagtcgcccaaggcagtaaaggggcaggctatagccgattttattgttgaacatcgagatgattcaatcggcttggttgatatagtgcgttggacattattctttgatggatctatttgcactcatggttgtggtatcggcttggttattatataaccaaggggggcatgttttgagtttgcttacacgattaaaccttatgctaccaataatcaagttgagtatgaggcagtgctcaagggattgcaacttttgaaggaagttgaagccaatgctattgaaatcatggaagattctttgctagtcattagtcaattagctggagaatatgagtgcaagagtgatacattgatgatctacaatgagaaatgccgagagttgatgggtggttttcggctggtgacattgaaacatgtttctcgagaacaaaatattgaggctaatgatttggctcaaggagcatcgggttataagccgatggtcaaggatgttgatatagaggttgccacaattacagtcgatgattggaggtatgatgtttataattacttaaaaattccttctcaatcggcttcaaggaaattgaggtacaaagctttaagatatgttttgctggaggatgaattatattatcggacgattgatggggtgttgctcaagtgtttgagtattgatcaagcaaaagttgtcatgggagaaatgcatgagggcatctgtggtactcatcaatcggctcacaagatgaagtggttacttcggcgagttgggtatttttggccgacaatgttggaggattgttttagatattacaagggttgtcaagattgttagaagtttggaacaattcaaacaacaccagcatcggctatgaatcctatcatcaagccatggccctttcagaggttggggaattgatatgatcggctagattaatccaccatctagcaaatgacataaatatatattggtagcaaccgattatttcacaaagtgggttcaggcaattcctttgaagaaagttgattctagggatgcaattcagtttgtcaaagtgcatatcatatatcgatttggcgttcctcagactatcacaaccaatcaaggatctatctttgtgtcagatgagtttgtccaatttgcagaaagcatgggaattaagttgttaaattcttccccatattatgcgcaagctaatgggcaagcagaagcatctaataaaagtttgattaagttgataaaaagaaagattgccgattatccaaagcaatggcataaccgattggctgaggcattatgggcttatcagatggcttgtcatggttcgattcaagttcctccttataagctggtttatggacatgccatgggaaattaaaatcggctcaagaaggattgaattacaagatgagctgtcagccgatgattatcataatcttatggtggatgagtcggaagaattagtacaatcaagattgcgtgctttggaaaaggtaacaagagataaggaaaggattgctcatcattataacaagaaggttgtgccaaaatcttttttagaaggcgagttagtttggaagttgatcttgccgattaggacccgtgacaacaaattcagcaagtggttgccgaattgggaaggaccgtttcaaatctataagtctgtttgtaaaggagcttacatgttgcaaggacttgatggagaagttttcagtcgagctctcaatgggaagtatttgaagaaatattatccaagtgtttggatcaattcatgattcggttaagttgtgccgatgcatgacagccgatgttgtgacatcgcctttagatggccgatatgattaatatcgcccttagactttttatttttatcataatctgttatgtgtagccgatgtgtgatagccaatatgtgttgtatcgctctaagttttttttttcttatcataatcggttggattgtgccgatgtgtgatggccgatatttgttatatcgcccttagttaaaatttttaattttctcaatgtttgttcaacattgtaaaattaagggggcatatgcatataaaaaatatggacttcaaatcaaaaatatggactttagaagcaaaaaattatattaatcggcacaagttcataggagaagatatattacataggcatcaccagaagttcaaagccgattacaaaagtgtttcagtcctattacaagccgattactcagcaatatatctctggatagccgatatagccctttgcctaatctgcatcacttcttcaattgcttgggcgtcttgagcatcggtttcagggatcaccttcaaggacttagtcatttcagctagatgcttaatggaagctttcagcttggacttctgttcttcaacaaccttgggcaaatcggctagcttctgcttctctaaggcaagctcagcattacattcctcaagttgagccaagagctcaatccttcgagattccagctgatctatgttggattgaattggaccagggctgtcacgtcccgtttttcgtgtcttctaattttcttaattttgaaatttagcatttgtgtttattcgcctaaaatagcttaatgaaaatttcataaatgaaaaagggtttaatttgactaaataaattaataacgccgccatttattttatcgtttgttaattggagttatttggttatctttgggtcttggaagtggagctcaattcctggaattttccaaagtgtccaatccagaaaaaaaaattccaaacatcccaaaatcctccaatgtttgaattttccagaaaattcccatctttattttttttccttcctttctattttttcttttcctttttcctcccttcctttcttcttctcctgtggttctgtttctgtcgatccaatcaattcctctcggtgtgcatgggcaggagcctagaaaaaccccaatcagatgagcaggccaaacccagcccaacccaagccgccatcctccccactgcccacgcacggccacgccgtttctgcttcgtcttcaatctgacgtttttttctccatgaaagcagcaacgtatcctccaattcccatcacagatctatcatctccctcatcaatcttactgtttaatgccaaaaaatgaaactaccttgatgatctgaatccgtttcccaaatttccggtgacctctcatctcccagctagtttaccttcctcctccacagataccactgaggatgattagccgtttcttttcttcttcttccaatctactcactaattccttcctctcctaaatcatttttttccatcaatgacaaaaattgaatcaccatgatgagctagatccatttttccagcacatatggctcctccactttttaccgtccacctcccgtgtcctgtataattgccagtgccatgccctcttctatttcttttacatggataggtcagcgccctgccaaaccgcttcactgccatcgccttgggagattttgcaggctctgtcatcgcagcccggttgagttcagccacggtagcgcttgcaaacagccacaccatgtgctatccatgtgaaagcatgatcgaggacatgaccacctcgtcgggagcttcctcaaccgccgatgcgccgctgctatgctcctctgcgctgtcgtcttcacctcatcattgtcgttcccattccatcacaccaccatctctagagtttgtgccgtcatcatacgagcatcatgctgccacttctctgtcatggtaagcacttgcaccgcatccaagtccattggtcgtttcctccttcctattcatcatccggtgtttgcacaggttgagaggccatcactctgctgctcttctgttcttccatgtcgggttgctgtcgtgtgcacataaagacgccactgcctcgtcgtctagcacatattgttgctgccatgtctccactatcgtggttggtaaggacctgcactgcctccactttttataatcatttcctcctttatttatcaaaaactaaatcactatcaccgtcgatcggttagctctgttttcaccatctctccatcttatggctgctcgtacttttccccttttctcctctatatatatttaacaacacctctgcaatccttttcttttgctcgcgcatgctgagatgctctctgctctggcttccctatacagcagcgctgcccctccaatttttattttattttattcgtgcacactgggactcttcatcttgctgttgtgatgctatagatggccaaaaggcccgaggcccgacggcccggcccacggcacggtgttttggcccggcccaagcacggcacggcccgtcaggggttgggcccgtgctggcccggcccaaccaccgggccgtgcctgggcccctccaccggcacgttgggctggcccagcacgaccaggctagcacggcatgatgggccgcagtccaggcccgacacataaacaatagggagtaaaaatagacatattatataccacggtcaaaagaatagggacgtcaaatagacttattttagctatatatatatgtcagcccaaagaggagggacggaaatagacttattttcactatatatatgtcacagcccaaagaggagggacggaaaatagacttatttaaaaaaaggcacgatggaccatccgtgccttcgggccggcccggcacagcccggcatgaagtgccgatcgggccgtgccggcccgatggctggtgggccgtgcctggctgtgcatgggccgggccgtgccgggcgggccttttggtcatctatatgtgatgctataccatcacatccaccaatgccgcctcgggtgaatgaacatcagcgccgctgctttcttccatgccatcgcccactcgtagttgtgccatcgttgtcagtcagaacactccataatgcaacaccgttgcttcaccaacgccaagacgccgttgtgctgctactcctcttccttgcttcgctgcctcctaaagtcgggaaaaacacatgttgccgcgaggtcgactttggccaaatcctccctgtcctgttggcagcgcctatttctaggggctcatgccgctgctgctatcttctccttatggacggttgccaaagcgttgttgctgtccccttttccatggtcatcgcggttccatcacaatgctgcatcatcaccgtcctccgccatgagcccggtgtctcctcttgttctcggcgccaccaaactactagtggatggcccgtggtcgctgtgcctgcagtgtgcccataactataacttccctctgagaatgactcatggaccctacttgttaatccacaaaattatacatcgttggaattccgaatatttcagaaaaatgttcttgaaaatccgttcagcttttccaccaaatttctatcttccgataccactatcgatatggaacacaactctgtttcttcccacgccgaccaagcggttggctgcatcatcattgttccaaacaagcgaaggactggagttaccacttctgtcatcctcgccaacaccacatcgtcaactacccgtcgttgttgcaaccgtttctactatcttgttccctgtactgcctctataatcttcctccgccacgcgccttgtctctcttcttattcctactagtgctggccctttttctttttattcacgtatgctgagacgctgatgcccaagcactatcctccctcgcttcgctgccactgtccctaggagtttgagccattgttgccacctctctttccttctcgtgcacagccatgtcaccatcgtggttggtgagcagctgcaccgctgtgacaaaatctgttgtttcctccccccgcgccaacctaccacgagcgaccatcgagcatcccggtgagctccacctcgatgtccctgactccaaaccgactcctgaagcccctctagctatccgtccaccatccagtgctttatcatcaccacgcctattatgtgctcgctccacggcaccatgttgcacacctcatggttagaccaaacctcctaatacccaaatcaatccaagtcatccctccctacaaataaatctcggccatctacgtaatcagtccaccactctactccctataacaaattctccgttgatcatcccactgatggatgtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctctttgctcgcgtgtttcgtgccttcgtagacacctgcgaaaagtttcgaccaagcagccggtcttttcgtcacctcggtacgtgttaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggagggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgctatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtacaaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcctggcagggcagggcaggcggcgcgcgtgcacgatgtacgcgtcgaatggtccgaaaaattggctcctcacccttgcgcagatgcagcctccttttgcagttttgttttgctgcaaattcggattcgttttgttt

SEQ ID NO: 40713 - DNA, 37722 bp, Oryza sativa
acttctccatgaaaatgttctctaaattcaatctttcgttggtcctatctcctccgtccaaattcagattcaacccattctttctcctatgttattctgaaattgagctctacttcctgatttatttagttacttcatttgatgttatttttctgcctttttcttttgtttatttgttttctcctttttgcaatcgtgtagacgccgttgccgaagaggttgctgctgcaggtgaagatttcgtctgaagatcctgtgggtaaaggcaagtgtacccttgaacatgttgatcctaacttgcaaaattatattgttttaaattatatgcatgatttgtttcacaaattattgtgtgggtagttataacctacttgttaattattccatgcctttgaattattgttgattacctttcatgccatgtcaccctagttttcatgtgagtcatatatgggtatggactcaggtacttagatttgcttagccctactcacactagtttacaagcaaaatataatattgactaatgatctacttatcactgtttttatataaattgtgtggctgtgtgctatcttcttggtggcatgtgttgcaccgtgtgtagtaatgaactggtggaaaatgttttagaccggggcgatggtggatctgtgtgaacctgggaggtaagccatctgtgtgcgtgcttatcattgacctgtgtggtcgattgagcggtgtgctccagagctgtgtgctccatttttgttgtgtgcttgaggtccttagtttaagcaagtcgccctggtcagttaaggacttcacttcgtgcgccattgatctgagccttaccatgcaaccacatgttttcatgggaaggacctagcttagtacactgcttagctttggcaccggcggcccaggtggctagatgataggtttttggtttgtaccatgggaactttcacctgtgtggtgtagggaggaccgcccatgggggaagccggtgttagggcgaggtaggggaaacgctttgttacactttggtgtttagcggcaccgaactgtatcttgtgggtaaagttgtacaacctctgcagagtgtcaatctattcgaatagccgcgtcctcggttatggacatgctcggtgacttcacatgaggggtagatttgtgaaagttttaattttgggaaagagttgtgtgcaggaattaatgaatatagatgtgttgtcctgtgtggacaaagaaccttttggtcttgtgtggacacagtatcctttttgggttggttggttggttaaaaatgttgtgattgcaaatgttgcttaaattaaatttatatctatttattatatttaaatttgcaaatgcctttatgcaaatgaaccctaaccgtcctttgaagccttgtatcatatattgcatattcccgtacacttgcgagtactttatgtgctcacccttgttgtctcaccaaatttcagagaaggtcagttgtttctagaagttctgttgctaagaacgtcgaataggttgcgtgccccagtcgattgcctgtggtgtgtcgttggtgcctctcgcctctttttcctctgtttatctctgtttgaccctgcgtggcaaagaaattataaaatctggtcataagaccaatgtaaaaattatatttgtttcctatttattaatataatcgtgatgtgattgtgatattatcttttgttactgtgtgtgctagcgttgatctgggactagcacattacacacagagggatcgtaattggggtcccgacaagggccaaaagatagctgatctaggttggctttctcctcattgacagattgccgattgacttggatggttgcctctatatcttttctttctcgcctattggctatcctttgtcttgctttctccaacttgaattgatgttgttcaagataaaaagctggagttagcgtagtggctaagtcttctgggatcatattttgaatttcgtggaaccaggccctgattgatccacaatcgactaccaagacatccaaggaattctctagccgatttgatatttccataagagttctcttaacatcatcggctagaggagctaaggctttgcttgaggtgtcttcttcttcttcatcccagaattgtcttatgtcaaaagagaacatatcggctaaaacctgcaagaaagaaaaatgcagattcggttaaagtgttcgaatgtttaaacagccgatataagatcaagataagtacttacagggacagcaggagttggagctgctgcatcttctacatgatgacttcctacagccgatggggtgtgttcacttgattcaggctgaacaggagttggagaatgaggaggctaaaaagaaaagtgttattaggaatcggcttatatgaataaaaaggaaatgagaaaatataagttaccgatggaggcagtattggtttctttctggcagccgatttcttcttctgcagagacaagtgttatgatgaaattgggatatgaaattcttgcaagcatcaagttttgattagaatacttaccctgggatgccgagctagttgaggtggtgccggaggaattctttgtggagctggggtatcggcaggaggtgtttgttctctagtgtcactgacttcggcagcagctgcatcaatgtcttcttccatggcttcatcatccagaaatttgtcgacatctggatcaacagttggtagatcatcggttgctaaagttttttgcttatttgttttcttcttcttggtagccgatggatctacaaccgatggcttggttcttttcttctttccggtatccattgggataggctctctcatctgtccttgaagcaaacttgttgtcttggggggcatggaagccgatgacaggaggagccagtccaccaccattaggaagaaggcctgcagcataattgatctccaaaccactttcactatgatgaggaggtgaagattctgtggtctgcaatcaaagaaataaattggataaatttttatatcagcagatagttaaggaaattgataaaagtagaaattcttacttgagggataacatcagggaatatgttagtgagatacatggaaaccgattgatgaaataaatgtttcttccattcaacccaccatcggtcaaatgttgtgctcctgagcaaagctagctcaatattatcaatacttccaaggggaggtccttggatgcttagcagccgatccatcattaatgccaatgtaatttcccctctatgctggatcttgtcggcaaaatacaaaccaattggcagctgtcccaatccaagttgtctggcagcactcatggggtgatagaattcgtaagaaacttggatgtttctaccctgatgtatgccaactgagagtatgcaagggctgatagcagtagtgaaaacttctctagacttatcaaacttctcagaattaatgtcatcaaatctgaagtccgagggaagttcaaagctatcagaatcggcatatgcaaaccaaactattgaatccctggggaacccattgtagaagcttgcaaaccaatctctgaaaggatcggctgacagtttggatccagcattagttgatgctgcctctccaaaagacatgcatcggcatgtggttatttcttccctatcttcatcggtgattggttcgaatcttgggaaatctgcttctgtcagggctggtctatcgacaactttcatagtatgcaaattcaaccagatttgaagaagccaccaagggccacctatgtcgattgctgatccagaagcaattctagccgatgttgagttcagtgtttggtataaataacctaatagatattttcctaatggaaatccttttttttctactagggactcggctatgtgttgccagtttacagttgggccacagcttggaccacagaacaagtacttttctagccacatcagaaggaatgctgtgtgttctcttggagtaacagctccattccccatgtttgatgagacaaaccctgaccaaccacctatgctcctggttttgaagtcaaacttgtttttggtattcaagccgactggattaaccgatgaagtgatgtctaaaccagttatcatggttatgtctagcaaagttggggtcattggtccctgtttaaacagaaagccattcatggcattggaccagaaataagaagctgccgacatcagaggttcatccttagccatattggctgcagtcagagctagggcttgggctatcccaatttcctcccagtgagaacccttgctagccgatacccttttataccaagccggctaactcttctaagttgatggccatgacttaaaggtattttttcaaagacttaagtttggattggctagtctaaaggggatcctattggtttcggcattaatgaactcagttggatccaaattgtcgatcggaccaagaaagtactgattgggatgaactaaacttgggattgcgatctgatgagaaaggttctatagaagaaaagaggaaaaaggcagattgagcgaagaaagaactaatctactgcaagaacaagggatctagccgatggggacttacctcggggaattcagccgatggtgcagcaaaaggaccagcggaagttgacatcgtcgcgggtgaggtcgccactgcagggaagtcgcctccggatcgccaaaggggttcgagggagttgccggagagagagaagacaggtgtgatgtaagcggtgaaacgaaaagtaacggtgtgaaatttctcgggggtgacagttagtacttatagcggggccataacggtcaaaaaacggaaagccctagattttcttggagataagatttgggcaaatccgcaacattaccaaatatcgcggacttggggggcatatgttaacgatcaaatttggtaaatcaagcattggagatagagataaaaccgaagcaaaatcaaaagaaattgaatgtttcggaaacagagtgcacatcgactaaagtccgaatcagctacgatctacatcggcagagtcgagtcggacagggtagccgatgaagccgattccgacaatatgatattggagtcattgttggattgggttgatatgcctcatgaggatagccatgcatggattgagtccaaagaaggcaattgtatctattaattagattattttatgtaaattccttatgtttcaagtcggtaagagtccaccttagggacttgtttgcattttgagttgtaatagagataggtgtcgtgtccgacagggacatattatgtactttgggtataaaagtagcccaaacccatgtaattaattaacaatcagtttaataacaatctcggcgcatcgccaccctttcgttttagtttactttcgacgagttcttgctttcaagttaggctgcatcggttcgatctccgacgacaaggtaaaacttgttatgatggcttgtgttctcgggattagtgcttccatctctatgatactctagtcttgtttatataagttgttgatttatcatatattctatataatctagactaatattgttatctagcctcaaatcagctaacatctctttctagaaggtagccgatagggttagataccaacgttgaattagattatatagtttatctaccatcttgaaaggctttcatcgacttgtatagatcttatacatctccttatgcttaatgctgcatcggttgggtccgacctattaagtaatatttagaattataatatctaacttgttttatgattgctattagagatagcatcggagtttcagcctatcttacctgatttagttatcttattcattattttatgtatttgatatgctaaatctgctctttatattaagatctcactatagtaaaatatattgagcttgttgttaatctgttaagttatcttagcaatcgattgatatctgtttaatatatttcacttgcattgatatcgtagtataaagttgtatcggagtattagccgatacatgttagatctacaacatcggctatgctataaacatatataatctttatattgaagtacttttagacataagtgatttatactgtctcggcaagctgtccgatctatcccaatcacttagtttaaacatatttcgatatacatattatatattgttaatatctacagccgatcggatagatctaactttcttttgctttatatttcattgccgatctaccttacgtaccatcggctaggttataaacgagacgtcatcggccattagccgatcggctatcgtttgaggatttaacttcgttttcttgtttcttgttgattgcaggatcaaactaactggcacgcccttaaacccaaaagcaagatttaggtccagtactagagttaagcaaatctctcatgccagtgtgtgttttttgcaaatacacacttgaacaaaactaaaactctacttctactaccaacaaagtagattgtctaattttacacaaaatagagaatataaaataaggctcctttggattaaaggatttttttaaaggagttgtttaagaaattaattctacgaaaaattttctaatatggtcctttggaacaaaagaattactagctcccacagatactataaaattccttagaaataggcaagatcattggaattttagaggattcctaacatgagattcaacctcatgaaaatcttcctttgtgcctatctctattgatctcatgcgctccatctaaacgactattcatgtaattttccttttcctgtattttgccattcataagatttgaagcgctatactatgcattttttttattccctgttttgagaatcctatgttctaaaatgtgccataagagcatgctgcctatctttgcacacacaaaaatcttatcaaaataacaataaaaaaagaacaagttggcatgaaaatgggagattgaggaaatgtgcttcatgctagcttgtagaaggagcattataagaggaaggaccacagacagaaaaagataagatggtgggcatcggctaatatctgtccatgcaaatatgcaatgcatgtccagcagcatgtgcacacaaccatatcacacgggtgtgtagctgcaggccgagcctaccaccaaacaccagcagcaggcagcagcaactggggactgatcaagctaagcaagtggttgcaggctgcagtatatatcatcttcatttcttctctttcttttggccaatttgatcggacctcaccgaaattctgaaatttcgaaaattttgaacaaaatttagttgaatttgaacaaatattatcaaaattcataaaaaaatgaaaaaatgaaaaatttcggccgaagtaatatcgtatcggaggggaccgaaatgaccgaaatttcggtccgaaattttcaaccctggtcatggcacttggcacaagatcacactatgaataaactttagcaccaaaactgtcactacttttagtagctcatggcctttaactgtcaggcttaaaatacagtagtaatccagagtatgatccagagcaaaaggttaagctggccatgcgagataaaagaaataaaaagatgaccgagtaaagaaatgcctatcgttattgaacctagtagtgcagccaacggccggcattatcgagtttgaacgttcaactaatggagtaccattttccggtggttagccactttttacagctcacggaccataggcggcagtcgatcggcagtgcagccatagcatgttgtagttgtcaccacctataagaaacacatatatctgcttcaacatttagatatgctattttttcgtaaaattttctacaatacaattgtatgcaaatcaagttgcattttagaaaccttatcaatgtaaaagcgtcacttgtgattgaagggagtgattttaagctttctactcctatataaaaaaggaactagtagttacctcatgattaaacatgtgggaatccatctctcaagccgatcagacagattgtcagcgattattgtagataaatcatccctagatgcatgcatagctagttagctacatgtcaacatgtaatgagaagggtcatgatacgtgtgaagcgattggacggtagcggctacgtacctccttgtgatggattagtagcgacaagtacgcgattaaggaattaattaggcctgcaagtgcgtgtccgcacatggttgcaagttttgagagttcttgggatacgttaattattagtgaagtaattaactgatgtgatatcataattaactaatctgatcgatccacgccaaaaagctcttcgctggaggcttttaggccctccaattttgtgagttatgaggtgcatgtttagagcaagtttaataatagagccaactatgagtttataacttatattagagttaacatatacagtagattagttataaggttatctctatttttctccttctctctatctctcacctatacattaaatgtatttatcttgaagtatgtgagtgctagctcttacatgaggccaactctctctatttttcaaattctctgtcctccacataaacttataattggcttatagcatactattaaacttgctcttagcctaactaaagctgacctgcattttattttatttttgttcagttcagttcagttgtgcatgcatgcaaagagggatcctttgatggcctgatcaactgtaaaattgtttataaacatggttagtaatatagaaatgacacagatagattccatgagttggtacactagtggagcttgacagtgccgtggtgaaaaattacagaattttctgaacatttctaaaaatcaactcatagggattatatgttctacatctgaaaaaatcaaaataaaaatccaagatgtgaaaagataaatgctacatgagatagtgcttcaactcttttcagcactgatgttcttgtacttctaaaaaatcaaatcaactgtattcaatcttacaaattttacagatagtaataacattagaaaaaataatcttcttccaaaacatatcgaatgtgaccatacccattcagaagctcacgggtgtgaagctggtccatgaattgatatcatagtgtatgatcatttctgatgtggtaaaggcccccatttaacctacacactagacagacaatgatccatggatgaggtagccatgccaacctgattctcaacggtttcctcaatgacaacttggccccagcagcatcatcctgtctatttctacatgctaattaagcatgggaccggaagggaaaaaacagcaaagtgagtgattgaggattccatttgcattccagtccaggtccggccccatgaaatgaaaccaaaccaaacagtagtacaggattccaggtgtgagatgagacgagatgacatttctgaaataataagtgaccatgggctctgcgacagtcgtcagatgcggtcgttggattatgcagcagctcgatctcttcaccttgccccacaggatcgcattcgcatggcgacaccatcaaaacacttgcacatttcttcattttctcttttcatgtcacgctctacctcaagttcaagtttcaactccactccatatacagttcagtattccaaaattccaattcatcacaggggcaagctacattctcagctactcagcttggaacatagtagaaaaattcatatgaaaacagattggatctcatctctagcaaaggataaaacctaaactctgtacaactggagctagaaagtgcatgtctcctccaagaaaaaaaaatgaaatggtgtaccaaacagaacagacactcgagtccatcaagtcacgcgtgttcataacacgtagtactgttctatttaccatagctctgcaggtccattcacatgtgagcaagatagagtgataaacacacaaaagctactagacatgtgtcacagtccaaaatcaaagccaagccaaaccaagccaacatatattggcaggcaaatcaagtaatcagcggccagaaacagtgtaagttgcttacaggagagcaggcacaggctgccccagagcctcgtgccccggctgctcatcagtgtgctactgtttggagatcacaggtagcacatccctttccatggcgattaacgtataccacactgaaccagcagattgcgaccatttggcagccagccactgcttgcaaccattttgtcaaggtccagtgattcacacatcaatgtgtatcataataaagatcccaacgtgtcaccaacccagccttgaaaaaacatccagattccagacacagttgctgtcaccgacccacacaaatatcagttgctcagttccagatcataacagaagtgtaccaaaatatatgagaaaaggactctcataagatgatgccacatatacctggcaactccgaaataaagcatcaggaatagttaatcaagcttaacattcatactctacaacaatcctgaacaaaaaaacaaaaaaaaaaaaactacccatctcaaaataacacagctggtattggcagccacaaagccccatatacaggaaaatagggtctccagcatcacccaagtcagcaccatcatcagggttgcatctgaagtttcctgagctatatcagcaacatgagaatagttaccacaagactgtaaaattgtggatcatctaaccgctgcatttgtgccagaaggttgtgaactaaacttctgggcaatagcattaatgcaagacctgttcctaagttactctccattgacaaagcttttactgtcgtagtacttcttctcactggcttctttcttctcgttccgtttctgcaaaagcaaaaccacagactaaaaatgaacaaaaccacagcacatcaatggaccagaataaataaatgcaaactacaccaagtccccacaccaaacaacatgttgctgagcgtagttatagcatgaaaaaattggtcccagagaaacagacaaatatttaatgcgcatatgcaaagggcttcaagaaaacactaacacattatcacaaacatcggtttataataaatcatgtacacacatcattaatatgaagtagacaacaggcaaatcgcatttatttgactgggattatgtattttactacatgctgcatgcaccaaacagaaaaaccagactcccacctgccaatttgacgtagcaccaatataccatgttacataacatacctggtaggcttcatggttagcaactatcctccttatgatagtactagtagtgatgtctaaagggctctccagtctacggtagatgcccatagcccttggaacagcatatggatttaaatcatcctgataggtgcacaagtaacagttgttaatgatcaatgctatacatctttatattctaagaaaatgtattgagtaagtaaccttcataaagtccatattctcagcaattgtcccatgaacaaccaacgaaatattaaatgtggtaatctgcacagaaaaaggaaattagctacctccagccacactgcaaagacacataccctgataatcataagtaacagttaaagggtatgaatttcagatggtcaatttcaatgataatattgcatacaaatacataatctggttcttaacaacatatctaacggaaacttagactacatcaaattaaacttttggaaccaagccagctcctaaacttttagtttatttgactgtgacataaaattaatgctacgtgcaatcgtgcatctgcagaaaatcatggataagcacaaatccgaccatatctgttaatctgtatctaaaatcaataatagctgtgagcaaggcttttgctggcgtagcataaatatcatgttcaatctttgaactgtgcatgcatagttgtgccatgttcaatgaactattactagcagttgcatcaagcaattcctactacagtaagagagcatcatgataaagtagaacagaaaactaaccatatctttcgaaacatcccatggagcaccaatgatcacttcatcaacataacggcaagccaaaacactcaaacttctctcatggaggttcatgattgggcgatgtggtcctcttgttgaactggcaaatacggtaaacaccaagtgcccccaaaaacagaatgttatgacgacggaattgagtagagatgctatgcttcaatacaaatacaacctgactataaactaagatgcaaaactgaaaaacagtaccaagcattgtaacttggaaaaattgagacagtggaaaaaaaaaaccatcattattaccttatagtctggtctgtgtgaatacccacaagcaggaaatctccaagctctcgagcgaggcgcaatatctaagtagaagaaactataaatacacaggaagtccaaatcactatgtcttagagagatcatttcagtttgcacccttgcaataagaaaaagaaaaggaaaaggaaaaccacaggtaaaaccatacaaccaacaaatgcatagccaagttgctctacatgctgagacagacatttgacattgcgtttacctcaacatgtccagcatggaatagatcaaatgcaccatctatgtacactatccgagaatctggacctggaccctgcataggtaaagctgacagtcaacagaaagaataagtggccgtactcagcaagtagttttatctagtgaatagtatcaaatgtaaacagcttgaaataaatgataaacgactaatgcaatgattaattaatagttgagcttagcagcatgttagttcttgttggaagttcaaggatataacttatattctttactaatataacctcagaacaaatctaagttgtgaaataatccatttgtcgtcaggtcattcaactcaatgtttactagataaagaatgcaaccaaacaacaaatgtctttcaaatggcaaaagtattagtaaaatggtaacaggatcctgaaagccaaataactcgcgctctactgtttaaaggcaaaaaaaaaaaacatctatgaggcatttttatgctgtcaatgtttaattcatgccttcaaaaaatatgatatctcaaaaaaaatgacattcaaagttttacatgagcagttcagaaaatgatcctctgtgaaagaatgtaaagagctgtaccctgctatttgagaactgaactattctccgagatgtaggaagaaaatgagatatcctagttccacttccagatccactatcatcaattttctggccatgcccgtgactgaactgcctttgtagtgaagagtggttgtgactatcagaagctgatctctctctaacacaaagaagcattcttcctgtagtttatttactagaaagatgagctgggcagttagcatgaaaataaaacctattcatgaccataagcaatttattgatacagaagggaattatgtagttaattgtctggagagcttaatagcttatcagttcatcatataataataaagcaatagtttgaatgttttcctaaagtaccacttcaggacaaatcaggtgggcactgatcttgtctacaaacaattatttggttgacctagaaataattgtaatgttggaaattgctatggtattgagccaaagaaataacttgtaaagttgtagtacataacaagaaccatatattcccttgcgatggaagttttaggttaaatttcactatgagtaaaaactttaatgattaaaacagaaaagaacagaatcagtaccaacaatgtctgtcgttgacactccttcggttcttttaatctgtttaaatcgaccaacctttttggcaagagcatatgcatcagtaccatctgggagcagacaaggatcatcgccatggatgatataatctatattatactcattgaataatttattcatgaaatcctcagttatggcgtaaggtgcatctggaataacatcgtgtacccattttacagcacggaccattatcaacctgtatatcagaaaaagaaacataaaaaaatcattcaagacaaaatggttttttttgaagtggaaaatatgggtatatgataatacataatacaatcaaagaaacaaaactgcaagtctaaaagaacaaaaatgcctaaaattccatatgacatggggtcacacgtaaaattggtaacacaactaaaaatagaaagaaaaaaaaaacaatatgtgcagtaactcctaaactggaaaaccagacacaatgaaagtcagtaaacaacaaaagaaaaccagcaaaaataacaaatttatagtgttgctaaaccaccatgatgatgattaaatgaggaaaaaaaggttgcagcacctaacatctaaaatgccacacataccatgtcatatgtgagcagcttgtgattatcaacaagacaaaggaaagcaaggaatcacttagcaggtacttaaggcaaactgagcagaaccaaacctgcaagtctagtatggtttatcgttaggaattaataagttttttggatttgtttgaatgtacagaccaaaaattcattgtttagtactttcagcagagcaaacctttttttttctgagtttctccttcaggcacccaaaagaaatagagctaatctttttcgttactgctcagatattgaatccgtactcaaatgaattagagaaacataagcagctcatccaccaccaaagttatcagaaacttggtccgacgactaactacaacccacatgtcacaacatttcccttagcaatttcaagtttccagatagaattactggactagtgctcgaattaagaccgacagacacatatatgatgtgtggggggaaaacgtcgcagcttcaaaaactaatctaaggatatccttataaaagtgctccactagtaacttgtattgtgcaacagtacattgaacgcaactaaagagtcgaaactgaaacaaatcagtgtgcgatacaaattaagttatgaaatagtaaaagcagtaacatattccccatgattaggacagaatcagtgtgcagctgaaattgaaacagaagataggaagttgatgcaacagcttctcgactaaaccattaacccaagtaaaagatcgcccataaggaacaacccacaacagttacccctaagaacttgaaatgcccacagaacactgcaagatatgtagaggaaaattcactacctataggctgatttgcctaaatcattattaaagcacacaaccagtatcaggtaacagtttggtaggattacatcgtgcatcattcaagaattttttttaaaaagagaatgacaaagggtttggagtgaacctctcgtggaggggcgtgaccggcgggcccttgttggcggtgatctcgtggtcgctgacaacgccgacgatgagctcgtccccgagggcgcgcgcctggcgcagcgcgttgcagtggccgtagtgcatcatgtcgaagcagccatccatgtagacgcgcacggggcgccgtcgtccgcggcggaaccggcggcggagcgcgtcgacgggcggcagggcgggaatggcgacggggccggcgaggtggagcgcgaccacggatgcccccagcacgatcccgccgatgacgcacgccgccaccagcttggcgctgctgctccccgcccccgcctccataatgaattgggagattggacagtgcgagagagacacaacaggaaggaagagggagattggtcgtgcgcgagagggcgtgggaggagggatctagggttagggattggggcgcgtgggtggaggaggtatcgccattcgaggtgaggggagggcgcgacgcgaggagatcagggtgggagatgcgggagaagagaagcctctggttctctctcttgtctctccgagctccgcgagagagatgagggggattcgctgccacgtgggaccaatgagtcaatcagcgtggtcccacatggcggtgtgacgtggcatagcagaagaagaagttgccaggtttggcccacgcgtcagggagggagctgttgtctgtactctgtactaatccacgtatggcgtcgaaaataaaaacgacaataacaacacactaacacgacattagcatgaggatgggggtttatggattggttcagctaaccgcccgaccgaccaaatgatgttgtgctttttcgtgttgaaggatgattaattaactcgatggcaggaaattctaaccaatgtgctgtgtagctaagatcatcggatggaacttttgttgattgattaggacgttggatatgctgcccatatgctgcttcagttgcagccagcatcagatgcgagccccatacactcaggtggagcacctcaaatgtgaagatgaagctgaaaatgacatttttggtacgtgtttggttctgtttctagcttaaggccctctttatttaggcttaggtttattggcctagacttttaagtcagcttattggtttatatgatttataagccggtggatttaatgtcctaagtttagtagttgagtcatacatctacctcacataagccaaaaaagcttctccaacctagcttttggcttaatagtattagagtggcttatggtttcaaaaaagctaaacggaaaagctgcttgtttgtttaggcttagacttttcgacttataagttagcttataagcctaaacagagaggcctaaagatactactactgtctattgttgatattgaatacggagtactagcatttcttgccttcgtgatggtggtgtatgcaaaaggaaacttgatctgaatgacccaatgaaacaagtaacatagtcagcactcagcacaatgactaaggttttcctcttcttctttttttccttgttacccgggacaagtatgagtgacagtgtgacgctgacaccaattccagcaagtggtcaaagaataatagcaaaaatatctcaactatacagaaaactacgaatgaaactggaaactaatttttcaacacaaaattaataagactttggaagccagtccaatcggggcattttgtgtggttgttactgaacctctgcttcttcctcttccctcattcacaggcatagggtttcgatttcaactcatttatggggtaccaggcaaaaaaaaaatcgtgcgtttaggaagcaaggtaacagaaaagaacaaattataaaaggaagggtttttttctacaacaaactgaatttacaacatgttatttccgagtacactacacaaacaggatgtcagcaaaatacaaacaaatccctccaaactgtgattaaagcgccatctctgcttgaagtttggtcagttcagccaaatcattggctggttgagatgaagttgtaactctcgctgatggttccatgcgtgtactctgaggtggttcaggcagctcatggtcgagctcttcctcctccagatcttccagctctgcttctagttcatccttcaaaatagaaaatatgagagtcaaacatcttcggaaaattggcatcgtgtgcaattatgtattttgtgtcttggtggcatgcctatttcgagttagataataccatcttgcacacgttttaattgacgccagaggggaaagagatagatgaacagtacctcgtcgaaatcagcagaagcgccaattggtgttgcaagtgcctcctgtatctgcctcatattttctgtgtgttcatttgcctcttcaatggcattttcaatgtcatcaatactcctgtgaaagaaatgttgttatcagttgatccaagcacatgcctgatgctaactagactgttgcctcctgtatggattaactgacactcttgctgattttaactacttgctataagtttgtatctatatttaagttcataatgtgaaagacaaaaggaacaacaatacagtagaaatgtacacacatttggcatttagagcatcttatgcttctgaattcattgtattaacgattcaatttcagaaaccatgaatggagggcaatcagagacttacactgactgatgaatagctttgacagcagatgatccagagcgcaaagcatcaacggtatctgtggttgcctttgcgctctcaagcattattatctaccaaaacaaacaatttcctgtcaatttgaatttataacaaccttctggaatatcagaatgcttcaaaagtcaagattgaatatgcgcccatatatctcatcacctgatcatgaactcgcaattggaaatttgctagctgctcaatttgtgtttcatacagcttctttttctttagacactgaattgcagctgcaacaaacaggtactctctcatatagtttatagaagtgtcacaagcttgagaaatatttttctcatcattaaggaaccattaccataggtacacatgcaagattactgacccacagtttttctactctgtatcatacatgagttgatgtgcaagattactgacccacatattttctactctttatcatacatgagttgatgggtaatgtaagacatgaccaggaagcttgtatttggccataacaaaacagggtaactgctattgttctttacaggcttcttaatctcctagttgcaaagttcttcaagtattaatgcataacaaacaaacatcttcaacaagtttatgtattatatacatttacataaaaaatgtgatataagtgtaaatgtttcttaacaaacaaaaaaatttcttgaaagaaatgcttaccgcttttgttcttagcttttgtataatccttagccttttcaacttctgcagaagccttcttctgaagaaagcactctttcttctccagcatttctagagtctgcacatgcaaattgtattaaaattaggccgcagtgaatggtacatataagataaaaaaaatcagttctatttataactggagcaattatctcgttagtatcagctgaaagctccttagaatataagagatttccatcttctttagctaaactaaggctctcttcaacattatacatcatttttgttgtgatactatatgcagcaatagcaaaccgaaggcataaatattgataccacttcagcagggactaggctggaacaatagcgatcaccctaatatgaagtttgtttttccttttcataaggcaatgatttttttcctcaaacatactttactattttttttaaagttattatatgtctactgagaggtagactgaacttcatagtgataaagactaagaacaagagtacatcagaagtgtcaccatcaacaatgtagcttataagcttattatttccttgtaagttttaacaggaaagtgctttataaaattgactagaggaatcccagattcaaccaagtatattcttctagatgcagcgcaactaacagtcaagatatacaactggctagcaagtttggccatgtcaaaactgaacttaagatattgctttttcattcagtattgtcttctagagatccattttaagaacacacagaaacacagtcaatcacattcattgctgccttcaacataagatggtcagggtagcttcatgagattggtttgcctatttacttgggcaatgcatggtcatgaggttttgcttccatatatttccaaggtggtcagttgttaaaataaacccttcttttttactaaagcttttcttcggggatactaaaactaattagctatctcttcaaactgtgcagccataaactcccaaccccgtcatgctaacattagatagcttgataatagtcccacagctgataaatttctgcggagacaacacagaatacaaagtaatcgagaatagaaaaggaataaaagaaaagggatgaacaacctcatggagacgatccaaagtggggagcgcagaggaggcagcctccttcttcttgctcttaggctttgatagcagtttcttcagcatcttcttgtcacacccacctctggattcttactgtcagatgatgatggcctatgttaggaaggaagaggtggatgattaatggctaaatctgtatggtcgttccagtagggtgaaagaccaagaggagtcgaggggaaagtaaaggaaatggaggttagagtcagattcgttgagaattgtaggaagaaacagcagggatagctttaagcctttaagcatgtgaaggaagataaaagtggacctgtgcgcttacgaaaaagaaataaggacagtttcaatgagatcactgtcttgagatacttgctccatgtttgacagtttgcctatgtgtgaccactttttgttcaataggtttttatttctggaaagatactttcaatgctaaaatcaagccttgttgttacaagtataaacaattgtaattatcaacttgcttcctaaaaacactaaggtcttaaaagcatgtgttgtacactaaagactaccgcagatgaaagggaggaggtatcagtcaagataaaatatcaaattcactatgtgaaatttgtatatattttgttgaataaatttcaagcaaattactttgactgtgactattctactgccaaaagaggggtataaatacaacacaagaaacactttcaactttctgatgacagagaactgtagtaggttatgttggattaggtgtgccttgcatatcttggcaaatccctgggctccacgttcatgtggttagttgaatgtactctacaaagcttgttgtgacaacagcctgcacctctctgagactgaagtctgaacctaatactcatcccatcatttttcttacttgaaacaaattaagctcttaagacaattttgtaaataatgcgcttctctttttaggacaagtagttgatctgccattattcgtcttaacaaatgatgatgggatgatacaagatgctgttggtgtctttttaccaaagtgggggggtgaactgcagcttgataaacttcacatacaactaaaaggcaaacaaagaagtagtcttgctccatgagttatttttcttgaaaggattgaattgatgccaaatggagtaaaattccaactcctacatggctaataataggctaatagcatagaagaaaaggtcttagcgaaatctggtcagaaccatcaccgtgtacggtacagctacgaaagaacagaaacgtacatgtatgctttagaaaattcaattctccacattacataccaacgaaagctacggatccacttgctcaaggactctcaaatccccccagacgagtgcaaacctgaaaagaaacgcgtaggctcacttggtatgcgaacaaacgaacagcaaatgcagcagcagcatctctccccgaccttaagaatattgggaaaagaaggggaagaaaaactccttacccccaggcctgagcggagcataccaaccttacctaccaggctaccatcgcccgcattgacgacgccgagccgtgcggccgcaccctgcaccgcccccggaagctcaccgccgtttgtggaagtggaactcaaccctgaaagaggcaaactgcttccggtccgtgacactgccggcaacgatggtgatgccaccagacaaatcaaacggcccaaaatttccgaggaggagtaggcctttgtgggccttcttgtaagagagacccattagaactattttatatatatataatataatgaaaatatattacatctctggccttctactcatggatacacagccaacaaatctatctatctatctatctatctatctatctattatattattaaaacagccttgaaagaaggcaccacgttcgctgtggaggctagaaatttccacattaatcggagaaaaaaaaagagtccaagtagaaacacaatttaaaaataactgaaattcgaaattaaaaaataagcaatattgaaagaagagtccatataagagcccaatacgagattattcaaaattcagaataaaattaaaataaaatccaaaattagaaaagaaaaggagagtccaaataggaatacaatttagaaataactggaattcagaaataaaaacaaggaatattgagaaaaaagtccatataagaacccaatacgagattaattaatattcggaataaaataaaaataaaatccaaaattagcaaagagaaaagaaaagttcaagtaggaatacaatttaaaattaactacaatttggaattaaaaataaaaaatattgaaagaagaatccatataaaaacccaatacgagattaattaaaattcagaataaaaaataaaataatattcaaaattagaaaaactaaaagagagtttaagtaggaatacaattttgaaacaactaaaattcaaaaataaaaaaataagaatatttaaagaacattatacggtattaattaattaaaatttgaaaaaaaaataaattctaaaattagaaaaagaaaaaaagatttcagttatgaatacaatttataaataactaaatttagtgacaaaaaactattgaaagaaaataccatctaaaacacatgacgagataaattaagtaacatgtctacaaaggagtagagtgttggcggttgatacgacatataaaaactgttaataaaacaccaaatagaatcctaatgacgattaaaaggagggacgatgggcaggccatgaagcaaacaggcaaggcggttgccgggacttctagaaaataaaaaaaaaataaaccccaatgataatcatattcgatttttaaaatcttaatgacaataaaaaggagaagcagcagccgccgacggttggcgggacttctagaaaataaaaaaaaatgaattccaacgatagttatgttcgatttttagaatcctaatgataataaagactaggtggcggatgggccgtagaggagtatagtggcatcgtttgatgggacttctaaaaattataaaaaatgaaaccctacaagacagtgaactataaaaactataaggtccaatttttaaaggttcgaaacttctaaaaagtaaaaaaaaaatccaatgataataatattcgattttaaaatcttaatgacaataaagaagggagacagcgggcgagccataaaagagtacaatggtaaagccgctgacggtttggcgggacttctagaaagtaaaaaatgaacccgaatgataattatgttcgatttttaaaatttcaatgacaataaagagaaaagacagtggacgggccgtagaggagtataatggcggcgtttgatgagacttttaggaattataaaaacgaaacccaatgagacaataaactctaaaaactataagatccaatttttaaaaggttccaaggagaataaatgataatagtagatcgagcaagcaaataaaaaaggatatgacataagtaagggtagtaactggtgtgacttttcaaaaactatttaattagaaattcggggatgagaagatttgttctttcaaagtcttaagacaataagatagctatttaaataattttaagtaaaatcatacgaaaaaatatatgattttgtttgggtgctagtcgcgcaattacgcgggccacccagctagtttcagtagaaagaaagaaaacacatccaacaagtttcagaagttaaaaaaaaagaattaaaaaagatgtgatgggacaaacccccaacttccactaataaaagtatcaactgaaataacgttttcaaaatcacatagattctagcataaaatttcgtaggtactacaccatccaaactggaataaaagctccgtggctaccaattccaagagtgcaacaccagtacgcatagcatcatgttgttcctgtgaaagcatcatacaccaagagtgaagtcgattggaacacataaagataacctacataatggtagataatttcttatggttaaaaattatcgttacgacaacgtcagattgaccaacatagcgcactagttccaaataaaatcattattttgtggccctaggcactccccttaggttgtgttcttttgaaggggttggtaacctccatacataaaacggagtgatagattaacacatgattaattaagtattaactataaagaacttgaaaatgtattaatatgaatttttaaagcaactttcatatagaaagtttttgcaaaaaattgtattgtttaatattttgaaaaacgtgcacgtggaaaatgagggatgtgagtaagaaacttacgggaaagaacacaaccgtagccaattacccaaaatattttttgcgttgcggggagagggatattaaaggcaaaggatacatcgccaagcaaaacatgcaacatgacagtaaaaaaaagatgttggagtaaaaaataaacaacattacttgttcccctccattttctctatgtgagattatctttcgttaagattattttttgtgaagcaacaacgtaaacactttgatttttagtggtaccttgtacctcccattgtggtcctttgataggcatgcaacccatctaaacctctacatgcagaaatccaaaaatagcacactcctctttcccttccctcacatcgaacgagtgatcgatggtgtatcttatcactcctcccctcacctcaccttacctgagaacaccacccattgccggagttgataccaaacaaggaattcatcaatggcaacgcatacggtgacggatccactagaggagctatggaatcacacaatgtcgatggacaagacgcacctgatgtgcttctacccgagcaagatcaccatgggtggcgtctggacgggcgacaacccgctcgacttctccatacctctcctcctcttccagatcctcctcatcacctccaccacccgcgccgccaccctcctcctctcccctctccgcctccccacctacatctcccagatcctcgctagcttcctccttggcccctccatccttggccacctccctcacttctccaacctcgtcttccctgtccgtagcctcttcgtccttgagtccatggccctcctcggcctcgtctactacaccttcatcgtcggcgtcgagatcgaggtctccgccatcacccgtgccggcatccatagcttcggcttcgctgtcggctgcgcgctcccgcccttcctcgtcggcgccctcaccggctacgtcgcgctcagcactgacgacaaacgcaagggtgacactttcctgaacaagctctccttccccatcttcctcggctccaccttctcctccaccgccttctccgtcctcgcccgcaacatcgccgagctcaagctcgccggcaccgacgtcggccagctcacgctctccgcatcactcatcaacgacaccttcgcctggaccggcctcaccgtcgccacggtgctcggccactcgcgctgcaccatcacgcagaccacgtggacgctcacgtcgggcgtcgtcatcttcggcgccagctacctcctgctccgccccatgctcctgcggctggcgaggcgcgccgccgagggggaggcggtcggcgaggaccgcgagtgctggattctgatcggcgtcatggttgcggcgctggtggcggacgcagggggcacgcacgccatattcggcgccttcgtgttcggcctcgccgtgcccaacgggccggtcggggtggcgctggtggagaaggtggaggacttcgtggtgggtgctctgctcccgctcttcttcgccctcagcggcctccgcaccgacaccgccaagatcaccaacatgcattctgccgtgctgctcatggtcgctgccatggtcgctgcggtcttgaaggtcgccgccgcaatcggcgtcgccggtgtgtttggcatgccactcagtgacggcacgtccatcgggctgctgctcaacaccaaggggatcatcgagctcgtcatcctcaacattgcaaggaacaaaggggtaatccattttaattaatcgatcgccatgcagtgcattgcatgtcgtgattaattaagggtaggtagcttcttgtgttgtgtagatcatgagtgaccagtcgttcacggtgctggtgttcgtgtcggcgctgatcacggcgatggtgagccctttcctggggatggtggtgaagccggcgcggcgcctcgtgttctacaagcggcgcacggtcgcgtgggctcacccggaatcagagctccgcgtgctggcctgcgtccacgtgccgcgcgacgtgcccgcgctactgacgctcctcgatgtggtgacgccgtcgagccggtcgcccgtgggcgtcctcgccctccacctcatcgagttcgtcggccgctcctcggcgctcctcctcatcaatgcctctgcgccgtcgtcgtcctcctacgacgcctccgtccacgggcgcagccacacggagatgcagttcaagcacatctcccacgccttcatggcgtacgaggagcagtcggtgggcgtgtcggcgcgcaccatggccgccgtctcgccgtacgagtccatgcacgaggacatcacctccgccgcggagaaccagcactcggcgctcatcctgctcccgttccacaagtaccggtcggtggacggcggcctggaggtgtcccacccggcgatacagccgctcaactgcaacgtgcagagcttctcgccgtgcacggtgggcatcctcgtggaccgtggcctcgccgcggtgccgggtggcgggtaccgcgtggtggcgctcttcttcggcgggagcgacgaccgggaggtggcggcgcttgcgacgcgcatggtgaggaacccgaccatcgacctgacattgctccggttcgtccagaagggaggaagcttcactgcaagcgagttcgacgcgctgaaagagcggaaggccgacgaggggtgcctgcgtgacttcctagagagggcgaacgagggcggcggcgcgacggtggagtacagggagcgcggcgtgttcaacgcgagcgagatggtgggggagatacagagcgtggaggccatggggaacaaggacctgttcgtcgtcgggaaggtgcccggggggtccgggctgacggcggggatggcggagtggagcgagtcgccggagctggggccgatcggcgacctgctggcgtccaaggacttccagacgacggcgtcggtgctggtgctgcaggcgtacgggaggccggtggcagtggtgggagctggagcgggagccatgtcggtggattttggcggcgacagcgtggcgatggcggagaggacagccagtgggcgtaggccatgggcacgaccgggtgtatgatcatcgatcatcggagaatttttctttctagaattggtgaccgttgagatagatgtaggaatagctgataatatggtgtggataattgcatattatggtataaaatttatacatagtgcaaagcttaaacatagttcttggaaaaataaagctaaataaccatatactagcatgttgttaatcaagcagtcatcactgcggtgcaacattttgttatttagagggcctgaggatgagaacaacgcagggaggtttggaaatatcagaagaaactcaggatcagtttcactttcaaaaatatttgtaaagtactacagtagtacgaaaatgacatttcacgtgtataatggtatgcacagcatatcgtaggcctactaatttcaggcccaataaaattggagttcaaaacaaaaaggaacagtggcagatatgggtccagatacgcactgggcttaactcaaattcttcagaataagtttacttttactcccttcactaatggctgaatctgtttcgcatataccgggcccccaactattaaaaccggtgcattttatctcccttggtggttttagagagcggtttcgctgacgtggcacctacttgacggtattgaccgggtcttcattccacgtggcgttgatgtgacgcttatgtggcattaaaatcaaaaaagaatgtgcatgacttatttgccattcacaaaaataatattgtggtacccactgacatgtagggcccacatgtcatcttctctcattcccttcttcctcctccccctctctcttatctctctctcccccggcctttctcttcacctggccagagcggcggtggggatggcggtgagttgtggcggcaatggtggtggggacggcagccgccgcgggtgggggaagagagagcttgcctctgcggccgccacacggacgacgtgggcagagtcgtggctgcgacatgccttgaggggggagcacacggggatggagcggaggtagagcgagtgtccactcgagcgagcggcgccatgcacgcagctgagggggaggaggcggcggtggcaatggtggtggggacggcagccgccgcgggtgggggaagagagagcttgcctctgcggccgccacacggacgacgtgggcagagtcgtggctgcgacatgccttgaggggggagcacacggggatggagcggaggtagagcgagtgtccactcgagcgagcggcgccgtgcacgcagctgagggggaggaggcggcggtgtagcggcgcgagggcatagggggagcacgcagccagcctgcacaccatggcggcgacaaccgctgatccagctgtagaagaagggcggtgggaggcgcggctccacccaatgcggacgtggcgcgcggtaggagatgcgggcggtgacactgaggaggacgttgtcagggaggtccccccaccttacccaatccatggcggccaccatcggatgccgccgtcttcgctccctgccacacccgctctccgcttgcccccgccgcccttcctctatccccgacatgctgctccccccaaccggtggcaaccacccaaagctccccactgccgtccccaccatcggatgccgctcctgaggtttcgaaagcataactggtaaaaacagttgtttggccacccacggaaaataaaaatataaacttgaaaaggagtttcgaaataagctaacaatcagacaatgagaggagcatgcatctcaagaatatcatctctaagtactagagcgacacgtttgtctttttgaaggaaaatctgagaggtcgtatatattcattccaggtcggtcggtccactaatcagaccagcatcatcaccagcttgtactttgctatacatgcgaatgaaaggaaccagtcaggtgtggcaacctttatattcgtgactggatatcatgagatatgatgcttcatcgatcgatcgacggcaggttccagatcgaaaagaagaagcagcaaatgcatgtgttccttttttttaaaaaaaaatcgattttatggggggtataaattaccggtacccaaaaaatatcacaacaaatttctgaaccttatatagcaggtggcttacaaggttaattatatggttagcttaattgcatgggttggtacatatatatttcttgctggactctatgcccagagcttaatctaatggttacgattaattaatatacacacgcatatatagacttattaagaacattttactatgcattatatattttttaaatagacgggttgtatacaagcctctcatagtagctagtgctaattaactagttggtatgtactgcgaaatagcttggttggataccaaatttagtcctacgaatcatttgataactttaatatagcacggtacatatttggattaaggtcaacctttgccccaagtcaataataattttagtagtgccataacatatctaagattttgcactactaaaattttacgagggcactaacccaaacaggcactaacattatttacaatgacatggaggatacatatatgtatagctattgctagctactaacaattagtactagtaattcctaaatattataatatttatacattggaaaggtagttgtcctaaaagtcatatttaagactaattaattgtccaatccccaactgatcaattaatctatgatgcacaagagtagctactagctagctagatcgttcttggcaggaagagtttacatgggtggagacatgaagcacgcagtgtcacatggtggcaggcaggtacaagtactatggtacacagagcgcaagacgatcgatattattccaaagggcaaagcaagtatacaaggggaaagctgcagaggagagctcataccaaggtggtgtggactagcaacggacaaggggaacacgatgcatgtacgccaagcgtcgctggcatgcgactcacatcagatcagtggatcgagaattaactacccatctactgctgcctgcctgcctaaccagcaacaacataaccctctcgtgaccatctcatatacagtaaatccattaacatacacacaggcatatgcgttcatggttaaacatggtatatataagaaaccacatgtatttaatttgtaatgtttaatacttaattaatactgtgttgtgtgccaatacccccgagcaattggtgcaagcacgctctaaattctagccctcttgtagcggcgtcctagtttctacaagttggccacgtcggagtgtctaggggagaggtgtttcatcttctctctcaccttctctccctaaatcgtgaagtcttggatagagttgggttttgtgttgattgtataggtcgggttttgggtgatctcggcagtgttctgttgttggtctagcggcggtcgatcacgcttagcagcggccggtccggtgctagccttctcctggatctgtgtgttgacgctgtcgctgtgtgggtggtggtataattttttttcctggttatgaccttataaaggattgtaatcttgtaattttttcctgctctatcaataaaacttcgcaccgtttagtgcgagtcgttcaaaagaaaaagtcattgaagtataatctcggttactattttatactattgagaataagtttacaaaacctaataagtttattatgagatctcaaacgtacttaagatcggatgaattgtatatttaattgtttatacaagaacaacaaatacaattaataatatatgggcaccatatcgatctagcttggctatcctgggtagtcgatatgtgtcataagggcaagcacgtggcaccactcaccctttttagccgactgtgcagtttaggtgtgattataagttactccctccgtttctaaatatttaataccgttgatttttttagcacatatttaaccgttcgtcttatttaaaaactttggtgaaatatgtaaaactatatgtatatataaaagtatatttaataatgaatcaaatgatagaaaaataattaataattacttaaatttttttgaataagatgaacggttaaacatatttaaaaaaatcaacaacgtcaaatatttagaaacggagggagtataaatatctattttcgtagcagcgagattactagttccagtatttcactaagtggagatagataatattttttaagaacagaagaggtagggatgggtcgaaataaataggggcatttgaaaatttataattggtatttttaattttgtaacaatttaactcgaatggatgacaattctagcggtattttttaattttctatgatattttcgtaataacgatttaaacgagtggtaaatttataattgtccaaaataaataataaagtgatcatgatggtgccaatgatcaatctcgagtcaggccagggctaggacgactggaggatgtaagctatagggttgaggtgacgctctgttggggcgtgaatgaccgatacacctgtagtatgtatatatgcgtgcgtgtgtcacagcttgcacagtagcagtgtcgcgcgactgccactgcacgctctggatggacttggttctgaccggccggttgatcgattgggtgcatatttactatgcattggtcattgcacgatggccagtctacagtacgataactgatcgatgtaagaagccaggcacacgcatgcacgtctgtgtgttactactgtacaagtgtagatggctatgtcaaagaatattgccacgtccatatataagcctagctacgtacctagctatatgcacgcctacctaattcgttataattgtgtagtaattccacatttatttatcctgtgaactatgtaataattgattatatttttttaagtaaatgtcaaataattgattttcattttccaaaaagaaaaatatggattatgactatgaactccaacatgcctatccaccactacctgcatgtgtttcgacagtcaggatttatgcacgcctgccggaacaggatttatgcactacgtacacagtagagtgactcatgagctgttaatttgctccaattaacaagcaaattgctagcaaaattagctaaattcgtgccgaagagttgtgttgtacttaattgttactggtgtatcacgggacatgcatgaaacgccagaagttacactatagcaaacagcactcccgatgttagtttccttcaagaaatgaaacattatatcgatcgatccatccatcgaaaattcgaaatgatggatatgcaaagtgtggtcgcaggtacatgcacgtgatagttaagttgtagtatacatatatatagtccatatatagtttgaacttttactgcttgtcgcccgaaataatcggcattctgtcgacgaccagcgccctgcagggcggtgcacgctattcagatcgacattatatatataatatattcatgtcattttctcacgaccctgccagtaattaacgtccgttgatccacggcctcttatcgattcagctataattaaacttcactgtcgatcatatacttattcaatccagtatagtagcagcacatatgcatcattctcaatcgatcaattagccattaattgtcctaagcatgcagtagatagatatatatcgatccagatatgaatgatatgtggaaattttgtagtaataagaaacggcgtatatttattttttttcaaacggtcagaccgttgccggcgttttatataaaaaaagaagttgttttattttgaggagaaaacgcgtgaccaaaccttacagtgcatagttaattaaggaaaactataagaaaaccacaactactagaccaaattaatagaaaatgacaaatctaaactacaaggctacgaaaaacagaaaaagccaggttcaaccaacgctattcaccataagccttgcaaaatagtagcgagctggaagatcaagcaaggctccctacacgggcaaacgttgtcaatactacaacgttttgaattcattttttaatttgtttttagaaagttttcagtcgattctagttttcatcggatagtagccttaccgtattcgtttccattctagaaaaaatctgaatttatttctgtttccaaaatttccaaaaaaaaaaattctaaccgatattttccatttctaaaaacatgtgtctgaaatcagaaattttctgaaccatttttaaccctaccctaagctagttaagtaaaaaaaagacgagatttggagggacagatgtccctcccgacacttcttttaataaaaaattatgagtgttttgggaattgaagacggaagcttaaggttaaaaccacacggctagttaagtctagctgcttgtattgcatgcatgcatcaaaacttacgacttacgagagctaaacaacaaagtaaaatgcatgggggatattgttaatcacatgtcgcaaacgtgcaggagatgacgaaggtccatgcatgcatgcccggccagctgctgcatactccctccgtccaaaaaataaacaaacccttatttccgtgtctctaacaacaatgaaaatataaattataaaaaaatttcatataagacggacaattaaaattggacacgaaaatccagagtttgtcttcttttttttttacggatggagtattagctattcgctaattgatcaaaattaattattaaatatatatccgcaccgcacatcgatcgatctggtgtacgtctgctacatctgcatgtgctagcagcattatttgttgatgtatgcaagcgtcgcattcgtatcacaaatttcgcatggaatcttgaattcttgatgcattatactccctccgttttaaaatgtttgatgccgttgaccttttatcatatatttgatcgttcatcttattcacaaaatttaagtaattattaattcttttcctatcatttgattcattgttaaatatatttttatgtagacatataattttacatatctcacaaaagtttttgaataagacgaacggtcaaacatgtgttaaaaagccaacggtgtcaaaacatttcgaaacggagggagtatattgttgcttgtcaagcatatatgcatgcattgatatgcataccctccgatatggatactctcgtgatcaagtcgtttgtttcgtagcaactagcaactccagtttgtatgtttggtctgatatatatgatcgtacatgtatgctgattgctggatctgatcccatttgcccctttcaagccttttccatgtactgtaccagtactgtacccccagcctggctgtttccaccccttgatcgtttcctatccacaattccacacaccaatcgcctggcttgaatattatgcattttcatcgactctggttgctgctcccccaaaactagttactagctactcctatatactctctcatgtttttacttaagctttgtatttgattgctatacatataccttttccgctggtgtttcccccttgtttggttggtgccatgttctagcaaagctttttgatgaatttgtttaaaaaatatgctacataccttttccaattatgttataatgaaacataaaaatgcaatgatctaaaaataatagttccaatgataaatcttctaatatcattttcatgtgatgaagatttagttttactgtatgtaaaatgtccacgcatgttttaattaaaaaaatacgggaaacgagaaaaaattattagcatatgattaattaagtattaattattataaatttaaaaaataaatttatatggttttttaaaacagcttctctatagaaaatttttataataaacatatcatttaataaattaaaaaacatgttaacagaaaacgagaaaattgaagttcatattcagctatagtaatccacagtagcgcatctcatagacgtccaccccgtcgtggcccttttcctctccggcctcttaatctcccactcccttcatctcttaatatgaacttcaccttgaactgattctgtcgctaggctatccacctctctcccctccttccctactccctattcttatatgaaaaagacattacccccatccttttcaacgtacgtaaaaaagttacctataattaaaattatatatagtaaatattaaatattttctttgatgattgttataagtggcaagtaaaaaaaaaccttttttttaagaacagagttcctgatgctaaggccatgtacaacgcgtgaccctagcttgtggtctcaaacctctacgtcggatgcgcgcacccatggcagtggggaccgtggctctgcaagccgatcccgcgcttgcagaagaaccgcccgaagcgccgcgcctgggctcgggaagggcgaagccacggtccaaggccacgcgttggcggagccggagccccgtgcgtcgcctcgaccaatccccagatccgccgccaccgctactcttcaccgccgacggtcacgaagaaggaaggaggagaggaaccgctgccgttatggcccctgctgccagatccggcgagcccgcgcccggatctggcaagctcgtccgcgccgtcgtggggggaggaggacggtggcgtcgagccatccgccgccaccgctgctcaacgctgccgccagatccaccaccaccgctactcaacgccacctccagatccgccgccgctgccgctccctgccaccaccaaagctcgagcgccgctgatggggagctcgcggcggagaggggagaggagaagccgtctcgcggcagagaggggaggggagaagccgtctcgcaccggagaggggaggggagaagctggcgagctccgccggagaggggagggatctcgccggcggggtggagtaggcatcggtggaggtggagaaggggattggaggagcgggtcggtcgcgtgtgagaagggcaacgggagagagaagggggagagtaaaaaagaaatagggtggaagaggggtggaagaggctgacagtgggttcttatggttttttggggtgcatatgtatttcttttggttgttatagggtctaaaatataaagttttaataggtttgataataacatacaacacaagggctaacatataaatagataggagctgaaatgcaaaatatgttttggagtgattaccactgtgggttgtgtgacctttatgtggttctatcctacgtggtatcttaagaccactgttacttatggcttgtattgtacatgccctaaggagtcgggaggactcaggacagaggagtccctattggattttgttactataggagtggtatatccgaagctttttagatcgagtcaaacgctcacctaaaaggctactgactacatccttttcctttagagaaaaaaggctactaactctcacaactgtgaattgggaatgccatcgtagcatcgtagcattgaccagctaagcaattaagtaatgttttgaacagattgaaaccattttctccctaaaaagcctagtgtttttccagacccttctccagcatttgtgttctatttaacaaccaatttcaatggttatccacaaaaatatagtctaacacgtagagaataaaaatttacgctgtaatttgatgccagcgatacacatttgccttttgttttttttttaaaaaaggatatatgttcttaatttccaccacttcgattattccatgatttcgtcagttttgttctcgagatggctagaaaggtaaaagctgatttactagtactacactttccaatccggagtgatggctactgctacgactatcagtgtcatggttgacctaccttgctatgatcctctgaagatatagaagtactccgttatactgctgctactttaattagtacttcttctgtttcattaaaaaaacgaatatacgattgaacgtgacatattcgagtacaataaattttagatagagatatatataaagatctgtttagttggtgaaataaaaatttttaggtgtcacatcggacgtttgaccggatgtcgaaaggggtattcggacacgaatgaaaatactaatttcataacttgcctgtacaccgcgagacgaatcttttgagcctaattaagctgtcattaacacgtgtaggttactgtagcactaatgactaattatgaaatacttaaactcaaaagattcatctcgcgatttatatgcaaattgtgcaattagtttttcttttttatctatatttaatgctccatacatatgtctaaagattcgatgtgatgtttttatgaaaagtttttagaactaaataggatcttgtcggtgacatgggatcaggagtatcatgactagaggtttgaggcagacacaaacacccacgtggcctggcaccctcgggggacgtcgggcccgagggtgatgtgttcgccctcctcttagtccccccggaggggtcgg

SEQ ID NO: 40714 - DNA, 4031 bp, Oryza sativa
cacctaaccacatttattgcggtttggctgagcgtgtcacgccgcatgtaacgcagtgcagtgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctgatcagatatatgccaggctttatcctaaccattacaagcaagatattgtgtgaagaagggcgaacatgtagattgctaagctgacatgtggtggacaagaatgaccgacgtgactggtctgactccggtcatgtcgtcagcaggcggccacgattccacgtcgcatctgctcccggcgaaagtggaggtagttgtgggccgtcccatcagaaggtgactcggacgacaacgatacaaatctccgtccatttatgaaaaggtgggggaagtccccacaaaaaagagggaaatggtgcatgtggtatccccttaagatataaaaggaggaccttgcccacttagatgggaggtttttttggactggacttttccagattaggaacccagaacaagggagaggctggctcatactttgtagctccttcacacacgaatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccgatgaggagccccacgctccgtcatctggcgcgccaggtaggggactctgcgagtgatcttctgagctctcgcactccttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggctgaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcctgtcgcccatgacccggagtctccagcccaacgttggctggacgatgtggccaaattggtcatgactgcaaggcagcgcctagatgctggtgggcggtcctccgccaccaaggcctctggtgctgctaccaccggctccgcgttgtcaagacgaagggcgcggcgagcggcagctgccgttcgccattcggccaccactccttcgtcgactccttcgacccgggaagatctgcgtggggggccggacgcccgcaccagcatcgagcggcggcgtaatgaccaacgtgctacccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcatctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgtaacaccataccatgcatccctgcacacgcggtgatttacgcgtttagggggggtgtgcggcacaaccgcatgctcgaaaagatcgcctccaaagagccccaggctaccgcggagctttttcagctcgcggaccgagtggctcgtaaggaggaggcatggacctggaacccctccggttccggtgtggcagcttcggccgcccccggatccgccgctcagacagggcggcatgataggaggaggaagaagaggtcagcccataccgacgacgagggtcatgtcctcgccgtcgagggcgctccgcgggccacccgaaaggggaggcctgcgggagacaaaaagaaggaggccggcgctcccagcagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttatcgccggagcctcaaggccatgaagcgagagcttctggccgcggcccctactcatgaggcgacgcgccaggcgcggtggtcggaggttgccctcactttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatgatgctccggccgtcccagccgatcattggtgtgacgccggggcacacttggccgctaggtcatatcgacctcccggtcaccttcggtggacccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaagaaggttgccctgggcgacggcccgtccaaggccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcgaggccggtccggcagaaagtgcggcgccaggcctcggaacgtcaagccttcatccgcgaggaggtggcacgacttctggaggccggattcatccgcgaggtcatccatctggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaacactgcgttcattacccccataggaacttattgttatacaacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcgaaaacttttgagagc

SEQ ID NO: 40715 - DNA, 2206 bp, Oryza sativa
caacacacgtctgcgccgcacactgcgcgtccgtctaccgcgtccgcgcggcgcggccttctccatctccaggtgagggaagaggaaggggaggggaaggaaggaggaatgggaggatctgtgtaagatctatctccaggtgagggaggaggaaggggaggggaaggagaaaggggaggatctgtgtaagataggagaggggggaggaggagaagagggaaggatcgatctgtgggtgaggaagtggttgcgaattttactcccacttccggttggtactagcaactaggatgtagactaaagtggtaatctttagtcccggttggtattatgaaccgggactaaatatcatcggccccctgacaggggataaaccgggactaaaaattatctttagggcctaaagatcaaaacttttttaaccgggtcccgattttaaatggaaccgagactttttttaaccgggactaaaaaatcgtttttagtcccggttttaaatagaaccgagactattgtggaatttggtcgaccgatcaaagatggtttctccaccagtaagtgtatctagattttttataacttctatctatctaaattaaacggttgagatgattgttagtaaagatttagtaagaaaaaaatagtatgtgtagcagtgttcatatctaaaagactaaatccataactaccaggaacaagctacgcgaggatcgacgatgggggatcccatccagatccggcggcgccaccgatcaactcctcgaagaaattgacctcgtcgccgtcctccatctggagctccgccggcgtctgccagccgcgcagccggcggccgtcgaacagaaaccggcccgtgccgcgctgcacccggccatgcgagcggtcgtagtagaagtccatcagtccctgcagctcctccgtccgcagcatggtgcggtagacggcgcggccgtcggtgccctgcaccttcagcgtgacgtattccccggccaccctggtcgccggcgccttccattcccaagtcgccggcgtcttccattcgttctccttctccaccttcaccgccgctgggatgccagaccagccgtacatcgcctccggtgttttagctatctgcgtaggtgtacttgcgtagctatctgagtagttgcgttgccatggatttcaccctacgtactcttatgtagtatattgttaagttctaactagagatagtactccattagctaggataggattgatttgtatctcgaagttatccttatctttatccttgtaatttgctatatatataccgagttaccaactcctgaggactcaatacaacgtgatccatattcataatatttctcttcctttgctgttcaatcagcatatatgaatatatgatgccaatgtaagagcatgattttaattaactggcgatatgcgtaatctcagaactgaaccttgatgttgccgcagtaattgcacggtgatatcatcgaaggggtttcctataggctatggcggatcagcggatgcattgcatggcaattgagtggattaaatgacgctagtgacttgccaagatcaactactgttgccataattaatcatcccagaacaactgattcaatgttaacatcgattgctgctgccatgaggaaataaaacactgcaaattgcaaactacgacgatcggcaaatcgcagaggatgaacaattctaactacgagtctacgacgctcggcggcgacagtcgtagactactagtgagaactgggaagaagattgcattggaaaaatcctccgccgccgatcataaccgggaagaaatcgacagtgtccccgtccaccatctcgagccccatcggcgtcatgtcgcccttcagccgtatgccgtcgaagaggaaggtccccgtgccgtaggtgacatcgggcgccttggcgtagtacatgtccatgaccacctgcagcttgtcggccatcctgatggtgtggcggatcctccggtcttcctggtccatcaccttgagcgtgatgaagatcggcttcaccgtctccttcgcgtcctcctccgccctcggcgaggtcgtcgacatggccggtgagtttgtggggaatcgtgggtgtgtgtgtggatgtgggcggtgtgccgtcgccctgcttggctgcttatataccaactccctccgttcgtggataaacacgcagggggatccac

SEQ ID NO: 40716 - DNA, 4147 bp, Oryza sativa
ccgcgcataccgtcgcgctttgcacggcgcatgggcccatggccccgcccgcccgttgcgctgccgaaacagcacgccgctggccccgtccgcccgtcgcaccaacctttttttttttcaaacgcgcaggcaaaagctttccacgttggtactcccctagtactagtattagtactccctccgttttaaaagattatactataaatcgttttgtcttcagccaacatcaaactgatttaaagtacgactgagtttataagaaaaaatagtaatatttttaacccattactatattatgaaaatatatttaactatagattaataaaactaatttgatgtcgtaaatattaccacatttatctaaaaactttttttaacttaaagtagtttgactttgaccaaaataaaaatgacttataatacaaaatggaagatgtagaaaaaaaaagttcatttgcaactcgcctagatgatcactagggaatatacttatatacaggtaacaaagccatacaaagttgttacagacaatagaaacttcaaggtgagcagtgaaaaggactagatggtgattcagatcctctaccttcaaatgcaccatgcttttgtcactgacaagtgggcccatggtttattgggtccacatgtaagtgacaaaggcacgtacctttgaagatagaggatcctgagcctcgcttccatccaatgctacccctcctgggtaatccgatcaatcacttgcaacgccaaccccgtatcatagctcatggatgaatatcggtttcattttaattgagcacgtgtaaatgcacaatgttatttgagaattcgaagttctgaatatgaagtcgtgggtcacaattcctgacttttctttcattgagatctgaagctaagcactagttcagtacataatccggttaacgaacagctcctgaatgtaagtttaacatactgaaattcaagtgcctgaagttaagtcctcaaggtttgagtattgccctaagtacggaaactacaatgacagcagttgcattgactgtaggagtactctagtcaaactttttaacttctgtcaagtgcctgaagttaagttatcaagatacgaacggtgaaaacggtatggaaattttccgaccataccgataccgtttccgcaaaactaatataataataatacttttacgatggttactgtttctaaatttagttttttttaaatttctgttagcgtggcattgaagttgacacttaataaatgaatttataaatatggaaattttccaaccatttccgttcgtttttgaaaaaacaataaaataatgatattgtttccgatcatttccgaccgttttcatccctagatatgatgttgttgtccatgtgaattttggcaatgtcctgaaatctgatattgccttctgaaaactgaaattcttaatttattttttaaactcaagtgcaaatggtttttagaactcagttctgatttaagttctgaaatcagtcttagtatattgtcaaaaacaatttttcgagctttagcactagtgcttgttctgaatttttgaactttaattctgaaatttgaaaatgcggtagtgcttgttccaaaatctcaaatctgaagttgtacttgtgtttgttctgaaaaattgaactttagttctctgataatatagtagtgcttgttctgaaatctaaaatctgaagttgtacttgtttgttttgaaattttaaactttagttctgaaatctaaaaatgcagtagtgcttgttctgaaatctcaaatctgaagttgtacttgtgtttgttctacaatttgataatacagtagtagggcttgttctgaaatccaaaatctgaagttgtacttgtgtttgttctgaaattttaaactttagctttgaaatacgaaaatgtagtaatacttgttccgaaatctaaaatcttaagttgtaattgtgtttgctctgaaatgttaaactttagcttttaagtctgaaaaatatagtagtgcttgttctgaaatctaaaacctgaagttatacttgtgtttgttctgaaatctgaaaatgtagtagtgcactactagtgcttagctcttgaacagcacagtaccgagaagcttgtagcctgtgggccgggtcgagtgagtcgtgcattcgtgtcgtggcttggctgacccgcagctgcttgacccggagcagcatgcacgctgtgaagagacacgaatgtccactccctttgcccatggacgaggcagcagctgaacacaagatggaatcttgaccactgttcgcgctggcacttggcaaatcccccctgaacccaattccctgtcggttttctcccacagccagtgaaaccaacagcatcgacgcctctatggaaccaagagccttgcaacctttctcttccttttggtcatttccataaagtaaaacgcattaccgcacaaatacacaatctcactgcgaccatcacggatacacgcagtgctcagttcagtatagctcacgcatttagttgcctcaccaaaagcgtccaaaattccttgtgcccccgatggagaaaaagcagccaagccttgttcgctttcgcttcgcctcatctgcttgttcctctcctcgtgtcgtgtgatcgtgcccacactctcctcactgccactgcacacgccgctctcctctctagctttcctttttggagctctcttcttgtcaccacttccacccgtgttgcctttcaaaaatctctttactttccccgcgcatttcttcttctccttctcctcctcacctctgctataaaaactcactcactcgaatactggatcaatcaaccactgctctctctcaaacagcagctgccaacgatggcagattcccaccattgctgctggttcttgctgctgctcctgctcctcgccgcgtggtgcgtgcgcggagaggccgaggtcgccaatggcggccaccaggatctccctccgctcctctccttcaaatcctacaacccagccgccgccgcgctggagagctgggtcggcggcgacccgtgctccggcgcatggatcggggtgaggtgcagcaggggcagggtggtcggggtgttcctcgacaacgcctcgctcgtcggcggcttggcccccctcctcgggctcgcccgcctcggcgtgctcgccgtcaggaggaactcgctgtccggtcgtctccctcctctcgacaactccaccagcccgaggctgaggcacctgctcgtctcacacaaccagctcaccggaggcctccgcgtctcgctgccttctctggtcaccctgagagcggagcacaacggcttccatggcgacctgcgagctctcagcgtcccgatggtgaggagcttcaatgtttcacggaacatgctggatggggagatctccggcgatctttccaggttcccgagctcgtcttttggcgggaatcttggcctctgtggcctgcctcttccgagatgtgttcatgcttacaatgcgttaggagatagtgtcggacaatctcctagtgcggcaatggaggaggctagtagtggtggtagtaatggaggcttgagtaagctcagtgtgacggcgctcatggcgaccggcattggcaacgcggcgctcatggtgatctctgtggctatctctgtagccatgttcgtctacatgagaaggaagctccggtcatggaagggtgcttccgatgcggcgctgagctttgaggaggaagacaaggtgaggaatcgggaggagaaggggcagaagagcaatggtggtggactcgtctgcttcgatggcggcgaggagctgaggctggagagcctgctcaaggcgtcggcggaggtgctcggcaagggcgtgtccgggagcacgtacaaggcggtgctggaggacggcatcgtggtggccgtcaagcgcctcagcgcgctgcagttccccggccggagcaaggcgttcgaccgccacatgcggctcgccggccggctccgccaccgccacgtcgtcagcctcaggggctactgcaactccaacggcgagcggctgctcgtctacgactacctccccaacggcagcctccagtccctcctgcacggcagcaacggtgcgtgccggcgccgcgccgactcgat

SEQ ID NO: 40717 - DNA, 9884 bp, Oryza sativa
ccggcgaggccggcgctggtgcacgcgaacgtgaagccgtccaacatcctcatggacgagcacggcgcggcgtgcgtctccgagtgcggggtcatgcgctacgccgccaacatccagcagtccatcccgcagccgccgcggtgcccgccggggctgttcctggaccgggcggcggcggcggcgggcggaggaggctggcacgggtacgcggcgccggagctggcgtccggcgccggcgccgcgggcgcgcgcgcgacgcaggagtccgacgtgtacagcttcgggatggtgctcctggaggtggtgaccgccgacaatgccggggacggcaacggcggcggcggcggcgatggcggggaggatgagacgatggggtgggtcaagatcggcatgctgtgcaccgccgaggcgccggaggagaggcccaggatggcgcaggtgctcgccatgatgggcgagttcatgtgaagtgaagcagctgcacaatcagttactagcatgtaactgagtctttagctttgctagcattaacagaagaagtgcaatgagagaaaaaaaaatccttattgagtgcaagaacagcatgtacgcgtgcaagatgtttggggaaattgtagcgcaaactgcttaatctgttggggataaatctcatgtatttctcgttaatcagctgcactgcagatctgcagtgcaagctacgataaagattatcagtagcacagtacccagtacccagtagcctttatcttcctgatatcagatttggaaagagcgaaatctgcaagcgttcagacaaaaaaaagaaaaaaaaagaaaagaaaaggagaaacactcaggggtcttccagctggggtcttccagctggctttacaagatggtgggctaaacaacctgggttcgagtcattccctaatgttcgcgtcaaaaaaagaaaacctatcggcaacaagtctgatctcaaagatcaaagaagagtcaaatattcagatacgtcatgatctgataactaacctactcctatatcattccgtccgaatgacatttcattatatagcatccccaaaaagaaaaactaacaggcaatgacttgagagttttccttctagcagcccaagtttgggttgagaaccatttgatttggtagtggcccggcccatagctttgcaggtctcactctgctgggttcactgggctgtgcgcctactaagcaaggtttagaaaccagaacatactagtaatttgtccgtgctaacgctacggctatatttaataatacaaatctaatatatgatttcagacaataaaaagaatggtttaatatattaataattatatagccatgtataaatgcatgtttcccacaatatatattgcttgctaacatttgcaaactctatacacaatgcaatccatttgcatgtatagaagaataaataatcaagcttcattgaaattgccattcaaacaggaaacgaaacaaaagtaaacactttagcatcactcatcttgctggtgttgatgcttccgacaactgcatcacatcgctgaactctgaacaaagcagaatctaaagcatgcatttgcagcaaagatggcaattacccagggcctcttctatccagggtcttcctgagttcatccatcatgctcgtcccgttggtgttgacgattctgacagctgcatcacactaaagacaatgttaggtgcaaactaatgtgcaaagctacggatgaatcatggtcatctccagctagctttatgtcaggtggtcagatgcagcgtttatatgcagcggctatcaaatatcaaatatgtacaatacagaaagcaatgcaaacttgggtttatatgcagttggttcatttaaaatctgccgccatcgaattgttgcccttggaaatgattatatgctactgaagaagaacatggaagcaactcatttaaacaaccctacaaataggggttccagtgacttggtcggagagcttgcggccgtggacggagaggaagaacatggcgacaaatccttcatggtgccccatcatcagtcatttcctgactcaggccttatcctagcttgagaaaagattaggcctgctatctaaattagagaaaaatatgcagacaataattttctcacacacattcacataataaattgttttctcccaggttatccagaaaataatcacttgagttagagaaacatatagattgagtctaaaatcagtgtgaaacaataacttggcattcatttttattttcaattttctgagtagtgtatgctatagtgcgagggaggaaaattaaacagcaagtatatattcatttttattttataatttctctctatttcagtaactttcgaagagatgcataatagccattgatattgggatgcacatacataagagacgtgacactatcattcacaatcacatccactaatttcataattttgcatttgaactgtaatggttgaaggaacggaatcaagcaatgatttccttgttcgcagcacggtggagagggttccggtggcggtgcaatggagcagatggcacaggatccttggcggcgcgagggactcaaccaaaatatttgcactgctcacttttatcaattgagaagaacatgccttgcaaaatgcttttaaatgataaagccaatgagtgttccctgttaaatagaatgttccacttaattagagaagatgttatttctcagaatcaaagcagcactatatgttgaaccaaaataattgtagtatgaaaagatgagaactaaattcatgtgccaatcctgaccactatccaaagatgatcaactgttgtaatttttattggtgcaaacaaatatattgtcaaccttcatcataaaattaacaggtcagcatatgtatatctagcattttaagtggtttatttacctctaattcaaacacgtaacatcccttggctctttcttttcccttcagattatcatcatggtatagtccagcagctacaacccttcatgcgcactgcatagaggaaacttgttgcctatataagcatggtaagaaaaagaaaatgaattcgcaagctacaaccaattggaactggtacattcagaccaaataaaccagcaatgcgtaacattgtttcacaaaccaatcagttgttcatgtcatgatatgaaacaagtcatcattcatcttcaaaatactgtaccgactgctcaaataaccacatgaatatatttcttctctctaaaagaactcattgttttcttcaagtgacaacaacagcaactcagatagagtatttttgcaagtgtttcgggttactcatttataaatatacttctgcattgcacaacacataatataatatatttaaaaagaggtggtaaaatcattaatatattaaaaaggaagtgagaacttgttaatataaaggaatcagttagggcatgtttagttcgtgaaatgaaaatttttgagtgtcacatcggttgtttgaccggatgtcggaaggagttttcggacacgaatgaaaaaactaatttcataactcgcatggaaaccgtgagacgaatcttttgagcctaattaatccgtcattagcacctgtgggttactgtagcacttatggctaatcataaactaattagactcaaaagattcgtctcacgatttcccccttaactgtgcaattagtttttcttttaatctatatttaatactacatacatgcgtacaaagattcgatgtgatgcttttggaaaaacttttagggaattaaacggggccttactattctcgagcatctcctttaccaaatgagcacatagtacttttgaatgttgattcacattacctacaccatagagatgagagccccatgcgtcaaataggctgagcctgtcaaactgccaccgtcagtgcgtccacgtctgctcctgtatggatggctcagcgtccctgtgtggacgtccggcgcagccacaagtggctggacaatgccggcactaccgacggccaacggcagagggcttcttcttcagtgtcggcttgggctcccagtggatgcatcggtcggctgaacttgtcagaccaccaccatcgcacgccgactaaatcatttgcgctcgtgccaggggccgacaactgcaacacgactactcccccttcttcccggccgacgcgatatgcggcggagtggggggataggccacggcactcgcagcgaaccggagccggagaggcgggtggtacgtaagaggatagcgatctagcgacagaggagacagcggacgcgaggtcgtgggttctcggagaagaccggcgaggcaggggacgaggcggagattggtggcgacgctggcgacaaggaccacgccgggtcgtgcctatgcggcttgggggcgacaatgacccaggcgactccagatcggtggcggcgcgatggtgacggttaggggaatcggcggccggcaaggttggaaagggagacagccggcgatggtgaggggagtgatgggtgcggcggttagggccgggatgcgcggaggggatgggtgcgatgggcggtaggggagcgagcgtgatttgggggtgcgggaggggcgcgctcttgggggagcgacggagggggtgcgagcgtcgtggggccgttggattcaatgcagataaatatgagctgttggatctgtaaggcgtaagaatgttagagtgtaagatgagagatgagtaaaatgggttggtgaattatagggtagatgccacgagcctacgaggaagacgggaaaattcagaagaggcgatgacccgacggaaaagcagcgctggctgtggttcaatgaaccatccacggttccacgccagtacgccacacgttgcctacttgcctgtacggtacggtcaattgcagtgaacctgacccattcggctagcttcaaagaaccacattagaagttaccatcaatcttcagagttcagctacatcacgccagtactaggctcttcagaaattttaccgagaaacagaacacactgcaattcccgggcaggtcggccagccgccccggttctgccgctgccatcttcattgcggttagccgtcgacacgtataaaaatcacttgtcactgaaaaacgttactggtcgcccgtgctttacggcggtactagctcgcaattgcatacagctgcaaaactctcgagcatttaactgtactcgtgaaagatgaggagtctgaatctttgtttggccttttgcatggccatatctgcaacaacagttcctttttttactgtgcacgatgcattaagcctagagaacagttaggctaagtaaaaaaaaatcaacgaagttaaactgtgtttaccatggaatcgtacagttggtagccggtacagctgcgctaccactaagacaactcatatgtggaccactactcaacaagatgcacatgggcaaacatgcttcaatgatttcggcctttggatccatcaccgaatcacgaacatctctccaggccagcattacgatttaacagctcgcagtttgaaactttgaatgcaataatttgcgtccagccttactgccactcgctactctttggtcattcagaacacaaattggagcgctatgaccacaaattggagttctttggtcattcagagcacaaattggagcactgaacattgtatgctactgttttttttaatcgtaactacgaggtaattacaatcttgaagatgattgtactaccctgtcgttcatttaacatagcacagtttggagtggtgaacgtttgtgcaggagagattttatatttatggtctgaattgttaatctctcgttagttcccgtatgatatattttaaacgataggccaatagatgacaatcaacatcatacaagtgtcaccatgtagtacgcgatactcatgttctttaaactgaaaagaatcaaataaatcatctcaattcatacaaataaaaaaaaaagaagagtaagtacatggccgccgccacagagaaatggcgcgaaaccacaccctccctccctcacaccaccgccgactcattaattacatacacaaatcccccccacgcgacgaccacacgacgacggagacacgcacacgacgacgacgaaacggatcagcccgaggcagatcgaaggggatcgatctagcagaagaggtagccgaacgcggcggctgcgagggaggcggccgcgaggggcaccgcgggggcggcgtcggagacgggcgccggtgccggcgcgtggtcggctgccgctgacgcgacgagggacgcggcgatggcggcgaccgcgagcgccttcatcctgagaccggccattgtcttcggaactcggaagaggattagggcttcgacttctagatctttctggcgagaagcagagagatgggtagtagtagtaggaggcggcttgtggggaggtggaggtggaggaggaggcgggggtttatataggcgggcaggttagggtaggtcgtacgcgtaggggtgatggggtcgggttggcgggggagaccgacggggagaggcgcacggcgcacggctggccgtttgttgggttccgcgggtttggtggtggggcgttgcggttgccgacttgccggttgggatcctctctggccaatgcacgcgcgtctcgcatcgtcgtcgtctgctctgctcgctcgcgtgaaccgtggccaagtttgtggtggtcttcttttttccaggcttttgtagtagctgttcatcatcaatgtgcaccacgagtgcacatgcttcgttctttgctgtcgatgtgaatcttgttttttttgagttagagaatactgttcacagtccattgagaggtgagaactatagtttcttttagacacgttgactataacggacgcttaagcaacggtaacatgacaactagcaaaggcctttttttaacccttttagaagtctttgcaatactataacgtagaaatcatttggctaacaaaaaagaaatcacgtgttgatttactgtctcctttttttcctagtggaataatcaacaaacacacattctttatcgaacttctaaatggtatttttaaaaaaaactatatatgaattctttaaaaaaatgttttacattcttttctttcaacttttataatagttaatgcattaagttttttttaatcttcaaacaattatctcaaattattcatgtatttaaccattccgcataaaaagagcgcgataagggcttattttatcgtttgctcttcatcttgtcattccaatcatattttgaattttaaaattgatttttaagtttttcatggtattttatttttcaacattgatttctatgtcattaagaacatatgtacaacataatataagtgattttggatgatgtaatatatcacagtataataaactaacatggtggcctgcgcagattgcgcggctagcatcattatattttctatcatataatagtatatatattttctcattatattatttaaatatattaaaatgacaacataattttaaattttgcaataactttacaaaactactaatgtgtaatattcatattgtattttatatacttgttagttattaattatttttaatatcaaattttagttatttgtaaattatatatattcatatatagactctatactcgtcttttaatatattattttaattccgaattttctgtaaattgtatttctatatagactctatgatcttcttccaatattatttatttttatttctaaatttttattatttctaattgtatttctatgtggactctaaactcatctttcaatattctttaatttttaatttcgaatttcagttacgtctaaattgtattcctatattgactttaaactcttcttcccatatttttcttaatttcgaattttagttatttgtaaattgtatttttatacggactctaaactctacttttaatttcattatgtttattccaaattttagttagttttaaattcctatatggactctatactctacttctaatattccttatttttttaatttcgaatttatttttttcttaattgtatttctatatggactctatactttacttctaatattccttatttttaattctgaatttcaattatttcctaattgtatttctatatggactatactctacttctaatatttcttatttttaattccgaatttcagttattttctaattatatagttatttcctaattatatttctacatggactctatactctacttctaatattccttattttttaattccgaatttcagttatttcctaattatatttctatatggactctagtctcatcttctaatattccttattttttaattccgaatttcagttatttataaattgtatttttatatggactctagtctcctcttctaatattccttattttttgattccgaatttcagctatttctaaattgtatttctatatagactctgttttttctttttctccgattaatgtgagaatttctaggccgtgagagcgaacgtggaggctcctttttctattcctttaataatataatagatttagataaaccgtttgtccaaattctctgtactagaatgcgtcacatctatccaaaatcctttatattagggacggatggagtaatagtcattacaactttttatttgagagaaacatgcattacaacttataatcaactgtagcggaacaatgagactatacacaacaaagaagcaaaacccagctcaggttgcacgaagatggattcagaagatcaagagtgaaggggggcaaggactcatgggggaagaaggccagcctagtgggaacagctggcgtgacagttgccaaatggccccccacgaaattagctgtcaaagctaaattcagcaatgcggccggccatccttccttccttccttctcttttgtccattcccccattcccctccccctctgaaaattccaagaaggccaacgattttttgctttgctgcgatcgcgacactctcgtgtagtacattcaccagtagttcgcgcatggaattcagagtgaaatccgggtctaaatttgatttaaccctgattgcaacgtgctaacgaacggacggacgcgtcgaaaaactacaaaatagacgtcagttttttctacgagcagagcggaataatatcctaccagaccaccagcacaacacaatgccgtcctccaactccaagatttcgatccctctggaaggtcgtggacgaagaacaattcaattcttcggaagcaaaaagtctgcggcaaccattacgaacacgcgttaggttcgtcgtataagtaccactcctgctgccgtccagttgcaattgcgttttctcctttattactcctatttttctctctttgtccgttgcttttgcggcgtggggtgacgcggggtacgcgcgtggttaaccgcctttgcatttcctccttcgactggacgcacgccgaggccgtgaccgtgaccggcgccagatggagggaggggaaggggaagctcgtgggagtcgtagtgattctgtgcttgggttggatgttgggggttgaacgaaccgtagaaagtggtagaacgcgttgccattttggacattgccaatgcaacacgaatgatcggtcgttgtggaatactacgcatttttggttaggaaaacacggtacgatgtcagatgctcgtctagtcgtgtgatactgggattaggcaagttgtgcattgcaatttgtacgttgccaacacgagtgatcggtcgctgtggaatacgcattttggttaggaaaacatgtcagaaactcggtatacccgattt

SEQ ID NO: 40718 - DNA, 5564 bp, Oryza sativa
gcacgcgaacgcagatgaagcccttgctgctcacgccggccgcgcggctcgcggccgcggcgccgtcaacgctctcgcggctgctccgcctacaaagcggtcgccaccatgcgcacgcctcctcctcctccaaccgcctattgccccctctcctccgtcctcctcgcgacggtttccgcggcggccgcctcatcgcctcctcctcctcctcctcctctcaggtctggcttgcgcgccccagctcttgtttggcctgtcttgtgggggtggttgcggaccaggtgttcgacggaatgcccccgaggtgaatatggctgtgactctggctgatgccgctttttccctgcgttgcagatggcggcgcctgccgatgcaccgggcggatccgcggacgcgttcgaggtgatccgcgctcaccaggtgcggcccttagcatcgtgatcgcccttttattccttggacacctcactccttgtttgtgatgtccccgaggagcgaggaacctaaccaggcagtagcttatgcaactaggggtgaaaacgattggaaacggttggaatcgctagcatctcttcggaaacgatgcttgatcggccggtaattgaccatatttatcatttaaactacacagtatcgacattaatatgatgcagaaagaaattaggaaaaaataaaatttaaaaatagccaaaaacggtacggtcggaaacagtacccttaaacggaaacggcgcccggtcgatcggtaatttctgtgaccgttttcacccctatatgcaacatacaaaaaacacaaattgacttgttctgggtcagtagtgtcccggagattccacaaatttaggacaacgtgcctggtaaatgtacaaatgtaatacagtcagtttctttttaagaagtcaaacgtcaaatatattcccaggaaggattagttatggtattgtgaaacagggttggaggctgtctgctactctgctgtgtgtgaatgtttcaacaaattaatgttgcaacaagtaggcatcgcatcaataattaacaattacatgaagaagtttccataacaagaattagacctacagagaaccaattgtttactagccacaacaccaccaactgagcttttgcaaacctttcccttgtcaattcctgcaagagtctgagcaatcaacttgcggaacaagtgtggaactgtcagaagggaaaccttcaacttcaatgatctatcttttagtttttatcattatcatttctcgatggtccatactcaaacaagatttttgttatcgtaggaaaaagctgctcgacttcctccggttgaagaaatacggaccattctggaccaaagtgttaggggtgtccttgccacccattctcaggtattctgtagactaatgagtagtggttgtattgccatgtacagggcaatcctcaagagcatggaataacatgctattttgttacagggtcatgttggctatccgtctggttcaatggttgattttgcatgtgatcaggatggttcccccatattagcagttagtagtttagcaattcactcaaaggtaagatataattcgcttttatgatcttgaatacatgataaaactatatactcactgtttcccatgcatggatatccctgtacatacacacaataacgctattactacattggcatagatgtttggacatgcaaagtaaataactaaatatgcatacagatgtaaaatgcatgaccactagcagtgatatgaaaatagtactgcaactctacattcaccaccagtccagctggaaaatttttcattgtcatgtttttcctttgatgcaagcttcttggattctgatacttttttttttttttgcagaatctctctgaaaatcctaaatgctcgcttctggttgccaaagaccctgaggacagaacagatactgtgattactgtatatggtgatgccacacctgtaatgctccagatactggcctgcctatacccttgattcttttctgtatgacactttcctatatcatattgttcatgttacgtaacaaatatagatctgttggtctttgtattatgtttgaaaggtttcagaccaagaaaaagatgcagtacgaagtgcatacttacgaagacatcctgaggcattttgggtatgctatgtggacaattttattattttggaagcacatgttgttttatgaagtactgattctgatgaaaaaaaatgccaaataaggttgattttggtgacttccgttttctgcacatcaagccaaaagccgtgcgatatgtgtctggggttgcaactgccatccttggttctggaggtatgttgccttcttcattgccctgttgagccactgtttgaaaagtgaaggttatcctttataagaaccaggtttcagggttcgatatctaatcaaccttttatttgctcatttatttgtgaatgctgagtagccatgctcctctattgtgtttccacttctagtatttgtacaagaatagaaaccatgacaaatggtttgatgataatggtgcctgattttaatgctattgtgaaacatccccagaattcagtgctgctgagttcaaggaggcaaaagtggacccaatatctcaattctcaacccctattacggtgtgtccacattctgtttcctttttccatcaataaggggcatcacagtagatatgccaatcgttagtgtaattatgttaaattttaattccatgcagagccacatgaataaggatcattctgatgatacaaagctcattgtgcaatactcaaccactgtcaaggcaagtaaacaagaaaatttatgtacagtttttagtcgcaaatgttatttggcataaaattttaggcaaatcacatttgctgagctattgttccgcaactaactatttaagttattactgaatggcatgtattcagtcatcttggtgtgtttagtttgggaaaaggaaaacactcttgggttcaaacatactgttgctgttttttttagggaagacctactccgtaactgagaaaccatggctagctgatgtaggatggattcacaagagtgctgtctataacctcacccagaagttcctcaagttaagcgcgacctgatgacctgatgtcctgaacccacacgaccacaccctatcacctatcctggtgttgcgcaatgatcagatttagcaatgcatagccacacaactagatgctctcaatttttcatgggaatggaagccagggaggcgttgagagttgagggggttgattacccagttctgtagtttgggtccaacaaatttataccatttattttgtagcctagctgatatttttgtgtatccagtttagtgttagcaacaagaactataattctatagcatgcacatgatgtgcacacttttgccagcaaggcctgtaaacatcactttgccagtactcttgaaccatatccagatcacaatagtgtggagtagtggaacaggagcctgtcttattttcccccccaaaacacacctatttatgctttatgttactcttatctgttgtctttttagtttatacactattataccttatatattagacagaatgttctttttttttctatgtactgtgttgaaaaagataaaccatctcaggtggactttgcttacatgcttgatgtggatagtcttggtttcaatgtgaaggtaactctttaaattccttgtcctactcttatactatatgaaattacatagatgttatgctggaatgctgcaagcctgcaaccaaagaaccaaatatatgaaatactgatgttacatttgatacaatgataacaatgcttcaacgacgaacaatcaacaaagcaataagatttagaacttgataagattctgaaagcaaaggttatgcttcctgaatcctgatagcattacagtttaaggaaagaatacctatagataccttgaattttggagcccctcattggctttataacgacacacttagttctatacatctttgaacatatctcgttgaaccttaatgtgctgcagtgtccactcaatcaaaagccaaccctgaacttctaatataagcttttgcatttgtccaggcgggctatgatggaagtgttctgaagctgcgtatccccttccctaggcgtgcacaggacaggaagtgagtccccgcagtcctgcactgcgttctcttaagccttttatctaaacgtccgaatgatactttataattaatgtctatgatatgattatttcaaatatagatatcttgagactgactacattgttttttctgttcttttatagggatgttaagacacttattgtggaaatgctccaagctgcaaaagcctcatcgtcttctgctgaatgaatgtcctgttctagaaagggacgtctttgtccttgtaaatgaaataaagatgtccttttcgatgagttttttctgatctaggaaatgtcatgtttttacacatgatatatcacaatgccacagcttaacaccgaacagatgccaatctacttgtatattatttacactgaaacgctccaccgtgtgtacatttcttacttgtcttaagtcttattggaactttggaagtctgcagatgcagctaccatcatctctcataaatgctagcgaaatgtgtttttgggatagcatttcagcaaaactactttttgaacatggccaaatgtccattttctcgagtttgagtgattgctgccttgctggatctctactgctctactcacccacatcgctcctcccatcacggaattgttgctttgttgcttgctggtattccgcggcagctaggaatgaaaacggtcagaaatggtatcattattttattattttctcgaaaacgaacggaaacggtcgggaaattttcatatttatgaatttatctatttagtgccaacttcaatgccacgctgatagaaattaaaaaaactaaattttaaaaacggtaaccattggtaaaaatgttattattatattagttttgtggaaactatatcgatatggttgggaaattttcataccgttttcacccctagccggcaacgatgtttacaactagtactctctcttaacaaggcaacaatcatattcatacaacagaaatgcgagtgttgctacaagtgatgccatgaagagactgaaaagaaatgaaactgtcacaaaggattcatcgaagtgatcatattcatgatccagcatttaatataaaaatgacagtaagaaatttccaataaatcagcaagatgtagatatgaggcctcataggtagaaaaagccccatagaggatgtttagatccatgagtgtaaagtttctgacgtgtcacatcggatattatatagggtgttgcatgggatgttcggatactaataaaaaaactaattgtagaatccgttagtaaaccgcaagacaaatttattaagcctaattaattcgtcattagcaaatgttttactgtagcaccatattgttaaatcatggagaaattaagcttaaaagatgggctgcaggaatt

SEQ ID NO: 40719 - DNA, 1078 bp, Oryza sativa
cagcgaacagagcgcagccgtggagccgaaacccccgaccggatcaaggactgatttgtaacatatttggatctctaccaattttttcaacccaaaacaggagattatgtgagaaacagcagtaccgctaccattagaacagccacgtatatgaaaaatgtaaccttaaaacaatgattacacttgtattaacttaatatatactccctccatcccaaaatatttaacgctattaacttttttaaacatgtttggccgttcgtcttattcaaaaaatttaagtaattattaattcttttcctatcatttgatttattgttaaatatacttttatgtatacatatagttttgcatatttcacaaaagtttttgaataagacgaatggtcaaacatgtttaaaaaagtcaacgacggcaaatatttagggaaggagggagtatcttatgcttaaggtctaacacaagctttttctttctccttcacctcaaggcccaagatcaagagctgaaggaattttatcatcatcttacaagcaaaatgggatttacgtaaataaattatatacaacaggggcttatgtgaaaaaaagtacctcttgtgggtcccatctgctacctctctcctcagccacgccgtgctcctttccctcactcgccagtcgccaccctcgcggcctcgccgcgtgctcctttactgctctctgctcgcgcaggagggcccacctttcagcctccgtcacgtcaccggctccgcctcccgccgattccttcctccccgtggaagcaacccgcagcggcggcgacggcagcggcgtcggcggcggggacgaggtggggagtcgagaggaagagatggagtacaggagagtgaaggaccaggtaagcaccaaccccaagtcccgcccaaccctaatggagagagagagagaggaatgccactcgcgctgatgcgtccgcgcctccagattagatcgctgcaacgggtgttccctttttgcgattttcgctggcccttttctgttcctcacttagggttctagaatttccggattttcgggcgttttgcggctcttgatgt

SEQ ID NO: 40720 - DNA, 1694 bp, Oryza sativa
caatgccgcctacctgtggtgaggtagggattagacatggagtcggcgtgggaaaaaggtggcgtagacctgctgcggcgaccgttcggctgggaaatccctctgcagtgcaacgccgacctgcggggcgacgcgattgacggcgacctgccgggacggcggttagctcgccggtgggttccgctgcggggttgcggcgtgaggcgtgcagcgggggcggtgaatggggaagcgacgtggcgaggaagggatggggacgccggggaggtaagcaggcggggcggcagatggggaagtggcgcggcgaggaggggatggggacgccggggagggaggcagcgcagcgaagagagggtagtgacggcggcgtcgtagatgagggcgagcaggagcggcggtcggcggcgatgcagagctcaggggtgtcgcgatgggggtgccgacggtggaggcgttgtgggggcgcggcgatgggggcggcgcgatgtgggaggcgtggtgggggaggcagagtagggaaccgcccccggcggcggcggcggcgagggaggcacacaggggaaccgacgatgacgaggagttgaggaggcaggggaggcgcggacgcggggcgtggtgggggcgcaacgaagagagtggggccccggaggtggagcacgtggtggggacgcggagaagaggaggaggagcggttttttctcgctgaggaagagggaagggtcgcgcgtgggaggatcgtgaaaggaatatcgttcgtaggatctcgcagatcaatggctcagaaacaaaagtggatccgaaggattgtaggattgctggatgaacttgtaccttttatattagtatagattttctctaccttcagttatcaagtatgtgcataagtgaaattggagttgtacgttcagaatttcgggtttcgattttcaaaatacgaacttattagttcgagatatggtttggactagagcgaattactggcataattattcagatgataatgataatgatagtagggactatatacctaaaggaaaagtctatacgtactaaattcttactaacactgatgtgtcatgctatgagtcactggtggagaaactgtcactcccggtttgtaaaccccctgtagtcccggttgaccggaactacaaatccaggactaaagatcgctatatttagtcccgagtgaaataaccgagagtaaatatcaatctttagtgctagggactgaagatcgctatctttagtcccgggtgaaataaccgagagtaaagatcaatctttagtcctactaaagagagggatctttagtcccggttggtgttaccaaccgaaactaaagagaggatagagacagtcccggatggtccccttttttttttgttacttttttattttctcccgaatcggatggcatgcacatcctaaatcaaaccccaaatccccaaatcaaagtaacatcctaaatccacatcacaaatcttaaagttacttatacacacaaatataatacatcacaaatcctaaaaaatttacacataaatcaaatacaacacagattatacatcttaaatctatacaatgaatcacaaaattatacatcttagtgaatcacaaaatatcaaaaaaatataaagagagagaaaacaagctgccggatgccgctactagtgctactactcaagaaatca

SEQ ID NO: 40721 - DNA, 1437 bp, Oryza sativa
attcctgcagcccttgtcattgtatcatttattgtgccccacatgaagttgccactgtttgtcctttacccagtatcacgaactcttccttttgttacagattgagatcaaagaagtggatggtgtatgcccttcaccatcggacatggcaggacaagtagtcacttatctagaggagaaagggtttctgcatgattagatgggatgcatcgatcagccggtagagttttctcctccatattagactagttcagaataagtcaagctttggcatgttttctgtacttgtttttgtttagattggttacatgctttgatctacccatattccttcttcactgcacagctaatggagctgtgcaatgacattcaggtaagttggagtagatttgtttttttgggatccaaaatcatcccagttattaacaggccgtagaagatatccatttacttctgttcttacattgtggactttatactgttactgttcttctaccagaatcagtgcctgggctgcgtacatccatcgtggatgaagaggctggattccaatccattttctaaaaagaaaagaatcagtgcctgtattatctgaaaccaatccgaacttcaaggctgtttggtcgtaagaatataaaattgtcgtgaccttgactttagataatacggatgcctggtgagggtaatgtctcgtccacggaaatcattggaagttcccacttccgtgatcatcggcaactatgttgtcgttatatgatctgaagttacgagggggaaaaacaaacatatctactccctccgtcccacaacaaacatactaggtgatgtcgtatctagtcttagattactatattaggactagattactatattgtgagacggagacggagggagtagcagaccgagaagggtaggaagatgggggaatgctagaattggcgtcaaccaaacacggaggacgcggacggtacagggagggaagacggacttatgtgagctcctatgcgatggtgtgtgggaaggagaaaagggatgtggtgatgtgataagattattgcgttgcacgaatcttggcgtgatctaaatagtctaaaatgaagttgtgtgttttcaggtgcttagaaactactcccttcgtccaaaaaaaaatttagaattgaataggatttttgttagcacaacgaatctggataggagcttgtccaaatttgctgtactaggaaatgtctaatgcaatactaggttgtttttttaagggtggtgagagtacactcttatccaaacggtagtgcaggctgcaagcttgcggtttcttacagagtcgacgtcgtctctgtcaaacaacagacatggtccacccaagagggatacggcacctttgcgagctgcgtcgaccgctcccccgcggagacgaccagtcgagatcaccacacacct

SEQ ID NO: 40722 - DNA, 4007 bp, Oryza sativa
agctgtgccagggacagggcggggcgcgcgggcggcggcggcggctgcgggccgacgaggtgctgcgcgcgctgctcgtggcgcccgtgcgggagctcgagcgcctcgccgactggctcttcgtgttcttctgcctccccctgccggactactacgtgccgggctccggccgcggcgggctgctggtggcgcgggcgccgtcgtcgccgtcgggcggcgcgctcctgcactacggcggtaggtaccggaggcccctctcgctcttgttgccgtcgtcgtcgtcctcctcctcctcctcgtccatgtcctcgtcagaggagtactactattactccgacgattaggaggacgcatcgaatcaagctgaggtgtaccgaatgcaattgtgtgtggtttattcatctatctagccatggccatgggcttttgtgtgctaaattctttgtgatttgtacatatgtgtcattgaaccgacaaattcaaatgatggtttttgttgattttgttggttaaagattgtttcgattctgaaatttcaggcgtttttgatggttttgcggtagcttctttgattaagaaatgaatatcaaaatgatgtcttttaatttgttcttgacatgagtgtacgtaacaactaacaaccatatatataggtggacggcgattaattatttcgaagaaaaaatatactaagtttgtactatttggtggccggacaataattgggccattgcaacaagagcaatgaagaacaaatcgattgtttactaattgtccctttcgatctcgatctatcatatattcttaggggacccttttctcatcttcaatacatctcgagcagtggttgacaaagtagtgggggattgtctaacataaatcgtctgaaaaagagaaaatggtacgggtagtctttgttatgaagatccttccctaagttgcaatattacacttctaaacattttaaggtaccttccaattattagtaagaagttcgatcacattagggcatgtacaaagttagagtctaatataagctctctatattaatttgcgtcactaaagagctctctatattaatttacatcactagagatcatcctcatacaatagtagagacaataagatctcttaatcattaatgcactaactattttttttattatacttctttccttttttttccatcctcatgcaacaaactttccgttaataaatactaagagtggattctaagccattgttatgcgtaacaatgatgtttctcttttattccctctctttctttcacatcatcaaatttacatgacaacaaagagagcccattaagggcatgcacaaaggtaaaatcaaatatgagctctctatattaattaatgtcgctagagactatcctcttacgatagttcactctccggattcattttaattgcgttttagacaatgacacggtctgcaaaatatatatttgaccttatttttctattataatatatatgcaataaataaatgcatgtttacttttattataatgctttgaaagacaaatctatatatgttgttatagtttctttaaactaaatatttttaaaattattgatggtcaaagttataaaagtttgacctaaacatcagttattataaaaccagagggagtagagactaaaccattaatgcactatttttttatacttctttccttttctccacccccatgcaataaatttttcgttaataaatgctaatagtcgactctgagccgttatcatacgtagcaacgatgtttctccttcctcccatctctttcttccatgtcaccaaatttacttgtatgagaacgaaaagagactcttattagacatgattatacatgcccttatttcccaataacaattccatttttaagacaactataacctacaacattattccagcatacaagtgtatcgaagacacacacatcagggtttacctttctaatgaactgtttggatctcgacgcaacgggttttgccaaattccaatcgaatttactgtttcagatttcaatttcttaggaactattttaattttgcctccaaatctgctttcatcctatgtcgaagccatgaaatttcatggttttctgtttgtaaaaaaaaagaataagaagaaaaaccctggcacacatatgcatatcacatgaacacaaccgcgacttcgcaaatacttccattttaacacatgaaagatacttttaagtataagcgatacatccctaatatcataaaatttgtacaggaagtgtacctaactgtgtgtaccaggatttgagatgtggtaagccacaaattaactccatcaccagacaaaaatgtgttctcatatgtaggaaaacatgcgattaactattcatttgcctaatggccttaggttgtgttcgagttcaacagtttggctggctaatttgtttcatgtaaaataagatgggtcattaaggaatgattaattaagtactatatctattttatattataagtcgctttgatttttttctactcaaacattttcaagtttgaccaaatttataaaaaattatggtaacattttcaacataaaacaaacgtattatcaaaatatgtttaatgaaactaatttagtgttaaaaatgttactaaatatttttataattttgatcaaatttaaagaaatctaactataaaaaaacaaaaatacttataatataaaatggaagcaatattaattattgaaaatttgaaaataaatgaatctatttgatttttaaaaaacttgtatatataaggttttatcacaacatgcattattgagccgtttgtgaagtgtgtccatacaaaaggaaaatactcggccaggtaacccaatcaaactcagccttaagttatttgagaaaaccgtgcactttattttgataggtatcggtttctaacttttggtaccttcgtcccaaaatataaaaacctatactagatataacatttgctagtaaaatgtatctggacagaggaaacgtctcatccagtcttagatttttatatttttgagatggagggagcagtaagatatttgcacaaacacactatgtttttcagtgccttgctatatacattgatttgtacagaagtaaacgatcaaatgattcagtacctattgctactatcttcattccaaaataagtttatttttcactcatccacacataccaatacaaatattaaagagtaggatattcctactttatccaaacacaacacaactattcatcactttatctactcccgatataattattcaacattcgcaaattcccacgtaatgattacttttagaaaataaacatatttaataacagctataaattaacttattttttttagatcagaacacattttgccccgactatacataagttcacatgtcctctggccctctggccgtcgatttatgtaccactttaatactcccgtctatctagattcattgtactaagattcattgaacggagggagggagtacttcataacacaataatccttgagacataaattaattaaataatatatgggccaattcttacggagcttcaattctttaggcctttaatcgatggcccattaatatcccggcctttcacacacggcggcccatgcaaagcccaatttgaccggccgcgtgacccgcgtttagacttttgactagccaactcacacaaacgagtataaacgaccaaaccgaaaaccaacgcgggtgctatcccagccgtccgttcccacctgacaaccgaccgaatcgaacggccaccatagccccctcacctcaccacctaatccaacttctaatcgagcgactcctcatcatcgtcgagtcgatctccctcacgaagcaaccccagccttctttacctttcccgggccgtgtcgcccacgcgattcccttccctccaatcgaatcacgtcgccgtcctcctccgcctccgccgccgccaacct

SEQ ID NO: 40723 - DNA, 13490 bp, Oryza sativa
aatttagagtaatgatgtttgaaactttttagattatgcgctagagtgaccttggtagttccaatatgcctttaacatgtttatttttgctgttgcagattggtctggatggaattcgcatgcttgatcccagcacaagcaggacactaaggatttatccccttgatacactgacaagatgggatgtaagtgcgacatccttttgcagaggattatgtgtatatcttcttactacaaaatacaatggcaatgttgtttttctaatggacggttcatggttgtggtgcttggttaggttttagattcaaccgtatttgcattttgggcgaagactccagttgattttgaagcaaagcgaataaggttgaagtcaaacagctatacctccaatactttgcttgacactgtgactgcagcaacagtgcaggtgatcatcttcctccattatcaatcgctatttaccctcattttaagattcttaggtttagacttgctttgctctgtaacacactaacaccactactaatagctgcttttggtgaaaaagtgttaattagaaaaaccaaagcgatgaatatttgaatttgaaccaatacttaggaaacagcaaaatatgacttatatcatgaatgtctctcttctccaaaatattactagaaatcaatatgtcatactgcggcgagtatgatgccatataagttggctaacttggataccaccttattactctgtttgaattatattccaatattctgtgtttgaattactctcttgtatattgatgaatggaatataagttgctaacttggattccacattgattggcagtatcctttcacaatatttgtagaaactagttttttttttaaagaaaaggttttgctccaacatatttttcttgatagattttgttcacggagttgctcatacattcagcatatttaatgcttcttcttttttttttacaaaacattcacattttttaactttgtgaaactacttacagtttaaggagattggtggagatgcaagaggcagaggaactgtagacagtagcaaacccatgtcacaatcaaatgagaagaagaaaggttttgattggatgtttgcaaaacctgttgacgaagtgaaagaccattgggtaagttgaattgctgcgacacacatttactacttgatcttagttacaagaatgctggaacctttttagtttattatttgtttacttgcattgttccacttcttatttttgataattttcttgcaatatctgctcttccctgcgaatgcatgtagtttggccccttttttgaagtgtatatagtttaccctttgattagtcctttacatgacgatacactctgtaaccattttggttgagcatttcagcatataatgaagaccacttcagttcacttagcagtactgttgctctagccactgactgttttgccatcttgtaccaccattttgttaatcttatgatcgtgtttcttctctttatcccctttctaggttccagatgaggctgcgaagaagtgctactcatgtgctgttgattttagtccttttaaccgcagggtaatttgaatactctttgttcggatatacttatttgttacttttatgatgatattttgataaattaagatgatgttttctttgcagcatcattgtaggaactgtggtgaaatattctgtgacaaatgcagtcaaggaagaactgctctgactgctgaagataatgccccgcttgtccgagtttgtgatagatgcatggtacgttctgcttcttgtttcttaattatatattctttcttttgcttgatgttatcttaggtatagttacttagctcattttaagcatagcttgactgtgttacttcttggttgtatttctcttgttttccaaagcgagcacagctcgcataacctctgcagcaactcacctattgtctgttgctctacttatacatgctttagcagttttatcactgaccaaatggaaaacatagtaaaatttgaatagctgtgcactatagctcttcttggcgagtttcaattcagtgccatgtgttcatacgttagaatgtttcttattctctcaggcagaagtctctcaaaggcttagcatagcacaggaagctgccaacaggtctgccacagtgcaaagtcatgaagatcttgcaagaaaacttaaggtgacgtactagataacacttcctctatattatacattcattggagtgacttgtacacttgacggattaattgagcatgatttgttggaatgtaagagttgtaaatgtttgttggcacatgttttgccgccaaaattttagtccctaacatcttaggtgccatcaggaaatttcagcatgttctatgagtctgtgatcttaacgaatttatgctttgatcaacaggaggagatggagagaaatcgcaagttctctgggttctgaaaaaaaacacgctcatctgggaccagaatgagggaagttgcatgtcctacttgcactgtccatcttcaggtcggtctgactttaggcactcaaatgtgaatgctcttacagtaatgacttcgtttggcgcttacatactaacagtggatgtgcaattgcaggttcaggttccaacctctggctcagaaacagtggaatgtggggtatgccagcatgctttccgtgtcagcgccaattgataaaccgggagacagagcatgtctatagcaattattctgtttataactcacttattttgctgttccatacataataagcgtgtgtgcagcctgtagatatttcctggttgtgttggtgaccatgacaggatatactaggtttttcttgtacatgggttaatcctaaaatatatgctctaatactgctgaaattgaaacatgcttggatgtctctggagaatatcaaagaaacattcgtttctatgcttcaaacatatatatctcaacataagttcttaaaaacagctttgggtgtgctttcagatacaaaatggaatgccttttgcagcaaatgtgtagaactgcatctaactatgagtgttttaagatgctttgcatcttcctgtcagcatggtcggctcgcttccggttgcaaatatgtcttctctggattatctaggcaaatgtacttattgcctaaaagtctaaaacacttgttattgcttgctacttcctctgtttcacaatggaagtctttctagtattgtctatatttatataggtgttagtgaatctagatatatatgtgtttagattcattaacatttatataaatatgagtaatgctagaaagtcttacattatgaaacggagtgagtagttgctagtactacttattagacaagaactgaatgtggggcaaagatcaaactgcgcctagttgaagcacgcaagagcctaaacccaacctcactacaagtcactatagcagcttcttgtatcaacattcatcatacctctcgaaaagcaacattcttgaccaaaatttatggccatcaagtgaccccccatggccatggcccaactgaagcagcatccgcatctgtagttctgcacacgctccacagcagtgtcatctagctccaggcaaagagtgtgcagggaatcaggatagcacgtcgcaggccaggccacaggccagcagcaacgcaggcagcatccatgcacgcatgtgcccggtgtccatcgggacggatctagaaattttctgcagtttgagcaagacactacaacaatggctaggtcaatgttattgtaaaatgttggtgatatactatcgagattgatccggttcctagtacaatgttgttgtaaaatgttggtaattgctatcgagattggtgtataaattttcttaattttcttgaggtcttgttcgacttagaggggattgaaaagtattgaaggggattgaggaagaataatcacactataataggtgtgtaataaatcctctccaatctctcgctcacatggattaaccaaacaaggtctgagcgggagcaaaacacaccatgacggtgttattccatgctatcgtgaaatattggtgatatgcatggtatgccctcctatactactgcgatccgataagcccgggcagctgcatagggtcgctgggccatggatccgccaatgatgatctggtttaaccatcagggggagagatggagggagagggattattgatctgattttacttcgtatactaaccattaagaagaagaagaaggacaccggcacgttggcggcatgattgatctctcctcgaaagcagcatctcttcctctccccacccgcggcgtttaagcggaaacaccatcattctgctgctgaaagcgttccatccaggcatgtaaaccacgggaaagtctgtgcaggaaaccggtataaactccggaaagaagtactactagctatcaagcctatgcaatgcagtgtctacgtacaggtagcctgtctgtctctgaatacaacgtgaggcgagctctcgagatgggcaactcgcagcgtgatccgatgagtactaagtttcaagtgtggtatactggtagctgaattcttcagacattgcgccgtggacactgtgtttgttaattcttcaggctatcaatgatctgccttttgggtcttcttcttcatcttcttcttcgcgagcggattaaccgagcctgcaatggatggcaggtttctgttcctaatccggatggccaatgctgtcttttgaccgtcgctttggggcagagccgtactgtatgattactctgtaactgacagtgtcgaacgtgttcatctccgtgaaatttgatggatacacatcctgtgcgtttgtgtttcttgctcttgtgtttgtaccatccgatgtggtcacctaatttcttcaatcttgaaatagcatttgatcccacaattaatagtagtatgacatcccaacttctaaattgtctttaagcagtttcttgattgcttctgggtagctagctgagttgtccttgcatatttgtatgttacagtacattgcaagggaaaaacatactaggttgctttcattaactccattctttcagaaagattaaccgttttcagttcatgaactaattgctccactccatatattccctagtccctaccttccttctttctctttgagaatcttcagcgtactgagaataatcaagacagagaagaaagcgaagagcaccaagtcattcttatctgtagtactttctgaagttaacactgcacccatcatgtacagtaccaaactcagtttggtggattggatcaatgcattctccaagttgttcgattaggacttcagatcccatctttcatttgctaatccacttgactacgttcaaaacgataatctgcatgtctttccaaaatacctaaggactaaaaaaaagctatatgcattgcaaacaggccatgctattcagacatgcattttggcactatctctgtccattatgcggccatttgaacatgtttccatgttctatgatctctccaaccatgtcctcttcatgatatcattgcatgtatggactcactcaaccatgtactcgcgacctcaccatattctagtagctcagactcagccatcaggcttggcatgcttgtagacagccaccagcagcatgctacgatacagttgataactgcattggacctcgattggactgcatatgatagaacatagataatgcttacaggttgttttgacagtgacatggcatacagttgagtggacaaccgataattgggtccaatagtgattaagcgagtaatcttcggtccttagctatgaaatggacttgttggtcacgaccgtcactcaaaacagaagaacgaaagagattgcttgtttctgttctctgaaaaattaacggtgtgtcgtactgtccacctattggaattctcccttgagggaagctctgaattagcccaattgtctgtcctacaaattaaccgagtactctacaaatttatgttctctattcgagtgattaagtatggctttagctatggttgttaagaactgaaatggacatggtcgcttctgtcactcaaaacagaagaacgcaagagatcgcgtgtttctgttctctgaagaattaacggtgggtgatgctgcccactcacacgagcaactctgaattaaaattaagatggtcagctgtattcttccacaaattcctactatattaatgcctaatttaagcaagatttgatggactgcgtgattcactaaacacaatgcagaacatgcacgtaagcactcgcgaattcagagaaaatgtatgggagggagcagatgacatcgggccgtgctacaggttgcctcggtgtctcctgcgctcctgctctctaggctgcgtcctgcgtgcgtgcgtgcgtggcgtggctgcccgtttcaggcttcgactagtggtaggtgagggcgacctgcggcgcaactttgaaatgcggccgtattgtggctctcaaattggccgaaaaacggatggttttttttgcagaggattccctgctgatttgtgattttcgtcgtgggttttggggggcacgaccagcgtccacacgtaccggaacaaagttgttctgctacagtgtttcactatgtcggcactcagcattcatacagtgaattactgaatcgtacgtttttactttttacctagtacgtgagactattttacggtagtttcagctggtaggaaaaaacgtagcataggagttggactcatagcaggtttttaaaataccatagattaccgctggattatcgcggttatagggtacgtcgacgtggtctaatatgcaaaaccacttgttatattagttaggtaaagaaaagaaaagaaaagaaaatttgagttcttttgttacttttctatcttaaaatatataatacttatacttcatttctcctataatatagcaagatataactgaatgagacatttcatagtaaattaaatatagactggtatctccttttaggttagcttttttgagacagatagagtacttgattcattttatactctatatatcctaaaataaatacacgtagtacgtaatgtggttccataaaaaaagtacgtaatgtgatttattctagtactatgaatctagactacttgtctagtactccactacgaatctagattcacagtcctaaaatactgcttgtccagatttgtagtatattctaatactgaccaaagtgcacctggtatataacatgacatattatagtattacgaattctggattgttacatgtctaaattcataataccaggatatatcaaatcacaaattaggtatatttattttgaaacaaagaaaatagaatgaatcgtatatatgtccagatttatactattaatatccatcctgagacagatatggaatcctacgaaatgttttatccgattatatcataccagtatattacatcatggcgcctcctctctctctctccaacccgggccgagcctctcgctccgtactcacgcacacacgcagcggcgcagcgagagaggaaagagagagagagagaggcaaaaacgacaccaacgggcggatttttaagtgcggccacctccatcctccccgtgtccgctagccccctcctccctccgttggtctccgcccacccagaggaaaccacccgcccccggtccccggaggaaagcttcggccatggcggcgacggcggcggctcggaggggatgcctggtcgcgcttctggcggtgctcttcttggcctgcgccgctgaggggggtgcggcggcggaaaaaacggcgcagcagcagcagcagctacggcggcggaggcatctgctgcggcggcagcggcaggtgcacagccacctcaggcggctcaacaaggcgcccctcgccagcatcgaggtagcggcccgtctctcctctcctctcctctcccaccaacatggcgcgcattcaatgcacgccgccttgctcgccatcgatttcccgtttcgttttttcttttcttttcttgctctggtcgctcgctggtatggaggggcggaaggaatgaatccatggaggtgaaaaaaaaagaaaaggcggtggtgcatttggtatggaagtcgcaaaaaaagttttgcgcttttgattgatgggtcgacttgctcgtgcttggtgatgagctcgctttggaagtgtggattgactgttcctcctcctctcatggaccatgcattggggtttcttccgttgatggaggaaaaggctcgcttttggaggaacattttatgggtgcccgtgcttctttgggttctctccacttcaagggaggaaagatatggttgctttcctttctttggaggagaacagactacagagtgtcttcttccttttctttctttcttttttttcctctgaaccattaacaaattttgcttttgttgctcaaagatttcttctttggagtatggttgatagtctacttcatggatgttttggattatctgaagttgcattggtttgatatatggaattctagaactttcttttcctattttttttacactacttttgctaaaatgagatttttccctgtctctctcaaatcattcatgtcctgaatttaggataatgttttctctttttttttcttgctttgattgcataattgacagtgtgaattcaacagagtcctgatggagacatcatagactgtgtgcacatctccaaccagcctgcctttgatcaccctttcctcaagaaccacactatccaggttcctctctctccagaacacaccactgcccctttttttacagttggggtaatgcttccccacatatcatgataacactcaatggtgcactatcaccacctttcagatgaggcctgattaccacccagaaggcctgtatgatgagtccaaggttgcatcacagcagaacacccagacaatcacccaaatgtggcacaagaacggcgtgtgcccggagaacaccataccaatcaggaggaccaagaaggaggatgtcctaagggccagctccatcaggagatatggcaagaagaagcacaagagcaccccaaaccccatgtctgtcgaccctgatatgctcaatgagagtggccaccaggtagggtagagtgtgtaatgtgttccattcaagaaccaatctccctaatagtacttaacatgttattgggattgttcatttaaatcttgtttctgctccatggtgcagcatgcaatagcatatgtggaaggtgataagtactatggagctaaggctaccatcaatgtgtggcagccaagaattgagcaggccaatgagttcagcctgtcccagctctggatcttgggtggttcctttgggcaggaccttaacagcattgaagcaggatggcaggtgagagggagaagaaaaacccacttaggtcaaaagttctattaaatgctttgttgcagcttccatttttgttcttccatgcgcccaattatgaagctcattcctccccttgcatgcgtcaataattcctgttttgcaataatgatatggtacactacgactggagaggcctttcattttaggagccagactagattatattcgtttacgaagattctttctttcatgagcaactgttttaggagctaagaatgctgtgatggccgattaaagctatatgcagtactctcttgcattgtggcttatgtctttattctctctacattattgcaggttagcccagatctgtatggggacaacaacactagactcttcacctactggactgtaagataaacatcacattcctttcaatcttcacgataattgttttttagcttctttttgtctcttgtttagatctacattcctatcttgctgttattaaactacagattagcctaatgatactgatttttgtattgcctctgtactctctgtagagcgatgcgtatcaggcaacaggatgctacaacctgctgtgctcggggttcatacagataaacaatcagatagccatgggcgctagcatctccccactctccaactatggtggttcccagtatgatatcaatattttggtctggaaggtaaaatacaagaaaccttcacatgcgtgtgtatacacacagacgaaattcatgaacggtgccagcgaatctatgcccacctgtttcttgttctttcctgaggcacctccagggcttaaggtcaaggctacaactgtggccctggcctgttttgtggacgcattcacagttgtcccccacacacgtactgtatttatgcatgctaatgcaaacactaatgatttgagttttaaacaaattttcacaggaatattctcctagagctcatgtttcttctgttaaaattttccatgtcattaccatgtgacattatgttggcatgccaccacttgcataaccaacaagatctcgctccacgtataattccgaaagtgggctatcaagctaaaataatttaaaactcgttttcatcaaagggtagatccttttcatagtgcatataatgaacacaaaaaggaaaactttatttttgcgcgtgcatgataacactaaaaggtacctacaatattcccttatcattatcctatcttctaactatgccccatggattgtggtttgcaggacccaaaggagggcaattggtggttgcagttcggtaatgactatgtgttaggctactggccatccttcctcttctcctacttggcagacagtgcctccatgatagagtggggtggtgaggtggtgaactcggagcctgatggcagccacacctccacacagatgggcagtggccacttccctgaggaaggatttggcaagtccagctacttcaagaacatacaagtggtggattcatcaaacaatcttagggcaccaagtggtattgggtcattcactgagcaatccaactgctatgatgtgcagaatggcaacaatggtgactggggcacatacttctactatggagggccagggaaaaacccaaactgtccatagtagaaatggaaaaattctatccatgcccctaacaaacccttgacacctctgtattatgcagtaaattagtttacacctcttctctttttctcctcttggtttttgttttggtttcaccattttcccaccaggttattaacttctaggtaagtgtttgacatgtgaaatttgttctcttcctcagagatgttggtctggctcttgggaggagtgcggtcaagtttctgaagagaaacaggcctgtttggttggttggtttgtgcacttgtgcctcatgttttgtcaaatattttttgttttctcccatgcatgccttcaacttgattgttggagccttggaggtactgcacttgttaagttgaattcaattaattaagctgttggtgcatgtgtgtggcctttggttaatacctgtaccagtatgggtttttctatcctgaaaaaagttgctaatcaagtgcttagctattggaatatgtgcaaagatgccaactttttgtgtgctacgtttggtggccacacttgggtcttctggaaagcggcattaaagttggttaagcatatggttagacctgggacttgcattctgtgaaggcaggtggagttcacattgcaagcaacagtgcaagcaccgcaccattgcttcagcaatcttcaagctcctgactattggtggccactgattgatttggttgtgagctgcctaactgaattgacatttttactggtctacggtttgattctgactactgcttctagtgtaaggcttttggatttcagtgctctagttgtggcatccagttcacaaatcacttgttcaagtcttcaagatgtaaggtttgattctgtccagctataacgcacaaggtgagatggaattcgggacgattgattttctggctggtcatttgatatgtttcatgccaaataacggtggaatgcagagcatgtctggataaaaataggagtactaaccagatccgttgacggctgcaattttgatattttagtccttttataaaactattttacaaactagtaacatgtccaagggccaaagtcatataattgagaattggttgggtggatggtgagaaaaaaatactggatcggtggttatgcttgtatgttttaatgggcagaccaatataagtgggatgggataggagaataattaggaatataacattggattcggtggttactctagcgaagcttactaaatgaggggaggggaggtttttaaagtagtaaagataaacctctaagaactagtaaatcgcaggaatggatcttctgctccacaaccgacactgaacacgagctcagtgctattgttaatggctttcaaggttagcgccgagtcgagggtcaaatagtttttttagtgcctagttctgaaataagttgtatcaaaggtccaaacggcaaacttgctgactgagggaataccaccaaatgagcttctgaaacatgtgagctgcatgattgtgcgaggaaagatggttaagaaaacaaaccacaccagaaagtaaccaaagcagcatgaggcttttttatttaccatgtaatccgggcaacatctcctctccagcgtttagctcgacagtagtacagtacagcacagccatggccgtagtagctcacgagcactcaccaagctgtctcaaaagggctatagaaagaaaacaagctgccttcacatgccacacaggggcccctgcttttcttttggttggattcgatggaaaataattacaccaacaaaatccagtcccaaatttttttcccaaaaacatcatatcgaatctttagacacatacatgtagcattaaatatagataaaatgaaaaactaattgtacagtttgcatggaaatagcgagatgaaacttttaagcctaattagtctataattaactataagtgctatagtaacccacatgtactaatgacggattaattagataattaattagacttaataaattcgtcttgtggtttccaggtgagttatgaaattagtttttttattcgtatccgaaaaccctcattcgtatcaaaaacttcttccgatatccggtcaaacgtctgatgtaacacctaaaaattttctttttgcgaactaaaccaggccgcaatgcaatgcaattcactgcaactgcaatactgcatccatccatgcatgcatgcagctagtagcagggctctcatcacaatctttctcactggctctgctgctgactccagtagtactgggctactagctgtagtagccagctgtgacagtggtgagcatggatggtttcgtgtgtttgcccagaggacaagaggccactgtggtattcatcaacctcttgacgcctctcttgtttgcaatcgcagagctcgtcgtttttcatccacaaacatagggggatccacta

SEQ ID NO: 40724 - DNA, 4917 bp, Oryza sativa
ggttgtctagtactgtactacttggcatacggcagagagaaagctcaccatctttctacttggcacaatcttcttgtacttttccgttttcactttcaccgagtaaattatcagggctaggaggaacacagccttttcatcattaaaagaggcagcaggagcagatcagagcagacatttagatctgtaaagcaatgcaactgtgtggatagcctgaattgttcagcagtagtagtaatagtagtatttgcgctgaatttttcagtagtatttgcagtgaaaaccatacgtgtttacggtgaaaatgccaggaacgggccggcattgaagacgatgggccaggaggcaacggcggacggggcggcgcttgttttcttcttgcattgacgcccattgcctgaaaatttcaactccatgttcctgaattcagagacaatttgcacctttcctgcttcatatgctcttgacttttggtagtagtacagtttttgataattcggtgaacctttctatttcaattgaatcacataagaacataacaggaagaggaatacacataaagttaactgattcttcagaaataggctgtctctcaatgttccaacgctaccaaatggacaggtgattaatactatcactgaagacaaataagtcataagccacaacattttctgatactgcaagtttatcattcttgaacatcatcatgattgatgagtggcacatgacgctcacaagtcacatcacacacaactatactaaaccatagactatctaaagaaaaactataaaccatagacaagcgttggtatcttttcaatggtgcacacacaggaattgtggggtagagtgatctttcatgttggcttctcgtagctgttttggtctctgaactctgaaatcttacttctgatcatctccgccacatgaggctgcacaaacatgtgtgtcgggtcaagcatgtgcaggatgaacttgtccgaagcgggcattgaagcattcagattaacaatgaactgtgccatcggtacatcgctgaaaaaaaggatttatgagttgattgtgcaaactagatagaggtgaagaaaaatgagctaaattttatcaattgtaaaaggagcttaccaggagatgaacaacccctttattgcattaaccatgttttctgctctttggagaacagaatgccacctgatcatttaatcagcaaaccacacagccatgtcagtggaaaatcagaagtactggaaaccttccccaacaatcagactctaaaacagtgatgcagtgatcttttaaagcacggtaaaagattgcaagtgaggagataccgagatagtggagatagagaccttactgccttctaacaaggataattatgagatcatataatgacaagcacccaacctataacttatgcttaaattgcttactgctaccactcaggtacataatagcaaggtgtgagctatgcttgaagaggcaataagttcaaagcaatactactggaagttgggtaactaacagaaatatgcaaaacactggagtggacagtgatttgtgctcccgtgccaatgatacttgcgatacaaacacagaaagtgaaccagcagtatctttcttatcttttctgtgcaacacatgccctcactgtgtgtatacaatgagacgacgacaaatttattactccatcttaggtacaaagctacaaaattccattagttaaagaaacagttaacgctagcaaattagttttacaggacgatttagcacgttgcgattttcgacctcggggaactatctcaatagggcaggcgaaaaaaaatcaacaggctcaaattgcatattgattgttgagataaagtagggttgcatcgggcagggtaatccaatggaagaaatacaccacactggtcgtaaaccttgcaatatatttcacgagcaagcataaatcagtagctcagtacgaatcctccctagagatctagaagttcatcttacctttgtcgcctccctgtgctgttgtcttctctagcaccggtgcgtcgttgtacggagcgatacgagcaaaccggcgaggaacaaggagcctgcagcggcggcggcggcggcgcgcggctcagggcggaggatcggaggcggaggtcaggcatagggttccgaccaacctgctggtcttgtttggatgaatcgggccaaggttaccccgtctaaactaggcccagatgtaagtggcctttcggcccggcccaaactatcaaaaaatcttaacaagcaaaatgccatcaacaaacacaacatttaaaaaaatgctattctactagtcaacttattgctattagtattagggttccatccaatccccgccgttaaaatgtgatagggttaacagagtgacatggttggaatcataacggattaacggtgatagcatttctaggataagttggcgcatgataacattttctaaaagttgagttcgtcggtcgatggtattttttgaaatacggttcttgtaatggcaattcatggatttttctcaaaaattaatatagatgaattcaccctatgggccggtccacaccactgtgatgatgtttctgaatcccacccctttgggctcaaataatgacaagaacagtggccagagaagctgccgcaagttgggtgaatcatcctttcgtatttgtacaaactacagataatgctccaaagaactacagataatgatatgacatacttgtttgtcagaaaatgtttgctacgtggtagcacatacgctcttcgctatagtaggctgaaatgaattaggagtaagaaataaatggcaagcatctggggacgggcaaaagagagcttcaaatcatcagtcaagcggtcaaaacttcagtagatctgcattgatcgtcggctggttggctcggcttggaggtaaagtccgaaatccatcaagaagttggctcaagactcaagagtagtcagatggtcaagaatgaatctcttctccggcattctgcagtagtaccaacggtgccacccaaaaatcattctatgctgccacttgccgatacttcaaaagatgaagccatgaaagtaaagctcatttctgcggttgtggtttcccaactgaatgcagatatacggagacagaaacaaccctgaaaattatagcatgagctgattactatcatgggttacaggggctccaatcaagagaatatgttgttcacttcaataagcacttacgtagatccgaggaagaaagcaagggatagatggaagccaaacaaaaagacagatacaactgctgtaagaagcatggcaactgaagttgagtacacctgcattacagttatatgtcagacaaatgtctgatgaaaagatgcgtaaacattacagtgttatcaaaatattttcagcagacagtaattggtgtgtaaatcaagtcagtctttgaagctgcatcaataattatacaagaatcttcagttgacattttatgaaatttagttatacatgtgcctcacgtatcacaaggttttgaatccaaaagagaggcttgtgcattatagttatcttttttcaacaggatacaatcaaccatccaatgtcctgtttagaggcctggatgatctgttcactaaaatagctcctcagacaggtatggaatatggaatggcatagtttctcatatatcagaatgtagaaaatgtaagtataaagaataattcaccagacaggcatgcgcatggacacaacacaatagaagatgttgttaaggtgttattaaggaatacagagatgtataaaacaaaatgtgctttgaggtgtaatgtatagtagactgtaagcgattcaggtaaggcaaaacagccgtagtgttgaataaaatgtaagatgtatttcacagtccagaattacttaaactcgtaacaggacattcacaataggaagatgcaaaatatctctattgggcataatccgctgagaaaagaatatacaaatgcaacatggttgaattctaagaccatataaatgcaacatggttgaattctaaggccatacaaatgcaacatggttgaattctaagccagctttagaagttcagcatttgtaccttgacaatattgtcagcatatttcatcaccattgatacagcaatgccactgcaaagcaaaaaaaaagtaaaacaatacaatgtggtatataaacctcaaaagagagcagacaaaacaggatccagctattagtacctgagtgcatgattaagaatcatcaaaacagtaatgaatgagtagccatgaaaaaaacctctgcattagattgcacaatcaagttaaaatggctgatagaatgaaacatatcaaaatattagcatgagtagatagattttgtcagaacaaacttattcatgacagcatcgaagtcctgaacacaaattgcaactaaattgaagagcattccaaaaatgtacagccaaaaattctgcacattgatgtttcttgaaggacgtttcttgatgattgcctgcattggtcaaacacgaacaatccacatcaaataaatcttcgtaaagtcaggtaaatataaaaggggcaaataacagtgtagtaaagtcacttacttctgtgtatacccccgcaaaaccacttagaagagccatcacctgcagaagaaagcacttccattaattccattggtggagtaaaaaacacatcgtgtaacatttgtaaataactgactgattatttccaatcctagtgactcacaattgccatcacccaaccttgaataggggtttgcagaacatgatctgacctggaaaataacaaattattttagtaattgaccatgatgttttgaagaaatatgaatattgttaagaatggacacagacgaatcataacatattttgct

SEQ ID NO: 40725 - DNA, 5906 bp, Oryza sativa
catgaggcaaaaaaaactacagactcttggtgcttaaagaaatcgacaattttggagaacggccatctattaagttttctctagtttggtttctggtgttgcttccccaagagaccaagatatgcgtaatgtacttcaacttggcaagagtaattattcaagtaggcaatcatgcagatattaggaacaaatcttaaaaagtaaggcgaatttttaaacaattcactttcgtaataaggactcttaaatctttcgattttggaaatcaagcactatatgagtatctcaccctttatttttcctgcacgagcaagcttataaaggcccttaggatcccttgactcacacaattccaagggcatgttcaagaaaacctacaaaaggggtttcagggatgtttgtgaatattcaaaattaaagtccataacaaagctaggtgcacttaaacagaagataaactaagaattgcttacttcaataaagctaccatctgacaataatgcacgacaagactcacggtctctcctatacggagatatgaaacttgcaatgcatactaggcctgcatctgcgaatagctttgctacctcacctgctcagaatagttggatataaatgtcaagcacagatgtgtcaaaaatgtaaaataacaacaaaagcattatcatatttttacctaaatcagaacttcattcaattgccacatgaaagttctgtgtcaggggatacttaccaactctgcgtatattttcagcacggtcttccgccttaaagccaagatccttgttcaaaccatgtcttaaattatcaccatcaagaacataagaaagcttccctcttgtatggagctctcgatctaatgtgcatgccagggtacttttaccttgacaatggaaggtaagagaatgaacttacttaaaaaaaagtaaatcatcacttggaaagttaagaagttttgttctgacaataaatgttaaatcatgaagatagaacaaatcaatagtgagaaactaaagcatcattcatgtagatgacgacatgtcagcttacagtacaaactctacagatttgcccgtcaataacctgaaagctatttccctggattcatggacagcaaaaaataggtacaatatatcatatattgacatgacactctgaaatgtagttgatcattttgaacagatcaccacctcttaaacacagttgaactcatcatggtttgtgagcaaaacttacaataatcgcctgaatattttaagggaaagttgctaagtagcattgtaaaaatgtaaaaattgaacagcaacatccagtgtgaggatcaatagcaggacctgggagcactgaacatgtcactgatgcatcaatattattttcctactcgtgtaatgttgttgatcaaattgcttcagtagagacgatgaagataaagtacaaaatatttcagtagttaccaaaccaataagtatataaatcattcaagaactaaagaaataaggcagtagtattttttgcattgcgtagaatgtaacaagattcacccaatattacatcctttagcccaaaatattgtaggatgcactttaagaacgttttatttgttagtaaagatatatcattccacatagacacaaattgctgttgaaattatcttatgcttgaacagctcagcagatgtgccaacatcccaagaagcacaacacaaagtttcaaagaaattagctttatttacctgaaccactaagtcctgtgatccaaacaacgcaacctttctgcttcagtagcttctgccgatcagcctggccaactgcacaatcatgccagaagatattggacgccttcggcacaattgatgacatttgcaaaactttgttctcgcccactgtgtaaaatcacaattactcagatcacagtgagaaaaagggctacacgaaagcagaaatttcttccaatccagttaatcattgtataacttcagaactcattgataagatagacttatctcctaaacaacagatctctttccttatgtccacaaagcgtaacaaaacaagctaactaattggtgacataagcaaagaacttggctgtctatttaattgtagtctaatccgttggtcaaaattttaggggaaaaataaaagatcacatcaagtatcagaacaatcgctgctgcaaaccagtgaccactagtataataggtaaacggattaaaaaagaagatcagtacccaatacttaggatacaagcccaaaacaatactaataaatgaagcagttgggaagattcaagtgactggaatttcctggacgacgaggagacaagccacggccacacgattccgcagtgatgcaatgcatacaaacgcaaccgaattcttccgccgccccaattccaccacgcgggccatggtctccccggtcaacaggagatcaaccgcattgcatcaactcatcgtgtaaacaaattaccgagagggaggagaggacacgcggggttggtagggcacgttacctaggctcacccccgcgtgcgccgtcgaagagcgctcctcctcctcctcctcctcctcctcctcacgcggtcgtcgtaggctgctgctgctgccgccggcgcattccaagggaggcggggctcggcggcgggggcgacgcggccctcccgtgactgcagcggttatcctcggcggcgcgaggcggaggcggaggcgtcggggaggatggggcggcaaccctagatttgccgggctccggctccgcacgggcgcggccgcggggggcacccagcgggcagtggcacgcgggtctcgcggaggaggaggaggagtgaggcgggccgcgtgatgcgccgcggtggaggaggcagcggggtggtggtggtgaaacgggagagaggcctccatcgatggaggccccgcgaatggggttaaccgcgaatggaggccacgcggttcccttttcctgttgttactactactctcccccaggccccagcgagagagctcgactaggatattaggcttgccccgtgctaaatatagcaactaatactggaatagacacgacttaatgttttctttatcttacaatatattttatccgtttcatattagatgctaataaatctagtcacacatatatgttagaaagtcttataacctgaaacggatatagtaataatctagtatcgaataatatactactattgtaatattgagatatatcttagattgttgttttataggagaaaagtattattacgaatttggatatatatggtaggttaacattagctattatcctgttctaaaatatactactacatatattggatttgatacatctacatatctagattcgtaatgctcgatgagattatgtctatgtttctagtactagctagatcgtgtctaatctaaatttagattatactagaaaatctgtgcgtctgttagcgcgtcggtaaatttatagcatgtatatcttatctagacctattgttttggaaaatttaccagcctttattttgaattatttatcactctagcaaattatgcagcaaattacattgttatgctcatttaatacattctagtggttttaagagtaatgttaaccttgattaccagatatatgtggcattgatgaaaggtgaagataggggatcctgatctagaaattgaaatgtgagaatgaccggtaatttgaaactggtgtagtaatatatttttacacaagttagtttaacacccacaaaataatctttcaaaaaggaaatattaattaatggaatataattttgtatttgtctcagaaagatggaatttaattttatgttagaatgaaaaaaaaaacaaagttggattgtaattagtgattgccaataattagacacatgattagagatgctattaaaaaaacgtaaagttatgtttcctcaaaattgtggcaatttttaagcaaaaaattgtgcatacagtatcaatagtgaaatgcacattcgaagaaatattggttgttaatattgcaaattttcatccaatgtttcgacttatttttgtaatttagtttttttatttatttcatataaatatgggatatcagtatggttaggtacgtaaatcaattttcgggtttaaccataatgtattttatttatttagataatttttgaaaaaatatatatattttttctttgttttttttttactttcgtttatctcatttatgcctggtcctgtgtgcacaattagcttgagaaggaaacaatgcaaatgctgtagcaacggcaccggacgaccaggcccaggcaggcatccgtgactgggctgtacacgccaatatatttttttttttcatttcacaatgaaacgtctaggctagttttctccacatggacacatggcagattcttggaggagacaattccaaatttacggagctccacgtggtccaataagaagtagagtttagtccctgaaatcggttatagagattttagcattgagagttgtagcaagggaaagttttgcagtttgcacaatacccaaacaaaatggcatgataagtagacacattgttctacctgtctacttcctccataaaaaaaacgcaaccaagaagagggttgttcaggttcgttgtactaagagatgtcacatcctgttctaggttgatttttttttacagagggagtatgtgttatggaagagatgagaagcaatgggaggactgggacatattctgtaccccaacctgaaaagcctcttgattcaccgatgtttggatttattttttttttaaaaaaaacacctacagtaaaggcgcacgcactcttataagcacatctacccctacaaacatcttcaaaacctgaattctaataaaattggtaaaattactatagatgccttgctataaatagttgcgtcgtctgcaagtgaaagatgggggcaatataattcaatggcgaaatcaatgggtattcttgtattcctggaaatacccaaatttttcattaaaagcataatatatgtagtatattatatgtatttatactcgaatgtgcctaatactttttttctcaacaaattcactccttatgcacttctagctcacaacacttcatccctccaggttgataatacttattattttggacaagagtacggtctccaaaaacaactttgaccattatttttcattataattcgtgtaaaagtattaataaatatatggttgtattaaagtacttttcaagactaacatatgcatgtagtcattatatttgaaaacaagtgttttaaaaataatttacaatcaaatattttaaagtttgatcttacccttatctaaaacgacaagtattattagtttagaggaggtactaatagtctagtagtcaactatctcaaatctcttaacactagtctatcaaacatcaaatccaaggtgcatgtaattatcaagtgaataaccgaccaataaatcatgcgttcgccaccggtataaatgagtggcaacgactaactatcatggtaggaagccattcatgcatgctttgggtccttggcgtgtgcatcatccagagaatggaaaactggcatgtagtcgtcgacgtattaatttgccggtcaatatcttccacaaaccaaatgacactactgcaccggcaccgctatgcagcacatgacgagacataacaacagcacgttgctgtaccctcttggttcatgtttgtgaagattagtggagtacggaaaccacttgctgatttactaaacagctataccgatacactaacatggcttgaagccttcagaaaataaaagaaacaaggcttgaagtttcaacattcaagtgcccccccacataacagaattaccactgctccaaaaccaggcaaaa

SEQ ID NO: 40726 - DNA, 3775 bp, Oryza sativa
cgccggcggctggtcgtcgaagttgagcgcgtagctcttggagtcgtagctgaacgccgtcttcctccgccgccctgatccgccgccgccgccgccgctcctcctcgccatgatctcctgcgccacggccttccaccgcagcttcgccctcgccgatcgctcctgcgccatgcgccggctatcctcgccgccgccgctcacgtccctgctgcagtactccaggtgtcgccccgacgacgccctcgacagcgaccgcccgaagcaggagatcagcccctgcggaatgaactcctcctcgcacgccatcgccgtcgccgccgccgccgcctggtactgcacgacgctagccattgcaagctagaccaaagagatccaaacgagctcagcaagacaatggcagcttcagcttcagctcaagtagaagaggaagaagaagagatggatggtaatgcagtgcagcaggttgtgttcagatctagatatataaaacgagggcgatgaactgtccgcccggatggcgccatgtctgaagacgagttgtttattcagatcaaagatcgttaaagaaatggcaagatgttcgcataatgtattcaactggatagcaagtgtaccggaagcgtcattgttttatcctgagcttggaggcatcaaggaattcttgcctggctttgaccagaacgtggttgcctggttggtgttgttcctcacactcagatctgtgttgctgattgaattgagtatgtaattactgtcagtgctaattatccgtaccatatgccttgatggcatctcaatccaacaaggcaacaacctgaagtagccaaggataccaaagtaaattattggttatctacttgatcttttgcctaaaattatcttagtaactagtgagatcaaaacagggtgtagcatgctagcatagggggttatctacttgatcttttgcctaaaattatcttagtgactagtgagataaaaacaaggtgtagcatgctagcatagggtgccttagttgaagtcgttttttgtagagtcagaatacttaattagtgtgggacaataccagtaagttagtggcctaatgatgttgggcagcatatgcatcccgcataaataaatctacataccgagcacgatcacaatgacagtaatatagtaaaacgacctatcaaactgagtcaacaaatctttcaccatggcaggtaaagactaaaatacacaaagtttcaggtacgattagagtttgatgacctctacaaggtaaagatcaaatgcacacccttagctgatactgtgatggtggccttcaacttacaatgcattgcctagaaatataaccaaaaaacaaacaaacaaacagagcaagtaggtacgatatctgcaatatattcaaatcaagtatccaacttgattaaaatcacacaacattattcagatcagcggcgcacatacgacaggtattcccagcgccgcgagcaccagccaacaagtcgtccagatgataaagtgcagatgctttatttcatcaatcattgtaaagcatgaatggagttagctgctgctaattggtcatcagtactaattatgctacaaagacaacatgtacaaacacctagtgacaaactgacaataggtccgattgattcatgtgaggcgaaatctacctgttggaccaaaaagacatgatatcaggttaccagatcttggaatatattcacaaaccactaatcaagatcttggatcatattgacctaaaatacccaaaaggagactgctcccaatagaccctattgcactgacagttggaattcacctgcaattggagctctactttctaaacatgatacagtggccgcagcatgttagctggatcatttgttatgtaaataatccaggaacaagacctgctccagtcagaacagtggatttagcacaaagtatagtagcaaatcaaagaagtgtcaataaaaaaccttgctaggcaatactgttggttccaaaatgaaaatatgaatgctagtttcacattgtgcactgacctaacactgaaatatcgctaaatttgcttacggagatcttaaatctaatcaaaacagatgtccaaagctcaatctgaaagtcaaaaggacaactagtactcataactggatacttcataacttcaaaagacaaaaatgtgatactgtcacaataatgtttccgctcccaaatgttatggcacagatttctcaaaaaaaggacaattttcacaagaattcattcagaacttcaagtgacaagagatatgagctctgtttctcaaacatgaatcatgagcaagcatatctattggaatattagcaaaggtgactcgagcagaagaaatggcatacgatggatttataatttataaaatcaacaaaagaactagtctatgcaccagcagaattcaataggttagaggttacaacttacaccctgataccagcacatggtagctagaaaaaaaagaaatattatataatctcgtacccctgcccaatatcagaagttatagattaattggatcaaaatatcattttccttggcatttgtgttacacattgtatcatcacccaacttaaaatccttcaagtaagtttaccaaaataatgtttatagagctcttagtccaaaagtttgaagcatggaaaagcaaataaaccctgccacaagaggtcaaacattgaacattaccatttaatagtactctttccactaataatcaataatgtaggctagccaaatcatagcaaacctagtaccattggacattggtacaattcaccatcgcatacctgacaacatgaaaaaagtactgcatttcgacaacctgatcatgcatcatacatcactcaaatactgcattttctattatcacacatctttagaaagaactacccaaagtcaaggtgtaaattgaacttcatatcattgcgaataacctttctttcaggaaaataaaatctgatccgagtctcagtaagcaacttctcttcaggtgcaggaggtagatttaacacattacaccaacaaaagcattcctagatcgagtctcagtaagcaacttctcttcaggtgcaggaggtagatttaacacattacaccaacaaaagcattcctacttacttaagattaaacaaaactccatggctgtcaagagaattcaagtcgcccaaaaaagaagctgaaaacgaacgaaaccttcagttccacttcaggccacgagagtgctcgcggtggtggagtcgtacttgaagaaggcggggatcttcttggcgaggcggtagtagcgggtgaggcggtgcaccctgctctcgacgaggatgaggcggaacttggtgtccttgtccttcctgttcctctcgaggtgcttcctcatcgcgacggccttcttgatgaggaagtagaggtcctcgggcacctcgggcgcgaggccgcgggacttgagcacgcggaggatcttgccgccggtgacgccctgggcgagcgggacggcgtgggcgtcgcggaggatcgccccgatctgcgacggcagctggcccttcttggcgacgcgcacgatcatctcctccacctccgacgcggacgtcttgacccaggcgggagcggcgcgcctgtaggggagcaccgagcaggacatccccttcccgctgctgtgcatgcggcccatggcgtcgagcggcggtgaggcggagcgagaggaggctgcggcggcggtggcggcggcggcggcgacaaggagggaatccac

SEQ ID NO: 40727 - DNA, 3278 bp, Oryza sativa
cggcctaataagagcccaacttaattcttagtcgctaatccacctcttcggagcgagatactctgaagaattcttcgtcaaagattcaaacaactactacctttctgagtaatgatcaaagtttaaaaaattgatcatttcttgttcgagacgttaaatatttatgatcggagaaagtagctgatagttgtgcgcccgtccatatacattgtactacatgattttgaattaaaatcgtgtcctttccacatctatgtcaagatatgactgtagctagatgtacaggtccaaagtttacggccaatggtgtcggcatgcacgactcttttaaagcattataattaagtgactaatgacgaggctgctttttcagaaagctgctctgatctgcaagacgtatgacagcagcctggactatgtgattcaagcaaccagaaaactcgtgcatcagcgggctgtcgacgagccgagctcaagcgagcttgctcgatacaagctcaaaccggcctataaaatgttcgatgcttttaaataggcttggttcgagcttgatttttaagtaaaataatttatatttcaaggataatctttaaaaaactaataaatatatgataccaatacaagacatacaaaataacatatttgatctcataatttattaaataacaacaaaaaaaatcatatattactaggctcgttagaaactcgagctcggcttgacaaagctcgtgagggggaggctcgggctcggctcgtatggagctcgaatcaagcctaaaacgagtcgagctcgaacagctcgcgagtctcaagcttttttgacagcccacatcagccgtatcatatttataaatgcatcctttataacaaagtaatagtatgataattttatcaaaattgaggtaatgtataaaagtcatgaaaaaacatgcgttccgaaggagcccatgatgttagtagtactggatttttatattttggtcctttataaaacttaacaacaccagtgctgacaccctcacccctgtggcgtccaaaatgtagaggggtcggcaccaaagagactagcaccggtgacctattttttaaatattttttttgaaaattatcccaagaaaaatatttacatcataaccctttttgagtttttttacaaataggtactcggtctactctagcgttgagaataagggttcatttctagaataagttttttcataagtatatttataaaatgagatctaaaaagtcctaaaatatagaaaatcaaggttagtacgaagtacatagcttagtttccctttctcggtagacttatgtttcaattatactctctctgtcccaatataaatacaattaagatcggataagacatttcatagtagtataaattagtgtacttatattgggacggagggattataaaagacgtgcatactgatgcacatcatattgaggcaagcgatagcttcttaaactcattaaaatcctcctaaaaatgcacttgagtgtacataatatttatgagcatcatcataatttgaaaaacttatagatagagccataccatcacatcaccggtgcttcctcaccagaaataatatataatatagaactttaaaggcaagagctagagaagatgaagtgcatcacacaatctacatgcaaaggctgtatccctgaagaacgaaacctgcttagatacctgtttttttatgcatcatgattaagatatactagatgcctatgtcatgtggctaaatctgcattttgtcgaaaaaaagggaaaaacttgtgtgatattgggaacagcgaattttaggtatatagacaatagacttttgcatctatcaagcgttctagtaatccagttctttactacttcctagaaaagcaactacctcatctgcaattttggataaggtcataggctttttgatgatctactcctatgcttgcttctgccaccaataagctttttcctattttattttcttggaaggcaaaaagaagttaggttgacccactaggctcatgctatacgtaaatgaagtgcatttctcaaaccaaagattgacaatttgccctacaccttcatatgagtttcgaacgtatgagttttacaaaacttccatagaaattagatcaattatcataaatatcctctcaaaccaaagattgacaattttcctacacttctacccttgtgactcctttggaactatgaattttacagaacttggaatttctcaggctgtcaaatactagtattttcagtactgaaccacggccaatcttgtgtgatatttgtcttgtggcattatctgatggacaggtacactacagagaaacgtgtactgttttaatacaagcagtactatcaagtcttcagaattaggcaggtcagcaatatggcatgcatccatgagggcaggcaatagactgatagagggtgccccccttgtttctcctccaattcaatgaactttgggacaggagtacaggaccatgatccagaagatgaattattcaatggcaaaattaaaaggctactctgcatttcatctcctaccaccctcacctcaccacctcaccctcctgcctttgatgcttatctgaatctccttttgcagcctgaatataaaacactcctacctttgcaaagttgttaggttaacttgttaagtcactttatcaggattgtgcgtgttccttaactgtctgtcacttttgactcatcttcagacactcattttaatgccaactttcagtgaccacaaaaactgtctatcctaaataatggagcccacttatagaattatggataaacaattgttgtggatcatttgatttgataaggtatcatcaccactttctagtagtagtttagaccacagtttttttgcatgtgtctttgttcatttctacagaataccatatgccatgccaaaagtatcatgaaatgacacataaagggagaaaagaaatatcaccttagaaccccaaataatcagatatatgatgaccaaatcttctccacaagttatccatggatggagatggacccctttgtcctgctccagcaagacgagctggcagtagcaagtgagaatattagtatcaggtagcatgtggtgaccatcctttgctctacacaacacacacaaattgttgccggcaaaagaggtttcttaaattttctataaaggtggccgttcctgtgacgatcaaatcattttttgtgtgtcatttctgctttttttttctttacctcaaaa

SEQ ID NO: 40728 - DNA, 6757 bp, Oryza sativa
agtaagaacatagcaatctctaaagatatgaaaattcaatcctgctttggcttgttggatcatggtgtacaggaatatatctctttggcagatgccatggtgagtaaactaggccgcatcagggaagcaaatgtgtagcagattgcacctgatcatcctaacaagagaccctcttttatcatccaaaaaatgtaatcttttctttccaagacaaaaggcaaccctctaaattctcaagctaggaagttacacacagctctggcatatccacagatgacccagatgcatttcagtttcttgcctacatagctatacttcatattattgcatacaaaaagaaccaaagcaatgtacactctatactctatggaatttacacggcaagaaagcatttcaggcatcaacagcatttagggttacagattttgttcttgggagatttgttggcagctgagctcctgtgtagtaactcctagctgtaaacatgagatctggactgctctgtgcatcaacctcacaatgccgggccctttgggctcctggatcggggtgccggctatggtacgctagattaaaaatgtcagggtcctcctcagcgtctctagcgcctgggcttcgctcgcaggtcggtatgcggaaattgtgattcttaccaatatgaaaagactgtaacttgttcagtgaagacttcatcctcctttctccattcaagttgtcaaagtccagagatggatgaatagctctccttagatgtgccattttccgtgctttgtatttggccatctttacttcatgcttcatgtcgaacccttttgcttggaggctagtgtcatactcatagtgccgaggtgagcaagactgttcctggaatgaactaaaacaaaactggtcacgaggacctcttctacccatttgtacaaacccattactgtgtacggcttcctgatctttgacatgttgtgtttggccacctccatcatcagagctgcctccggagtcctgcaaatcggtctgctctccattggcttggaatgttatctcctcaaaccgcccatgtagctctgcacactggcaacctcgagcagcagatgacatgtaggcataaagtgaaccacatgacgatacatttgatccgcagttatggcagtatgtagtgtcttgagattcctctatgcctgggccaggcctccaatctggcaccagtgcactaacctcgccatcaatcatctcagcaattcgagtaacctcatggtcagttatatctagctcggctaccatctcagttgcaacactcaatgcggtatcggcctctatgtcaaaaggaaaatagatgttccgtacatgccctgcaaagtgagaaattagatatcaagaataatacaatttggcatttttttggtgcactgaatttaacccaagaatttaaggaattgaacatttgtgcataccatcattatctgcaatccgtaatctgaggaatatgcttccatcctcactttttctccctttgattgtgatatccacattgccaagaggctcatcttcatgcccattgaacaagtcaataccatcagctttaatgtcatcatcttcacaatcccatctatcttccgttggtgtatcctcgtcaatgctttcagataatccattactcatcatggagacattactataagcgtgttctaaataaggctgccgcagatagttcatcaggctgtaatctccatcacccggacaaaagaccaaatcgtcaacctgcaggaatgggtccttgagcagctctctcgctgagagcctccgggatgcagtggccaggcatttctcgacgaactgcctcaccatcggatctttgaccttgtacaacgcttccggcttagtaccctatcagccaaaccactagctaaaatcagcaaaaaccgtttcgaactagccacacaccagaatcacaaagtgctgcaaacattacaaggatccaggaggcaattcttacagagatcactttcttgtagatctgcaccgggtgcgtgcactcgctatacgggtactcgaaggtgaccatctcaagcacgcacatcccgaacgagtatatgtccaccagctcgttgtactcctcctcgtacacctctggcgccatgaactccggcgtgcctaaccaaacaatcccacacctccaccccaatcaaattcccgtaaaactactgcaaattgggatcacgagcacaatccagtagcactatctagccaatcagagacgccttacctacgcagtggacggcgtgggacttgcggaggatggcggcaaggccaaggtcaccgatcttgacctccccctggttcccattcacgaagatgttgtcacacttcaggtcccggtggatgatgggtggatcatggctatgcaagtacagcaatccactcagaatctgcctgcaccagtgcttcaccgcccatatgttcaccctcatgtgcttctgcctatacctaatcagtaatcaccaccacaccacagcaaatcagatcaatccaagaaccaatcacacacacgcaaaaaaaaaaagaaaaaaaaagattccgtcttttacagttgggcagggttgggcaggaaaaaggaacatccttttgggagattgggctttgaggcgtgcgttagcgttattacagcgtgtggatgaaccgggagagagatttgatttgcttactggcggagggtgccggaggtgaacatctcggtgatgaagttgatgttgcggcgggagacgtcgacccaggaggtgtagaacttcatgatgttgcggtgcttgagcgtcttgaggaggtggatctcgcagtagagccgctccaggtcctctgggctctgcaggaagtcgtgcagcttcacctggttccacgccacctccatcccctggtactcgtcgaacgccctgtacctgcacaccaccacccctcgcgtcaggcgagaagccgccgagcaaaacgaacaagatgaagaacaagaacaagaagaattatcttacacggtcttggacgcgcccttgccaagaacgtcgttgtactgcacagcaaaaagaacggatcagcaatctggtaaaaactcaaaagcaagatagaatcaagaaacggaggctgaaggagatggtgccgtacccgtccgtaccggccggtgggatcgacctcggcgtactccgggaggtcgccggcggcggcggcgttggccttggggcccatcattctagctcctctcaccctgaagctccctgtttcttgccgcgctgtgtgctgctgctgctgctgctaggaaggagagtggatagggactgaggagggagaagaagaggagaggattgatgtagtaggagagagaggcctggtcgaggagatgtgggcacacatggtggtgtggtgtgggcagagagagagatggagatggagagatttgatcgatgtgcacgagatggatcatggaaaaagtcgagataaattttttgggtttttactggtgtttttacctgagattttacatgcctgggatttctcctttttttgtgattattataacgctgacaggagcttgggattcttgatatggtcgttggttagttggtgattattcaattggaggggagggctgggctggctgatcaccctcatgtggtagcaatgacaatcaaattattttcaggctgggattgtcggcgtagcaaaacaagatgcatatatttttgtacgaacgcaagatatgtatggtttgtgttgcaataaacaatttactgttatagcaaggctccttggaataaagtggttttaaggatttttggaagacttcaatcctattaaaaaaaatccccaatgtggtactttggatcaaaggaatagccatccaaaaatcctacaaaatttctttggattggcccaaaacatagaaattttgaaggaattttaacataaggtctaacctcttgaaaaaaaaaatcatttgtgcttattcttctctctttttgattccaacgcttttcccgtgctccatctaaacagtcattcttgtagtttttttttgaactttttcaattcatatggtttgaagtgttaggaccttccaatcttgtatttttcatttacgtattttgaaaatcatatattccaaacgagcccttagaatgctaataactttcacctatgcgaccacacgtatatgcattacaatttttactcgattatatggatttgttttttttccttcaactctgtcccctttagaacaaaggaatttgagaaaaaatttgatagattggatcctatgtaaccatttggaacaaaggaataattgctcaaattcctttaaattcttttagattgtgtcaagtcataggaattatgaaggattatcaacatgaggtgccacctcttgggaaaaaaaatttctgtgtctgtcagtctcgtttgattcctatgtttttttttctactcaatccaaatgatcatttctactgtttctttgtgtttttttctatctgtaggatttaagataacaagacacttgaatttaaaggagccattaagctgatgcgttccaaaggagccattaagctgatgttaaaaggatatttttcatgcattcgtattattttgtgtgtacatgtttttatataattggtcaaaaacacttggaaaaaagtagccagcaaaaattatgatatagttttttaagcaggatgtgcaatttatggcaatttttgtttaaccagaagataaagacaagtgcacccttaaaagtaataatagttttaaagatggaagcaactatgtcatcaatgttgcatttttatcttcttttgtatgaaaggacacctattaataacaaagaaaatctagttgcgaaatcggtcatgaaaacccatagagtataaattattgtgggtcctttcttgttgtccctcttgtcctgtacgtaccaacaaagaaaaaacctgccttgtgctgagttggagagctcacttcatttgtctgcctcttgatttcgaaaccgttctaaatgctatgcttcccccagcaagcacacttgggacatgagggtacatggtggtccattcataaccatacaaatcgatgcaatgtatatgcatctgtaaaggtagttatggcccatgttcaacaattttgatttgtgcttgcctcatttttggtttatacctccttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctggtggatctgtgcgtgaaggaatacagagagccggagagcgagagagagttcaggctctagaacccattcgccagagtccccactcccctcctttctcctcctctcctttctttttctaggcctgggcctcctttttatctggtctggggtcaccacatgggcctcctgctgcctaagaagggaaacatgctttttacaatcagggctagtctacagccggaagtgacctctgacaagcagagcacacgcctcctgccccgctcgcccgcttttccggtggacgcccatttcaaccttcatttaatggccagcgacttccttgccatactttcgctgaagcctggaatggatctgaccgggactgacataccaactccaggagttagcatgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgctgcattaaatgcggcgtggcgcgctcgtccaacctgctataaatgcggttaggtgagcccgggtgggctcacctaacgcacagacgtggcgccaaaaccacagggggtcggggcgccccagccctcggggccgaaacgggagcggcccgacccctcggggagacagagggaggggtggccacgtcaccctcgggcccgaccccttccccccccgaggggggcaggccacgtgggtgaccgcggctacccaagcctctatagtcacgatacccccggccccatgtcaccgacagtagcccccggcgttacgccagggcgatcgcccccctcgagggaagcgctcggacgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgtgcgaatcgggacgagccggttcgtttcgcctggagacatgatgatggcgcatttcacggttggcgggcgtagttaatgcgcgcacgatctgcccatctcaaccgccacggccgcacatctgccgcatgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttctttcctctcgccactcttccccttgccttcgccacttgtgctctaactcttcgtttaacacgg

SEQ ID NO: 40729 - DNA, 18348 bp, Oryza sativa
  unsure (1)..(18348): unsure at all n locations
cgggctgccgcgccgattcatgccggaatctgccaccggccgggaggtggtcgcgctgggcgagggacgcccggcgccacactacccggggcggtccgtcttcttcctctctttcgcaatggaggggctggtcccgccattctctatttttttcatggatattctggagttttatgatctctagatggcgcacctcacccccaacgcgataatgacgttggccatcttcgtgcacctgtgcgagatgtttatcggggtgcgcccatttctccggctgttccggtggttcttcaccgtacagccggtgtcgccgccgacggcagtcggtggctgctacttccagccgcgggggcaggtgctgaaccgctacattccctgcgtcctccgcaaaaagtgggacgactggaagagcgattggttctacacccccctcgccgacgaagcgcgcctccgacttctgagccagcccccggcgcaggacttcagctggcgggcggcggtagatctgggagacggctacgacgccgttcttgaccgcctggcgggtctgcgatcccaggggctcacgggggccatggtgttcggcgattaccttcgtcgccggatcgcgccactccagcggcgcgcctggggcgcctgggagtacaccgggcccgaggactacatgaggacccaccaggggcgcaaatgggactgggaccctgaggacttcaggatggtggtccaacgggtgctaaatctcagctccgtggaggcatccctcatcccccaaggggtcctccccctctgctgcgatccagagcgcgccaagatcctggccatcatgcaggtggtcggggcgtcgagggagcgggccccccgaggccacgatggcgcgggcgggagccgcaggggggaacaatctaccccgggagggggtcgtgcttctgggccctgcgacgggggccgggggggcagccgccctgccgacgcccgggggaagaggaagcaggagggtacccctcccccatctcctccccgagggggcggggcggtgcatgccagcagcaggcgcccggagggtgccgtgccgacgccgcagccccagggggagcgaaagaagaaacggctccgcaagatggaggggatcgtgccatgccgggggaacctcatctcgcccccgaggtggtcgtttagccgacctccccgcaggttcgtccgcgcgcccaccgcggccgtattcattctcccatctcccaaggcgagttttcactcacccgtttctttttgtcttctggtttttcttctgcctcagcgagatcccgtcgcgcccccccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccgccgggccggggagtccgtccgggaggcagaggcggcgcgcgcacgctaggcggcctgccaaacccccgacccgactccgcccgaggcgacgatgacttccaaggccacccacgacgaggccgcgggcgcgccgctcgggcccgacccctcgggcgacgcttgggacgagccagcttcgggggacgcccccgagtccggcacgtcgatcggcgggccgagccgcgcggcacccacaccgagggggctctcccctctgccttccgctgccccactgagcgcggagcccctcctgcaggccttggccgccgcgaacagcacggtgctggacgggttaagtgcccagatggaggccctgcaggcggagcgggcggagctcgacgcggcgtgggcgcgcgtcgaggaggggcggcgctcggtggaggccatggtggaggcgggccgcaaggcacactgccggcacgtctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgccgccgctgcccgggaacggcgggcggcggagaacgaggcggcgtcccggcagcgcgaagaggcccttgaggctcgcgccacggcgctggaggagcgcgcccgcgccctggacgcgaaggagagagacctggcggaccgcgaggtcgccgtcgccacccgggaggcaacactggcggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatatgggaaagcgcccgcgccgagagggccgcactggatcagcgggccggttgacttcaaggcgcgggcaaaggagctggacgcgagagcgcacagcggcggggcggtcgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgccgggcggcaggcgggcctctggggcgggcggtacgcgaagtacgccgccaaccaggggggcctcgcccagcgcctctcagagatggccggggccctcgagcggctccccgaggagctcgaggagacgatgcggacgacagcgacgacgaggccgacgacccgggcgcgtcggagtgagcccccaggcccccgccaatcttaataacttttccttcttcttccgaggccttcgggcccccttcttgtatagactgatttaatctgcaatcaagtaaagaggaaatttctacgtcagttctgtttgttgtgtgtatgagacgaggatggtctgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaagaaaacgatggcacagacacagtcctcaagaaatcgaaaatgcttttattgaaatacggaagagaaaaaaggtaagtatatgcatgtggtagcccccggccaaccctgcacgcccagggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggatgtggcgctgatggtagcgccgcaggctctgttggtagcgcgtggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccatagacgaggaagaaaggcgtttccccggttgctcggcttggcgtggttaggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccaagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcgacgagaagcttgacgccttgttcccgaggaatgcacttcaggaggactctgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgacggctgggctagcctttcttcaaaggcgtccggtggggtctgggctcgcgaggaagcgagccttgagagttcatcggcgaccgcgttatcccgtctgggcacgtgccgaagctttatcccgtcgaaatggcgctccatacgccgcacctggcgcacgtaagcgtccatctgcgggccagagcactggtactccttacagacctagttaacgactaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgcttggcgaggtcaacgtgacccccacaccggcgccctgaagagacagggagccgtcgaactgcatcacccagtacgcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaactaccgtgacccgatgcgcctggaaataatggcgcaacttcctcgaagccatcagaatagcgtaaagcatcttctgggcctgagggtatcgggtcttggcgtcccggagggcctcgctaatgaagtagacgggccgctgcacctttcggcggggccgatcctcttcgccaggggccgcatctccagggcgctcttcgtccgagaggccacgcggggcgcactcggcttctgtgccgacgacctcggggtcagagggcgacaggcgcggtcttcccgcagtggccccggagccatcctgggggtcgggggcgcctggcaccgtcggacaagcaggcggagggccagctccggccgtcgggggccttgggccgccgttcggctcgggggcctctcctccctgctctctcccgggtcgagtcgacacagggtgaggacgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatctgctctatagctcgtatcttctcggggttggcctcgatgcctcgggcagagaccaagaacccgagaagcttgcccgcaggcacgtcgaacacacacttatcggggttcagctttatgcgggccgagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccacgcgaatctgatgataaccagagtatgcatccagaaaacacaaaaggtcgcaccccgcggtggagacgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacgtatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcaaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtgctgagcctctcgtcgccacccgcgggcttggacgccgcggcaaggtggtccgcgcgctgctccatacaagcaagcgcgactttgaggtcgccatggacgatgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggatggccggaacaccatccccggggccttgatggcgtcaaaggctgcgggggggggggggaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccttcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcatcggaacgggccgaccccttcttcctcctcctgtcccgccgccctgaccgagcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtccctttgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccagtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtgggtggcgcgacgagcgtcgcgccggcgctcgatatcgaggcgggcatccggccccccacgcacatcttcttgggttggaggcgttgacgagggaatggcggacgaaaacggcaggtaaaccgtgcgcgncgcgtcgtgcgncgcgncngnncncttctactcgnctctgncgnactgaacgnntggtagtactcggcggactggcaagcgcctagaaggcctcggctggcggaggaaccgcccgccggcagtctcttaaaggcgctgctgcgccatcatgaccaagtcggccacgtcatccagccaacgtcgggctggagtctctggatcggggacgacgggcgggtgacgcaggagcgcgcccgcagcctggagcgcgccctggggagtgccgccatcgccgtagacgaggcggcgacgcgccccgtctcgccgtcctcccccgtcgcccgcgggcggcgaagtcgcggatccttcgacctccccgagcgcctccccccgcccaagatttcggcgagagggggacggtggggtgcgagcccgacggcgcgggttctgctccccgtcgtcaccgctagcgttcggagagaggctgtgcgccactgccagataggccattgggctgagcgggagaagcttggcgcacacgaaagaggacgagggcttagaaagacacgcgcgccccctacctggcgcgccagatgacggagcgtggggctcctcaccgggagaccgcgcaggcccccctttgctggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctggtggatctgtgcgtgaaggaatacagagagccggagagcgagacagagttcaggctctagaacccattcgccagagtccccactcccctcctttctcctcctctcctttctttttctaggcctgggcctcctttttatctggtccggggtcaccacatgggcctcctgctgcctaagaagggaaacatgctttttacaatcagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgctgcattaaatgcggcgtggcgcgctcgtccaacctgctataaatgcggttaggtgagcccgctgggctcacctaacccacacacgtggcgccaaaaccacagggggtcggggtgccccagccctcggggccgaaacaggagcggcccgacccctcggggagacagagggaggggtggccacgtcaccctcgggcccgacccccccccccccccgaggggggcaggccacgtgggtgaccgcggctacccaagcctctagtcacgatacccccggccccatgtcaccgacactcctatacaagctaaacaattcaaatgcaaaatcctttttcttttgagaggaaaaaaaacaatccaaacatactccttttcgttccaaaataaattaatataatacgaaatgtgacatattctaatattgcgaatctggatcggactacgatatgccacatcacgtactagattaacttatttgggacggatagagtatctagttgcgatcacaattaacatttcacatttttttccgccttcccagaggtacctactgactgaacagagtgaaaaatatcacctccatgtatatgatcagaaatctattatgaacctcgataaactaattgtaatgttttccacttggtaaattctgtaagttttttggagtagtaaagacttgctagttatgtttaaattaaaaaataaaatgggaggtccagaccttacaaaggttcagactttagttaacatgaaatggagctaaacaaatcttgtttgcctttccttttgggcagaaaattttatcccttgcgcatgcatgagactatgagaggggcagagagaataactcaaattaaaaaaaatgcagtttataatatttttcctgatcacttgtgagccaagttgccatgttgttccttatccttatgtcctcatgtggcatgcttcagttcctgttcattgcgttttttccagctaaaaaaacgggaaacgcatatgaagccactacatcaataatatatcatgccgtgtaaggattactctcaaaagtttgccttgcattcttcagtccctagtcccttgttaaaataacttcagttccagagtccgttgtcaacacacaacgaaaattgtgcgtcactgttaccatcttttggcgattttttcttttgctgcttatttgatatagagtactccatcgatccctaaaaaccaacctaatatatatgtgatatattataatactacgattagaaatataattttatattcgtaatagtattaaaatatgccacatttaatatagattgattttttatgaggcggagtacgacttctttttttttttcaccgtggaaggttctggacgggggtgatttcttttgtcaatgtgggcggtatactggaagttggaacctagcgctggtaaatgttttgacgcgactcggtgacaacgaggttcagacgtttagtcggtgagaaagttcggaggagaaggaaggctccagccacccggccagaatctcctctactctggtccacaagtccatctcttctctcaactgttcggtgaaaacttgataattgaggtattactattaaattactataacgaaaactaatttgtgaagatatattatactattacaatgatatttctttagcaaataaccatattttgttgcaacgatttacgatcgttgttttattcaatatttttgttgcaataggaaatgagttatcgtcaaaaaaccattagtgttgcaaaaaaaaaacatgttctatcgccaccgttttaatttttgtggtaatttgcataacacatggttgtggtaagttactttttttactattttttgttgccacgatcaataaatttgttccaacaaaaaaatttgttatctcataatttaacttactttttttcatatggacactgattgagacaaattttatataaaaattatagctatcgataaaatctacaattttatatgtgacaattttttcatttgaaatctttagatactcaaatccataattctaatctcagttaggtaggcacaaatggaaatatatgtattttctaacagaattggtacacaggtgaattagtgacaataattatttattgcaacgatgtgaagtgttgcaatacgattttttttgccacatcattttgtgccaatatccaaatttgttaccactaaatataaatcgttacaacaacctattagcactatatttattatcacggataacagcgatttaaaaatggtggtaatatgtatctattgtcatgattttagtattgatgccatatatttttttgtgataaatcaattttctagtgtgtaaggctgtgtttatatagattacaattttccaactttaccttatcgttttttacgtgcatatgctaccaaactgttaagcggtgtattttgtatgaacaaatatataagtttcttaaaaattaaataaatattttagtaatcaacactcgattaactatatgttaatagcttatcttgattcacgtgttgtcgaaaagctcaacgaacgaagccttaagctcgtgaaataatatgggtcattagaacataattaattaagtacttcactattacggagtacaaacttgagagatacatttatttatttacggaactcacaaatataaattcattacataatgtacattgaaaaacatgatgaaatagctcaactaataagctgaatcaaatatagccttaaccatcagcaaagatggaatcagtacagatatacgacaccacgcgaatggcatacgctgattatcgcacgacgtataccagaaggacttgtcgtcaaatggctaggtttattgtgatataatacgtacaccggcccgagtttaaatattagaattggtacgaatgctcatatttacggctaattatttcttcggtaatatgcgatatacgtattgatatcgagatatttgtgatgattttgttaatctcaaaatataatgatccgttttttaaatatgtttataaggataaatgtacgtgtgttttgagcatttacgtttgtaataaggactcccaacctttcaatcaccaacagctcaagaaaacagatcgtggtggcaaattaaaactggcaaggctttagcttttgctgatgcagaactccgctacttccgaacaccatacgccggtgtttaacatcatctgctacagtacccccttatcacttgtagctccagataaccaacccatctttcaccaagcaaaggcaccacaccaccgcaccttttcccccgtcatcaaccgagaaatcctgcaacgcgccgcgcgtgcgcgtgccgtgcgtacgctgcgttggctcgttggctcggcgaaaggctcccggtgggtgccgggccggggcccgatgcgggaggttgccgcgtcaaacgccgggagggcaccggacacgtcgcgtcgcggggccgcctttttttttattttttgcgttgctttttctccccacgcgcacacgatcgagacgtcgcagtcgcggctgttttatttttttttcttcgtcttctcggggtgggtgggtgggcgtgccgcggccgtacgagctttccggatctccgtacggggggcgtgtaccgccacgcgacccgggggtggggggcttggctgtggggtggggcagcgtggccacgaggcccgcatgtgcgctgccccgtcgcgcacgcacccttccccgccccgaaacaccgcgcgcgctgctgcgcccgcgagccgcgctcgtcgtgtcatcgctgcgctgcctcgcgctgtgggggtatcaacatcggcatgcctgaacgacggcctcgtggtaggaccccagccaccggattcgccacgccgggcggacaccagtagccacgcagcagctagtagccgcctagctagctactagctacttggtagcaggactgggccgtcaaatttgaaggctatgtacaaaggtctaagtgaggcttaaattaagtaccaaatataaataaaataatgtatatactgtagaccaaatgcgatatattaaaaatagtacattttttaactcttgttttgtaatcagaaaccatctaactgaaaacggagaatgttcgttgctgttgctggcttgctgcatagtgccttgcttgttggttgctcgctaagttgctatttgccggttgaatgaaaatatgaaattggatgagccggctagcggcctggtgctcggagaagatgagacgtccagactcgagacgaattgagcaagtcaaagatacgaaaagatgagacgtccagactcggggctcggagtcgagaatatgaagcaccacgcacccgaagtcaccgcgcggagacacgcgctgactcaaacgggcttctgacactctagccccacgcgaatacacgagccttctttggttgggatgatttttttaggccctgaaaatttggaggtcctgcacggtcgcacgggccgcacgccgttgtgcacggctctgcatggtagtagtaactagtaagggcttgtttagataaaaaaaattagctaaaaacgttacatcaaatgtttggacacatgcatagagcattaaatatgggaaaagaaaaaaaaacaattacacagtttgcatgtaaattacgagacgaatcttttaagcctaattacgtcataatttgacaatgtgatgctacagtaaacatttactaatgatggattaattaggattaataaattcttatcgcggtttacaggtggaatctataatttgttttgttattagtctatatttaatactttaaatatgcacttaaaaataattttggccaaagaactaagcacggcctatgtcgtaaaataaatcaacgtaggtactattctgattcgctgtattgccagctagcattgttaccaccgttatggacttattatggtaaatttggttaggggcatttgcaaatttgccaccggttttttgaatattgcaaggataccactcgaatgacagttctagtggcatttttgcaattttctagtggcagttttgcaataataattcaaagtagtggtaaatttgcaattgcccctgttcggaagcatcacagccgcatgtcctaagattgattaggcatgcatggaagtactgatttttttttcagcaagctggcaatgacctgctaaaggctgagtttagttccaaacttttttttcaaacttctaacttttctatcacatcaaaactttcttacacatataaacttccaacttttccgcgtcacatcattttaatttcaaccaaaccttcaattttaacgtgaactaaacacacccgaagtttttctttccctaggagtaactcgctggagttgcattggtattccgtacatcagtctaccaacaatcgttaaaatagaagggtgggaaagctgctgaagaaaggaagtaatccagtcttattagaggcaagttgtttatttgcctaaccctagctggtaagaggtaacgcaatcgctagacagatggctgcaagtagacgctctcggctctcactaatttagaaacgaatttcaaagctgactggtccgtccttacgtataatacgtagttgtacacctgaaccgtgttatttgtaatattttaaatagcgggctaaagtatttagcggttagcttctcaaacaactatagcggaagatagtggcagctacatacaatgggagatttaaaaccctaattatttggtggttcataacgcgcaacagtagtcacgaatagtgatagtcagatggtgtcacattctagcaaagcatatttcaacattgttcagcaaataatacaatatactaacaggtcacccgcgctgcttaataatagtaccagctaaatcgtgatggttgatagtacagcctacaacactctgcatatccatagtcaattactaataagtgtcacgacactaatggcatgacaaccatattatgcacttctctatctaattttaaaatttattgcagatgtatacacatgacacggtagttacccacagacaactcatgcacatatgtacgtattccatatgatatgaacacttgggactttacataattcttattcaaaaaatttacgtaattataatttattttgttatgagttgttttattactcatagtactttaagtgtgatttatatcttatacatttgcataaaatttttaaataagacgaatggtcaaacatgtgagaaaaagtcaacggcgtcatctattaaaaaacggagggagtagcaaaataaccatgctttactatggtaaaatcccgcgcttatttgatatatgttattcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcctgagttaggagtcataaccttacatcatttaacaagcgaaaatatagtacgtagtatttcttttctcaaaccttaatctctactaaaaaatactccctccggcccaaaataagtgtagttttgcactattcacgtttaacatttgaccgttcgtcttatttgaaaaatttttatgattagtatttttattgctaatagatgataaaacatgaatagtactttatgtgtgactaaatattttttaaattttcacaaatttttcaaataagacggacggtcaaacgttgagcacggatatccacggctgcacttattttgggacggaggtagtatataataacttttctaaaacatatgaagtattttacatgtgcttaaaaaaagtcataaatttatccttagtaaaagcaattctatatcagagtatcggtttcacattctctaccacaatgaataatgatactatcattatagacactgacatgtggggtaataggaaggtaaaactcacattaggggcagagctaaaacgagatgcacggagaaggtgccacttgtttaatttgctctgcttaatttatatcaagtttaaactaatgcgagtgtttaaatttgtattgaagggggtgcacatatggttgaaatagatcaggtatagctacaaatttatcttgattgagttcttgggcaccccctcaatgctctagctccgcccctactcatatactagtgattgtaatggtataagtgatattatgtagaggatcctcaaccccattcaccacgtttttaaacaaaaaaactagtccaagctttctcatccttatccacccatattctcatccacccgatcgctccgcctccgtcgccatccttcttttcgcgggcgccgggtaagcgccttacgcttcgaccatgccggcgtgacgccagcctgtctctttgacgtcgtcgtcgtccccaccatcgccgcttcctcctccaccaccgacgcccacgccgtcagcagtggtgatgacgacgcgcgcaggcgctcgtgccgcttcactcacctctgtctccctctcccctccactcactctctctctctccctccctctctctttctctctcgggagaaggctgagaaggtggagatgaagccggccgagaggaaggggtcgtcatcgtcgtcgtctccggcggccgaggaggatgacgacggcgcggcctgattggcaagatcaccctcaagctccccaagccaggggtgatcggcgtctctctggcttgccgtcttcgtcggtattctcatcggctgggcaaaacgcccacgctgggctatcgccgttgtcggggacaacgaacagccgccgccggtcacccctgctctgctccatcgcacgtcgc

SEQ ID NO: 40730 - DNA, 4216 bp, Oryza sativa
ccatctaccagtcaatacccagtaccaaaggtaccaggtaccagctggtactcaaagtactaggtgctagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcgatgaagaaaaccacacatggcgatccacgacgacgacgacggtcggcacggaccaaacccgcccgactgattggtgatttggtggaccggggctccagcctccatcaccttggagtagctgtagctagcagcggctacagcagccaaacggccggcgtacgtttccagcgcaagaaaaaccgagagagcagcgtgggacgggacgggacgggagctgggggagaaacggaggacaccgagaggcggaggagaacgaaaacgagaggcgcgggcgcccccccgttttgtttttgtctagctcgctcgctcgcgcacgcagcacgtacgcagccaagccaacgactggtgccacacgggcgcgcgacacgcgctcacccccacccacttggcctgttggccatcgccattcgccgcactcgcgacacgacgaggggatccgtcctgaccgggagtgaaaaggagggctgaaagttttttttcgcttgcaatgtagcgagcccggcagtacataggacggtaggagtatatacacgtccgttttttttttgttttataatggaacgaatctcggctctttgctttaaaagaagttacattcatttattacattctctcaatgagtaaacattcagttaacttcataatgactgattgaaaaacatcaacactaaaaatggaaaaaaaattattgaaatcttttgtaaatcttcatccgaaattaatgaaaatctacttgtaacttgtaagcttcaacatgcagcatatattagctccatattctcttcatatttttgaagttgtgtctaaagtcggaacagtgcattgctcggaaatgagatgaaattcgatgatatgtatgaatcctcctcgcgcactgaaatgttggatggtaatacacaacttgaactagagaaatcgtgtacaacttgcttattttgtatgttaataattattcttttggagcatagccgatgtttttccggtgcttgaaaggtactagaggtccgagtgtcaatagttggaaaatacccctatggcaatgtttggctaatgggaaatggaaatgatttcccacccataaaaagacatctttaaatcttaactattcattctccctctttcatttaattctaacccttcattcatttcctaattccaatctcatcctccatttttcgttatccaaacacaccctatgtattgatacttttcgatgatgcacaattcctatctttttttttcgtttgcatagacatataatctcgtatgtattatgaattaatttattcggtgtattacgttattattattttttgaacatgctaaatgtttagacacgggcagataaacctgcaaaatggcataaatcttatggtgtacatcatgctatataccgcaatcatggaacaaagacaaaatgtctatattgtactccctccgtttcacaatgtaagtcattctagcacatttctcatatttatattgatgttgatgtatctagacatatatatctatttagattcatcaacatcaatatgaatgtggaaaatgataaaatgatttacattgtgaaacggatgaagtactggttgtcacactataccatcacaccaatcaagcgaagcttgcatcaacgatgatttaaattttacaaaaaaagagagagaataatttgtattcattagccatttcatctaaaagtttaagctgaccgagaaagtctggtaaatatccactcgtatttcaacaaattatttaaacaaagtctctatttgaaaaacatcaacattcaaaaaggggaaaaataattattgaagtctctacgcgctaggtcgctgtcttgttaatcgatcgaattgaataacgtatcaacaaatttcttcgactcaggcaagcaccaagcagatatcaacccaaatcgatcgcatgtcgtcacacacaatctcctttcaccatcttcacgtcattcaggacaggataccacaccgtgcgtatcacgcatttgatatgcgagtgcgctaatatacactcccagtccgatcgatttggcagaggaaatttcatactttcacatacgtgagtctgcctaattgctctccgaatgatctaattgaccaaacgacgagacgagtagtccccggagcgccgctcacgctacaggacgggaaggcggcagccggaagccgcaacgaagccggaaaccgttgagggccctttgaatcaaagatttatatagaaatttaataggatttaaatcctatagaaaattttcctatttgaccctttgattcaaaggattgaagctttctaaatcctacgaaattcctatggaatggcacattgcatatggattttggaagaaatataccaagagctctaacctcttgaaaaatttcctttgagtctatctctctcatccgatttctgtatttttcctgcgctccaataaaacgattatttccgtgtttttcctgtgttttgcaatcctctgttttacacttcaattcctattagaattctgtgtttttcctattccttcattttttcaaccctgcgattcaaatgggccctgaagctagcaacttccaagctccaaccgatagacaactctgtccatggtttcgctctcacgggcgactcttgctgcaccttgcatgcagaacttgtagaatcgcgctataggtttctccaatctccaatatacgaactcgcaaaatcatttcaaccttgtcgacttgtcttacgttgttcttgtgtacgtagagcaaagtacagagaagtacattgctcttcaagtcttcgtccagatggggggtgagagatagagagagcgcatcactttttagccttttgttgcgcggacaaggctaatgtttggaacgctgtctgtctttttcctggccatgccgggctcgtgagattcctggggaactgcccaatgtttcagacgaagaccgtggtgcacagcactggtgccgctggaagtaaaactgtactacgctcgggactctgaaagtctgaactctgaaacctgaccgtgaccggctagagacgaacgcgagtatacgcgacaagtatgcagactttgattcacgattcacgtgcccgggctcagcgggtgtccgcaaccatgcaaacggcggcgtttccggtgcggcaaagctttggcttcttggcgcgcggaacggcggcgtctcacgcgcgcggcacgcccgtgtgagtgggatgggccggtgggcgagcggtagaggggaggggagcacgcggcgggttgggtttcgctggcagcagcgcctcgccttcttgggctctcagcctctcaaccaaaatgggctcctgcgctagctgcagcctaccgcagcacagtgcgctcggttgggtggtgcctgccgccgacgacccccgcggttgcggcgtgcgccgtgcgcggatgcgcccatgccacgagctgtgaactcttaattttagctcaaagaattgggtctagattctatagtgaaattgtgaagcaaaacccagctccatctctcattttaaattatgctgaaactgtttgactgagcttcggctttaagagaggtgaaactaaagctgtgctaaacatgttcttaataaaacatataaaaaaacaggtccctttcgcatcgccctaacaccaccatagtgtctgtcaggcacgttgctaggccaacaaagttgcgagctatgaatctatgaagctgtctcacagtataacagagtatgaacactgagcagcgcaaaaccaactctttctattgccta

SEQ ID NO: 40731 - DNA, 3650 bp, Oryza sativa
tgcctgtcattgaacacaaccaaggatgcaggagacttgtctcactctcggcagcatcagtagacagatatatgactggggcgttagctttctcaacgattcgaagaatgcattctgctgcctgagggatagggaagaagcagctctctttcttcacattactgcaggaagatgagaacatatcagtaaatgcctcattattcaaaaaaaaacatagccaacttgttgcatacatcactcaaaataaccacaagcacatagtattgcaaggaaagacttgagcagttgcgctagcattagtaacatttaaactactcttagtgcatggcacaactgcacaagtcatatatcatgctcaatcaactcctatacatgtatcaatcagattcctttgtagtattgaagtaacacctagtagttttttttacagttacaagcttaaaaacaagttatcttctgtaaccctttttgttgatggaacacaaaatacttgttatttatttgttatactccctccgggctgataatattagtcattttggacaagggtaaagttaaactttaaaatctttgactacaaataatttctaaaatatttatcttaaaaatatgaaaaccatatgcgtagattagtcttaaaaagtacttcagtaaaaccatatatttgttgatattcctatatatattataatagaaaatagttatcaaagttactttttggagaccttgcctttgtccaaaacgacaagtattatcaacccggaggaagtacttgttatgacatagttctgacccaacttattatgcttaattaaaactagtcaccttcaacgaattttgttcctcagtaacctgtaaggcgctgagtgctaattagtgaataccaagtgctctagtagaaagtgtattaggctcaaatagtgagaaaacttaccatgacacttaaggacactgcctcacaatgtgagaaccaagtgcagcaaccagctccaaaatgggcaacaaagatgaatgaatttcccttctatacaagtatgcagctaattattttcaaaccatgacttgggagttaaagtgttctgctggtcacatgttaacagcaactgatgtataacttaactgaatgtccatgaattctcaaatactgttattaagtcattgaagataacattatttatagcttggtatgaattagttgaaaatcttgaaccaccaatcattttagtcttgtaagcaccaaaattctaagaaggtatttagatacaaacattccaggtaaaattctcaaaactattgccgtaagatataaaattaatacgggggactgatttacatcagctgaacaaagaaattaatacagtactatgtagtacttactcccttcgtcccaaaatataagaacctcgtactggattagacattatctaggaccacgaatctggacaggtccagtactaggttcttatacttgggatggaggaagtacaagatagcatttaatcgatttgaagtagcaagaacaacattatttcagtatgctagtcaatgttagcaaatagccaaacattgtagctcaatattatggacaatggctacattgcgtcctagaagatactagtaaatttgttgttaaccaggctcttcattggctgcatcagaacttttacgaaggcccaagtcaatctgatcaaggccagaacatacaagttgacttctataacattttatatgcttagatctaagtgaagcatctaggaccagctccaagcgctccctatgaaatcaagcgcctggtttctaactttcaatgcaaggagctcaacatgaaatcaagtgcacatctctatgtgagttatttaatggaataaaacctatgcttaattgaatgtccatgagaactgagcactaaaaagatgataggattttctctaagccaacacccagcaactattagaggctaattggcacgatcttcttgtaaaatgtactgcagccctctcaataattaaacatatctgtattgctaaaacatggaggtgactaaaaacgaaaaaggtatcttaccagaacttcaggaagccatgtcgccgaaaatgcaaagcaatgtagttgccccccaagaaggtctgaacaaagcgttgcgcagtgagcataataagcctacttggctggatcaaagtattgcacttgtgagccaatgggccaccaggctgcatcacccactcttcctcaacatcagcatagaacatgtcaccgatcgcgagcacctcagcatccgtggtaaactttggcatgatatcctccacaaatctcttctttggctccttcagcttcgcatcctctggccaagctgcctggatctttcccagtgaaatccccaatcccttcaacttcttaacatgatcctcatcaatgaaacaagggggtgatgccgcgtaacatatgaactgatcaatgctcactttcttcctcttctctgtgaattcctcataggtaattacaaccttccttccaatgcaatcattaatgtggttgatatcaagcacccggtcgtactgataatccagcttctggctaggcaccaccaagatccggccaagcagcgccgcgaagaacatgtgcttctccaagcaaatcaagtggttggacatttgcccggagacgcagatggcgaacaggaatcgatctttcttggggttccactctatggtccgccggttggacggcaattccctcctcctgcacccgtcagccggcagatcaagatccaacccatcctccgtcgcattgcccgcagcgccagtgcggtgcgcggagaggagcgccgcctggatctcgcggttgatcttgatctggccgaggagcgcgtcgtggagatcggcgtacgagacagcgttcgagcccgagctgctgccgttggtgggtgctgccgtacggttgaagagggcgaggaggcccgagcgctgcgagcggaggaggtagagcgcgcggagctcggcgtcgcgcatccgggacgccgcggggtcggcggcgggagcggcggcggaggggaggcggatggaggcgggcaggcgaagggaggacgcgccgccaagggatacgaagagcacgaggaagaggacggggagggcgacgaagaggaggaggtagcggcgggaccagaggacgcggccgagcgaggcggcggagggagggaccgcggcgcggaggccggcgacgtggaaggaggaggagggcggcttgacgtggttctgcgggacgagggtctcgaggtcgtcgtcctcgtcggagacggaggggtcgcgatccatggcggaggagagtgtcggtgcggcggggtggacggagtggggaggcgggaggggagggggagagtgcggagtgtggttagagggaagaagcgatggagattggagggtggacgatggcgactgtcgaacggtggtctgctgctgcagaaaatgtagaaaaatgttttcctgaatgctaatactactatatctgtcttatttattactagttcttttaattaattgtactagtattgtgcatcaataaagtagagagcatgaagtcatgaccatcatagtgatttttgcagtgaacacaaactatgccaaaaaaaaatgtggaagtgtttcaataaaata

SEQ ID NO: 40732 - DNA, 7278 bp, Oryza sativa
catatctttaattggtttttgcaagctaaactcgttgctaacttcaataatctctccatctatcatttctactctaagtctatactactggtatccatatgttatcatctactacctcttcttcttccttctctttattcccctttccctcttctcctactgggggcatccctaagctcctccttggccctctccatctctgtggtggtgacgtccgtgcaaaggcgaacagcgacggtgacagcggacaacgatggaagatccatgagtgcgtggagcgaggtaaccaacgcgggagaaagggaggttgttggcgggcacggtgaacagggcgaggtggctctagagactgcacattgtggcggtgcccatgctacaacggagctcgagctcgccatccactcccaaccccattgtcgctgtaggcatccccacaccgtctccagtaaagtagatggaggagacggcgacgaatcctgagtcgaatccatacgggggaggaggcggtggaggtcgtgcgaggtcagaggcgacggcgagcgggaggccacggtagcgaggaggcgcgttgaggcggagtcgagggagaggcgctcccgtcaacgccaaccgctcccaaatgaaggaagaaagagaatagaatgtagtgggacacgaatagcaagttgagtaggctagttaagtttggcaagtgagagaaggagtttgttagcggatgacttggagagtgggatggatggactgttggtgtgcgatttttatccataattactaaattttgatttaaacagtgggatgaaaaggttgctagagatgcttagcatgctgcaaagtactacataaaactctgaaaccacttctgatttctaaatagctgctacggttgctttgtgcttgccataagaatatttgggaaaggaataacataggaaatccatagaatttgtatcttatagaaaataattatacgaagtcctttaaaacaaagtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatagtcccgtgtccgtagctaatcaatggctaatccacacggtcggtgaacgttcaagctgtccataatctatcctgcaggggcgagccacaaaattccatctgtttcaaatgccaggatttgaaggatcgagggtctcaagggaatagagatgtcgtgatcaagtggtcagctcaggactcaaccaagttgcttgccgttgctcttgatgcaccaggagaggcagtccacgagagtagacggcttaaaccacgacgcatgcttgatcaactgggaatgttcgatgcttccatccccaacatggtacccgctgattttcgttctttcgccgcagtcgaaacccaggtagaccgtatcaccggtgacggagggaaatgtgctcggagaaatcgacaccgaccgagacaatccgatgaacacggcgcggccgctcaggctcctcgccggaatcagcagccgggagtccaaatccatccggtacaccgcgtactccctcctgaattcgtcgtggcttacggttcggtacaccaggatcagctcccgcccgccattgtccaccaggtgaaggctgtcgctcatcgagcagaaggagaatggcgggtcgatcgtcgtgtcgaccgccgtcagcatgcgcggtggctgatctgagctggtggtggtctccggtgtcatgataccaatggcggtggcatggtagatgcggccggcgaagggcaccgtcgagtagagcatgagcctgtggtcgaagtctatcttggtacaacgcttgtcgccgggcttggcgacggcgagtgtcgtgggggatttgagatacgctaccacggtggaggtggaggtggaggaggagtcggcaatggcgacgcctctgacccggaaatcctccccgcgcagtccctggtgggggtcgttgcgctgctccggcgtcaggaccgtggcgaacggcgggagctcggtgaggtggcgggtgagcgggttcagcaggcggacgccgtggggggcgtccttgcggaacagcaggaggaggccctcgggggtcaccatgagcaggtcgtgctccgcgagctccggcaggtccgtgtggatgcactcgccggtggcgacgttgaggaagcggtggcggcggcgggcgacgccttgtcgatcatgatccaccgccgggggaggaagcggccatcaaccgggccgccgccgccgcgcgggctggcgcagcagcggcgccacgggccgcacacggcgcggaagcggacgtagtcggccacgtcggcggcgagcaagcgctccgcgatcaacccggctggcccttccgccagtctctcctgcaaaacccgaccgggtcagattcaattcaaataacacaacacgatttgaacagaaatctaatctcaaagtaaagaagaaacacgatttgaacagagcaaatgaagcaggcggaagtgttttggggaggagggggggggggggggttaccaggaaggatcgggaacgggggaggagccgtgcggcggcgggcggcagcttggagcggccgagcgcgctcgctttgacccccaagacggcggcggccgcttggagcagcaatccagcaggtgatcgccccttcgtttcgcgaagggggagcggatctgggcctggccgacggcgccggcgccggaacaggagcggagctgagcgtcgaggctcctaggccgcttcgcccgcctaggggcgtccgctgtctgcgctcgggtggccgtttttcgcttccccatcaaactgagccgccgccggcggcagaggggatcggccggagcccggaaagggaatgggttaatttggtgtgttgtttcgggcgacagcgacgcaacacggcgcagcgtgacgaatcagtacccgtacgcaaccaatttatgcccacaccttttagcctagtactccgattcgtcgtatagtactccgattcgggccttgatccagcgggctggctatctcggggagaggaagtcggacttagcgcctagcggggctatgaccaggccagcacgggccggtccgatgtaagccgtaccatcctgacacttgggccaaaatcaagattcgtttggttgggccggtatttcgacccatttcgctcagcccctgcgacgccgcgcgccccgtcctactgcaaaacgcgtccgctcctagctgcgatgcaagccaaccagcgagcgtagtacgcccgtatgcgaggagaggacggcgaaggttgcggcgaccaacaaggtccagtttagttcttaattttttcttcaaacttttaactttgtcatcacatcaaaacttttttacacacataaatttctaacatttttctttaaacttttaattttagttaaactttcaattttaacgtggaactaaacacagcccaactccccaaacctaaaaacccaaacccaacccaagtacccaaccaccccgaggttgacaaacaaaccattgcacgcgaccccgcccggaccgatggaaaaccacccgccacccgatcgaaccacggcatatcctcgcgcccgcggctcacgcacgcacgcacccacacacgtgtggccgatggtcaaccaaaccatccctggctgctctcgcacgcgaaccacacgagtcatccatccaacactgatgatcactactctagcttagcttactaccccaacactgatgatacattgatactgcttctacaatatgcacaactttactttttctcgtcgtcttcttttcttttcctttttttcttgatatgttcttgctttttgtatgtacaaagccactggcacgcgtggcccattgaccccggcgatcaccaaccgagcgttacatgtgccgttcctttttcgaaaagtaaaggagagtgacaaccaaaggaaaaaaaaaaaaactcgcttcctagctcgcagtgtcggtgagacacatccgagctaagcgagagagaggaggagctcatcggcttatgcacgccatttccgtggctcaaaacgttggcgaaaatgcgaaagaaactgaaatgaaaacgactctctcgctctgttccctaccacggcgaagctgctaacaccgctcgtcgtcttcttatgtacaccgacacctctttgctgctcgccgcgccgccgtcggttacgtctcggagcgccgtgctcgtcgctcggacgccggcccggaagagttcgtcatcgtcgtcgtcgccgtcgccgccgtcgttgtcactgcttcagccgcagcggctgcgggtggtggtggtgatggccgccgccgtgggaggactcgacgaggatggaccagagtatctgcacgtcctcgcacgggcacgacttcacgtcctcgtacaggatgtagatccctctctctgcatgccaccacacaaaccaaaacacaacaatcacaaacaagaagaagaagaagaagaagaagaagaagaagcgagaggatataggagagatcgatcttgacgtactcttcctctgggcggaatgcatgcggatccagagcttcttgagaggcgcgaggagagactggagccagcccatggtcccagctactaccactcgcctacctctgcaccctgaattcaccttaccatgcattcattcacctcagctgctgctgctgctgttgctgcagctataaccaagctgaaaaacaggcagaggcaaagcacaccaatatatgccttagctagccatctacctagccatcttggaggagtggtcagagaagagagaaagagaggaagagaggaggagagttgcagtgttgcttcgaggctgggtgaagctaagcctttctgcctcttaatcctctgctttactattcctttctcgcaatcacgttgccctcctccctcccttgcatcttaatcacaggctttaacattcttggtaccgcgtcactgtccatccatatcttcccatgaataaacaacgggaagagagaggccaatgtaaatgctgctggatcgatcgcaaaaaagaaaaaagtttcttgcaatcgaagagagacgagagggagaacactggctctgttaggtcttatttaagctttctggtcgatcgatcgccatggcctaccaccgtgtcaacaatgcgagccacgagcgtattcgccgatggctttcttttatatattgagaattgtactggcaaaggggaggttgaggaactattatcaagccatttccgtcggcacgcgatgtaggaaaatctgccccgatccgaccgttcgaatacgatcgaacggccgagatttcagctgttttcagagtagttccagagtcttggctgaaatgtaaacatcaattccgtcggtgaacggtatgtagcactggtgagaaatgaactttgtgcctacatggtctggtgctgcagcaggtcacatccaaaatgctgagatttaacagggcgtctgttagagcatcaccattgtaccacgcgagccaaatggacagaaaacaaaacaaagaaatataaaataaagatgatgaaacgatgtgcgccctgaataggatggtttaagtatcttaagagattatgagaaggaaatcgagaagagaaactgacctgttgttccagtagttgcctcttcactttctcccgtggagagaagcttttgctccatcagcaattctggagatctcatggaccccatggaaatggaagggaatcagtggaatgccaagtcaaagtttttattctggccccacctctggtctcataatgtggcaatatatatgggatattctttgcttgtgcaaatgagctcctcaatgctagccaacactgcttctagaaattgagtggtatcttatgtgggatagcactgaagcaagtgtttcttgtaatcatgtttgttttcttgcacctatcatctgttaggtttaaaatttgtactatgacacactcaagaaagtcatgtaaactgcagcagcatttattgttaatgtggacatactttagtgtgacagttactgacaaaattgtcacaaatactgtattagctgaatcaaacatggtagatatgaagaacgttgactgttgtactgactggaactattgtagttcaggataaaaaaattaacattatccttgtagtagtaggtgtatgatgcaactttgcttttgccttttttcccccagtgcacatccagttaaagaaaccaccaatatgaaaatttactaaattaaggagttcatggaccaatatcacaaagtggtggagctcagcgggccatcaacaaaagggaaacaaaattgactacgaaagtcagtacttggataagttcttgttatccattctctgtaaattatagtagtagagaaaaaatatggagattaacaaatacagggtaaatttaataattttaccagcaactgaatttcccatcagtaatctatattattggtttggataattttaacttatgccttcaatctttaccaatcctctagtcatcaaggatcgtcaaaatgcagctcacagcatgttcagagttgcacttgtgaaattagtgtaggatcataaaagatcaaacaaacctatcataggggaggtgaatgatagggaaaaccaaaaatccaaaaatcttttgcggaattaaagattaccctcaaaatgaagtagacgtcgaaaataacattatcaaaccaccaatattttcatcacaaaatctaaatcaactccttgattttacaattagttgattattacaattacctttgctaagacaattaacttgggagttggcacagaacacagcaccagattttcttgattcagtaatatatttctactaagcctcacactgaacatgtagagcacaagaatggaaaagttttcagaaaagcatcatttttttgctttgcttcttggatttgtgatcagaatgtatatgtcaaa

SEQ ID NO: 40733 - DNA, 5207 bp, Oryza sativa
aaatccttgcacaaggttttgtcaggcttgcatattcttactgttaggattcattaatttacggtagaatggccgaagaaacttgtcatcatgtttctgcctattcggtcttccatgcattaagtatcaaagtgaagccaaaacgatgcgcttgaagctccttttcattctgagagcatgaccttgacagcaatttttccatggattggcctgactgaaacaagaacacggcacatttattcgatgaaccaaatagccagtcatgaacatcccataggacctctactggaagtccatcaacatagactgtctggtttcctctgaacttccatgcaagtctcttcacctgcatgactctcttcttgccaatcctgatttctaggcttggatccttcaaccccgatgtgtcacactctatggtgatatggtggagctgaccaatgtccaaaaaccgggccttcgctgaatacaccttcttcccataaacatgttccttcctggctatcatgacagcattggaggccaatacatctgacgaaaccctgtgatccccatccttgcgcatgtcgccgagcacaagaacagcttcaagatcacagaccagggcaacatagaagccttcgacgggttctggcccggccgcaaacttcgcagaggacaggtcccagacgatatccagtgctccaccatcgacctccatggccttggaacctttcctcttggagaacagccatggctttatctctgccttgcaaaggcaacgattcgaggagtcgtcgactgcgacggacagagcctgccccatggtcatcttgctccaggtgacggtcacgctgcaagatttgccacggaggcgggctaggtaggtgcactgcaccatgttctggccacctggagaagaggaatgggcgacctggacgccgctttgacttaagcaagatgcaaagtctctcatcgtgacgatggcgacggttgcaagttgcacgcccaccttctcctttgcggctttctgacgaacacctcgtgcgcaaccgccctacttatcactcacaccgtcacacgcacactccgagcaggctgttcccctcggttggaatctggattcaaaacatctgcttgctccgactgacggctgaaaagaagtgaggaaaaaacgatgcatcaaatccgcatctttgcgctcgatatcccaagatttccccccaatcaaatccacgcctgttaacctggaatctgaaacaacagcagcaccgcaaacaaatcaagaacccgaagaacggaacatcatttaggaactcccagagatcaaccagagaaggagcagccatacctttccccccgacgaaatcaagaacaccaccggcgaagaacggagcagcgggagcctcagcaatcagcagcggacactacagagcaaagccggtgggcggccgttttcacctggccggctgcgccaagaagaatcaccacccacccaaccgctccacaagcgaacgtgctccttcccctccctccctacccctcaggagcagtaaaccagcgccatcagcaacaacagcaccatcatctctctcgctctcgctctcgcttggtccgttaagcttcgcacttcacagcagtacaggagtaggagtacttctgtttgtagcgtaggaggctcaaccaaaagcagaagagggcgggaggaagaagacaaggggaggggtgcgactgcgagggcgaccgccaccagcagcagcgtggcgttggggaatgtgggcagcagaaaagacgcggaggcagacaggcaggcagcaagcggccgaggcagacagggcaggctcttgggtgtcgggaggtggagggcgcggctgcactgtccagtcgcagcgagaggtcgccttcctcgcggacatgtgagctccacctgttcgcacttcgcaggcacggcctaaaaccccgtattatacgggaaactttggtcttctcgtatggaaaatgtgttgtgtagagagggagatgagaggtgccgatcacaatacagtgtcacgttgtatacagtgtatgccaggaacttcgatcgacataggtagtcctcgttcttttcttagcatatcatgtcggtttggaactttggataggaactctatgccgtaagagcaagtttaatagtatagccaactactagctctaattttactgagcaaggttaacggtgattttactgagcagatcatgccaaccagaggattgcgtcaaggggatccgatttcgccgtacctgtttttgatatgtgcagaaggattttcgtccctgttgaatgctgctgaagaacgaggcgacctggaggcgacctgacgggggtgagagtatgtcaaaatgcgccaagtattaatcatctcttgtttgcggatgactcattgctgctcctaaaggctgatgaacggagcgcggggtatctgcagaatgtgttgtctctgtatgaaaaatgctctggccagactatcaacaaggagaaaagttaagttatatttagcagaaacacgagggaatctaagagggagtcttttagatatgccttagatatcggggttgaagcatggaatgaaaaatatctggggttgccagtgtatatggggagatcaaagaaaaagaccttcaattatttgaaggagagggtctggaagaagatacaaggctggaaggagaagttgttgtcgcgtgccgggaaggatattttgatcaaagctgtggcacaagctattccagcttttgcaatgtcatgttttgacctgacaaaaaccctttacgatgaaataagcagtttgatctcccgtttcttttgggcacagcatgatcgggaaaacaaaatgcattggattgcctgggacaaactatgcagtcgaacggaaaaagggggcctgggatacagagacctccaccttttcaatctagcgatgttagcccatcaagcgtggcggctcctttccaatctagactcattgtgcgcaagagtgttaaaggccaaatatttcccagatgggaagcttatggaggttagagaaagtccgggcatctcatattcttggagaagtattgttcggggggtgcaggtgttgaaggttggcctaatctggcgtgttggtgatggtaccgacatagatatgtggaacgacccatggatccccttgggtacaaccaagaggccaattaccccaaggagagggatcgttctgaacaaagttgctgacttaattaatccaattaccggagaatgggatagagagttgatccaggatatattctgggaggaggatgtgaaaaacattctagccatcccagttcataatggctatagcgatgttgcagcatggcattttgacccaaggggcattttttcggtgaagtcggcataccacactctggaatatcagcgtgatcgtcaggcaatacgacaaacaggtgaatcttcatcggggaaaacgagcagtgcagcccttcagtgggagaagctatggagactgaatcaccttcctaaggtgaagcatttcctgtggcgcttagcgcacaacagtttgccactccgtcagaatatcagtaaaagaggtatggagatcgatacaaggtgcccagtctgcctccggttagatgagaatggtggccactgtttcttcaagtgcaaatttgtcaaaccttgttggcgcatgctgaactttgagcacattaggcaggagctttctcttcagacttctacgttggatgtatgtaagcacattctgaatttgagagaagacattatgttaacgactgtcatactgctctggaattggtgggatgcaagaaacaaagtgaatgctggggaggataggagaacgcatgaagaggtatatagcagagtcataaggatggtgtcagaaaactccttgctctttcgggacaaagctcggggaaatcctagcagtcaaagtacatggtgtccgcctccccagtgtgttctaaagctgaacattgatggtgctttccaggcggctaatctaagtggtggttggggctttatcctccgggaccatgaggggaatggggtactggctagagcaggacgaatcgaactggtgcatgatgcgcttagcgcggaagccgtcgcttgtctgcatgccttgcgtgctgttctaaatcatggtttttcgtatttctctgttgaaacagatagctccatcctggtgagcgcactggactccgcttgctacgaccagtctacggcgggcgtgacttttaaacaaattagaactctgctccgtatggacttaggtatgatcaaggtgtcttttgctaatcattcatgtaatagttgtgctcatgaactggcccggaaaggggctagttgggacccgtgtcatatgtccatatgggcagaccccctcccggattttgtacagtgttttgtggttcgtgattacactgaaccaaggtattaataaagagcacgtttcctgtcaaaaaaaaaactactagctctagtttatctatagtcaatctaagagcgggtacaatagcaaactattagccagctataaacatattttaatgagataaaggacgagagagaagagcagctgtcggtgatatgggaccgggggtatcgagaccagaggcttgaggcagacacaatcgcccacgtggcctggcaccctcggggacgtcgggcccaagggtgaggtgtccgccctcctcttgatttccccgaggggggtcgggtgactcctgtcccggccccgagggccgaggcgccccgaccccttgagggtttttgcgtcacatatatgggttaggtgaacacggcagggctcatctaaccgcatttattgcggtctggtcaagcgtgtcacgctgcatgcagcgcagtgcagcgcgttcctttatccggtctgtgaccagtcacagaccggtcagatcacgggttaggtggcgactggcggtctgacgcacgcctcgccccatcccgtcaagacgagagcctctaggcactcgtctctagccggagctagcgtgttgcctctcagagatggcacgttaccttcggtcagatatataccaggcttcatcccaaccattacaggaaaaatgttacatgaagaagggcgaacatgcacgttgctaaactgacgcgtggtggacaaggatgactgatctgtgaccggactgacactggacgcgtcatccacagacag

SEQ ID NO: 40734 - DNA, 2422 bp, Oryza sativa
atcatttatcttcttaaaatatgtttgcagctagcttatagcctgctattgtatcttctctaactgtaatacattatgaatacacagacaaatatcttgaaaaagatacattatgtcattgaaacatttgaaaaatacacagacaaaaactagtgtgcaatgaaccaacattagaaaaacatgtaaaaaatatgttgataagtagagtgcaacatcaataataagtagaaaaaggcgaaaccctgttaaattcaaggtgaaacattttctggaacattaagtgccaactatcgaagcatcaaaaataacaaatctaaaaacatgaaacacagtcaatttcaagatataacatttcactattgcccgtgaaaaattgtagtccatttgttgaaacatcaagatttgcaaagcataccaatatggctttcttcctcccgcttccacaccaggttgtagagatctcattcgccagttacagcgtcttgacatctccattgtagctgtcgttagcttcatcatccttatgcagtcgtgcgtcaactctactttgtggcatgacgaagcaaacccgacgcccaacaccacacatttgcacatgtcagtatgtcactccaccttgaaggtcaagtttcatctgaggttgctgcctcccggctacttccctgcgacaaccctttgcttagccacctttgctcacgaccggttccccccgagcactatatggccaggtccaacaaggagatggcaacggtgaggaagaacttgaacgggaacatagaggcaagggagggcatcgatcttaacaacgtcaatgatgtggggatgggtttggaggagattgctaattgggttgcttattgacatgcaaggatggagagagtgaatgagttttgggctttggatgcctgaggaaaagcattatcgtccctatttccctcaacaccatatcatcacttgacctctctaacttgattctgctatagacctaattcatcatcctctgttggtctcctcttcttctcctatcttagatcattatgtcaaggtcttatttgcattggttgaaatccagcccgtaaattatacaagatctgaagaatcatttgagattgtgaaacgtcgcgtgttgcataaatggaagtggtcttccagacgaaggtctacacacgtggactgtgatgtttggctcagtactaagcttttttaaagtttgccgtactttacgactctattttttgtttcattacatctagtttggctcggcatgcatgcgcgacaatgttagggaaccatccacacagatcttacggtggatgtgccacgattgaggcatatccaaatgactactcccaccgtctcaaaatataagcatttttagcacagtaacaagtcaaacatttttaactttgactattaatagaaaaaaaaaatcaatcatgtaaaattaaagttactagatttatcacgaaacaaactatcataatatgtaactctttttatttaaaatattatttatatatatattaattattggtcaaattagcatcttgtagaccatgttagagtctgaaaatgcttatattttgggacggagagagtaagttaccagagtatttgagtaaagcatgggcggcgagaaatctcattgccgacccaagtacccaactgcgagtcgaattcaattgaaatttctcaagttcaaaggaaatcaaggtctaccaagtccaatggaactgcaaaaagatgttcccaataaataattggccacttactcacttgccacagcgcgtgtcaatccgacttgcacccgttgtccgttgcacgtgcaagcagctatagtcatctggaaatggagtcgccgccggcgcacgagcagttgacgagaggccggccatggccgatcggcatcgtcgtcaacagcgggttcctctcgaagaagttggacggccggagctcgagcccgccgctcagcgtcggcatcaccgggaagtcctcctggtacggcacgtggtgcagccccaccgtgtaccacagcacgatgtcctcgccgcggatcgccctgtcccgctcgctccacgcagcgaggccgtcgccgccggtgctctggtcggcgtacagccccgacgcccacttctccgacctgctgtacggcgtcacccgcacctgcttcttgcagtaggcggcgcgcctctgcgggaagtcgtcgtcggccagcaccgacgccgccatcgcgccgccggggacgacgcggtacccgacctcgttccccatcctcgtcttcttccccgggttgacgaacaccaggtcggccggggcgccgccgccgaggtccacctgcccgtccgcctccctctccgccacctcccgccgcaccgtccagtagctccgcctcggcgtgtctgccggcgcgtcggggtcggcg

SEQ ID NO: 40735 - DNA, 2102 bp, Oryza sativa
gctaattaagctctcgttgattcgattctgcgtcgattaccacgagcttgatggagccgctcgtcttgaactcccagtccaagatgtagtcgtagttgccggcggacaccaccatcctcgccaccaagctcacgtcggggcgcacctccgtgatctgcatcaagaatcacacaccgaatcagccaaagattgagagtttgagacacgacgacggccacgaagacgaagggctttctgttcatgatcaaatatcaccagctggttggggaagccggcctcggtgtggcgccacgcgacgtcgccggagtagcgctcgaagacgcagatcatgttcctggcctcgacggggcggccgtcctggccggagtagtggccgtcgaggtaggcggcgttggcggggcagtcgccgccgggctggagcgggaaggcccagaggccgaggccgtactcgccggcgtcgaggaacgtgcggtagtaccactcctcgaccgggtccatgtacgggacgaagatctccgacacgaagccgcggtagagcacctgccgccgccgccgcgcgccgccggcgtcggcgtcggcgtcgtggacggaggccagcgagatgaccgtgccggcccgcatgtcgaagcccacgtggaactcccagttggcccacctgcagttgccgcagcacagccatatgcagcatccgtgcatgatgcatgtgcgcgtcagattgtcagctgatgaatgaattggtgaaatatggacctgttcttcagtcctctgcgtgaaaaaggttcaattctcgtatgggtttaacaaaactagcagtagatgagttgatcattagagagaggggcttagggcctgtttggagagctacgaaactgtctagctttttctcaaactatgataaagttgtagctacaaaataaagtgaaatactaaaaaacaatcagaaactaaaatttcagattctgattcacataaactgctttttagaatctaaagtttttccaattcaatcattggtaacttgatgagtagcaggaaaagaaaaagaaaaaatcttacaaattaggagcaaagactgaagaaactgcttccaccgaaaagcaggaataagtattcttcacaattcacatcgcaatctgactctcagaaaacctctcactctacttaatactatcctaaatccaagtaccaaactaagtactctagtcagctttaatttgcatgagaggctcaaacaggtggcaggaatgtaaatagagattttgtagtttaaacaacgattttgctatatttcactcgaaagatttttttttatctctcattcgattttctcactcaaatttacaatgtattttcttgtaagttacagtgtaatttttaaatcttcgcatgtaagttttaaaatttatattggatttggtctttttcttgaagatatggtcatttagtgtctattatggtgtttcttaattgcttttttgctttttactgtgtccattgaattttaattcaaagattaaaaatatatgtaatataatcataaaaatctttcgaaagatgtatatgtactccctttaaacaaaccaaacaaccatattttaccaaaattttgtcaagccaaataaaatcgcttaccaatgttttggtcacgttttcccaccgaaaccggttgaaaacaacacaaaattgtcaagccaatgtcttgacgtgggacgaaagcagttctcgatgaaatttcaagtggttttcaagaaattcaaattttaaatattaaattcaaccaaaattgattaaagaatgacgaaaatcactgtacagctagaagttgggatccgtcagtccattggaaaggtaaaccctctctttctctcatgagtcatcaatcaaaacacaccaaaatatctatgctggtgcgctgtacatatcaatatctatcctaatgcattgtacatgtcaatggaaaagtattttcatccctcaaatgaatattcctcgtttcttacatatcatctaaacaaccataaaaaagttgaaaaaaatataagatagattaatatgaaatatatcactacataaacatgtaatttcaaattctcgacttctac

SEQ ID NO: 40736 - DNA, 1046 bp, Oryza sativa
atcgccgtcccctgacggcgactatccttgggatttctcacgcgtggtgcacgagcttctaatagttcaaattgaaaatatcacaacgatacgtggatgcatcacacggcacaagtacaagcttgaacaagctgctagtaatggtcaaagcgattacctgacgacgtggccgtcgatgtggaagcccctgccctccggctgcaccaccacgccgggcgccggcgccggcccggcgtacggcggcccggccttgccggcgcggtagtccgtcccctccgccttgggcaccgggtacgccaccctgtccctgtacccgacgatggccatccggtcgaggtccaccaccagcgtcacgccctccagcggccgcgcgtagaagttggccgtcgcgccggcgacgaagcagagcaccttcgccaccctgctgcggcggggctcgccgtcgccgccgaaccaaccgacggggaacaccgcgcagagcacgtcgtccatgtccaccccgcgccgccgcaccgactccacgaacggcgggtgcttcggcggcagcgccaccgccgcgaactgctcctccagcgtcagcgtcgggaagccggcgccgcggtggacggcgtgcgagaggacggacggggaggaggcgttggcgacgtcgacgcggagctcgtgggactcgccgccggcgcgggcgatgacgaacgcgcggcgcgggagggcgtggcgcgaggcgccgccgccaccgccgtaggcgtaggagagcacatcgggtttgtcgggctcgtcgaggccgacgtagtggaaggtgagcgggcgggccgggacgagcggggaggcgagcaccgcggcgcggacggcggtaagctcggcggcggagagggggtcgagcgggtgggggcggggtgcgcccgcggcggcagcggcgacggcgagcgcggcgaggaggagagggagaggaagcatcgcgcggagtggcattcgggcgatcggattagcagcgacagtgacaacttatactggactaaattgaattaaataataatgggctgcaggaa

SEQ ID NO: 40737 - DNA, 2798 bp, Oryza sativa
  unsure (1)..(2798): unsure at all n locations
tgtagttagtgaagcccatgtaattagttgggccgtaacggtactgtaccacctatatatttatcgataaattttgtcctaaaaatttgacagatgtaattatagtacaatcgtaatgtaattatattgtaacttgcatataactacagtgtaacttgtattctctccatactcgtaaaagaagtcgtttaggacaatgtttaagtcaaatcttgagaatataaatcatgaataactctaaagttgttgagtttgaaaatgtaaaaattatatgaatagatttgtcttgaaaaatactttcataaaagtatacatatatcacttttcaatgaatatttttatagaaacaagaagtcaaagttgtattttggagaccgtgtcgatgtcctaaacgacttcctttgtgagtatggagggagtatgtaagtttcacgtaattctgaatcgtgagatctattacaagatttgttctggtgaggaagaaaaaaacacaacacacacatatgtcaaagaatttatttccatgacctccattttaccgaaataatatgttacggagaaatttttgaaagttacattatagttacagtgtaattacactacgattgtactgtaattacatctatcaaatttttgggagaaaatttatcaacaaatatatagcaaaattgttctagtaactagaggatgccccgcgtgttgctgctggatttggttaacatcgatttgttagataggaggtacaatctcaagaaaaaacaaatagatttcttggagaaattctttttagcagccctatctaaaatttgtagataatttaggtagcacatgttaactgaaggggcgtttagccataaagctcttttatacggattgacaggctaaatacatgtagatgtgtatggagatgggccaatgtgttcatgtgggctatatttggcactgaggaggcgaagagactcactcggtaactaatgagttgggctctatgctgcattccatccaacgtctgagaaacgatctaatgcattcatcaaacggttcacaatttgatgatgagtggaagcacgaggtttgagcttttggtcttcactttatagaaagaaggataagtctattttgcctccctcggctcttgtccttggttgaatcctatacctcaaccacaaataaacactggcggtctggcatcaaataaacactactgctacactagccgagagcccatatgttgcagcggaaagctaattgagtttctaacatattaagtcaatcacatgtaattattatttttatattgaacaagtaggtgattttgaaatttaggtgataaccaacactgaaacggaaaagaacttgttggaggatgatgtaaatatgtagtagtataaattgtgggatccaaatattgagatagggtgatatcgtagaacgaatacgatcactgctaacattttaagtagtactacgtagatatggatacttcaacatcatgagattagatgaactaccgatatccagaggtcaaaaggattgtttacattgaaacaaagcagtgccgggtgaaattaacagctcttttcttatccctccagggatagatacatacaagagtgctccataaaagtagaagcatatttctcttttagatagctattgctgtccaggttcacacaagagttgtatcaggcacattccttctgcaaattcatcagccatcttgaagccatagtctcacagtcctatcattgtcgaggccgcccgacgcaattttgttctccgttggatggcaggacaccgagatgacagtgtcagtatggccttcaagtttctgaagaatgttcttcccttggagatcccatatgtacacacagttgtcttctgatccactaacaatatacttcccatttgtaacggaaaacgcggactggaggcaatactttctgttaacatgtccactgtacatcttcaagaacttgccacttgcaaagttgcatagtttctgaaatttggtaaggacatacttatgaagcaaaggttgcaataaccatatattttccaaatgaaataaataactaatttataaaaacattccgtgaaaaatgaagtaaaatcactacatgaggaagcccatgatagaataacacaatgccaaaatttcttacaatgttgcttgatgtgaagcattattgacctaaatgcccataaagttttacagatgtaaacagtacaagggctgaaggagtgaaggtgtatgtatgcacaatgaataccatggatcaacctaatagtctaatactaatataaagcactgataacaacatttgcactgcaagtttcatatttctttcatatgcctccaattacttgaattatgcatgaaacagtgatctgttatcgtgtgaactgatgtgcccaaataaacttcagaagcagttttttaaaaccatttaacaacataactatctgaagataaacttttcacagtactaagaccacacagatcaagaacatgaggtttggtgtgaaactgggtaagtatagacatacttagttcaacatgtaacatattggttaccttaaatcttgggcaacggctttaacgaaatgatcctcagagtgaaggatctttgattgtattggtaactataatttcttttctgtgtgaaactganacaagatgtgctatatggccgccagtaatactagattaaataattagcagttggaggaacaatctgcctatgaaaaagaccacggcgaataccagaaataaagctacgataggcttctattca

SEQ ID NO: 40738 - DNA, 2843 bp, Oryza sativa
ccgtcggcgtgcccccgcagggtggcgatggcggcgagcgacgacggggagagcagcgcgaccgtgccgtcgagggacgccgtcgcgaggaggcgcccgcatggggagaacctcacgcacgagacggcgcggctgtgcggggtcgccgccctcacctgccggtacggccggtacggcggcgccggcgcctgctgctgctgcgacatcagcggcggcgcgccctcgccgacggtgaaaaggtggggaaaagtgtgagacgcgtgttctcctctcttcgacacggacccgagatttgatcaaaagtaccttccattaaaattgaaatttgaggatttattttctttgacgcaggatttacttttttaaacacagtaaaaacagtgcatccaaaactactcccactgtcaataaaataaaataaaatacatactactaagagaggatgtgacctctccagcccttgtaatacgacgaatctaggagagagtagacctcagcgtacactctttccctgtaaacatctaaaaaaaccctgctccctccaactcataatataagggattttgagtttttacttgtaatatttaaccactcgtcttatttaattttttttgcaaatataaaaaataaaaaattatgcttaaagtactttggataataaagtaagtcaaaaaaaaataattctatttttttaataagacgaatggtcaaatagtataagtaaaaactcagaatcccttatattatgagacggaggaagtataacttatggtgacctcggatgcctcgacagaaacattgtcaaaataattaaacataaatagaaatatctgtgtgaagtttagaatttaaatgcaagtgaataggtttcactacaaggaagaaaattgttcacttctcgagaatttactcgtatttggttaagagcaggtagcatagcaaagtataaaccagctataaacatatgtcgagaagataaaagaaaagagagatgaacaacaagctatttatagctaggtgtaacacggactccaagacacgatgtatattatgacaggtgagaccatctattaatagtggttatatgtttatagataactaataattggctatatctctaacactaaaacgtggctatagctctaacacaaacgtggacaagagggaccaggatcctctgtagccgaagtcacttaactttatcactgatatgtgggtttgataatccctagattcacatgtaagtgataaaaatatcgtgcatttgactgcagagagcatctcagtccggataggaggggtaaatcacagttactgtaccaatccaaaatatttggtcaaattttacggttgcggattcgcgacttcacgtttcccctttccctatcggcggcgtcccaaatagcgaatcggttcgtgtaaaaaaaaaagtgagccgcttagcctcgccggcgccgcctctctccgggaagcggcggcgagaacgcggaggagagagagagttcggggttggcccgtcgcgtcgccggagcgatggatcttctgaagagggagctggagaagaagcggaaggcggcgacggccgacttcggcgggaagagcttcgtgcggcggtcggagctggagcagaagcagctccagaagcggcgccacgaggagcaccgccagctcctctccaaggccccgccggcgacctcctccgcctccgccgcgggctccgaccccagcaaccccaacgccgacccggcccagtcctccgccgcaaaccctaaccctaactcctcctcgtccgccgccgccgcgtccgtcccgccgggcctcgcggggaagaagaccgcgcaggatgaggcgctcctctccgaggagcgccggatcgacgagctcgacctcccgcggcatgaggtggtgcggcgcctccgcatcctgcgcgagcccgtcacgctgttcggggaggacgacgccgaccggctcgcccgcctcaagttcgtgctcaagtccggcgtgattgacgacatcgacgaccttgacatgacagaggggcagacgaacgacttcctccgtgacatggtcgagctccgcaagcggcagagggctggccgggacacctatgtcaagggcaagggcaaacgagcgggcggcggtgatggcggcgagggtggcgctggcggggataatgctgatgatggggatggggacggccggaggagtggggatgatgctgatgcggacaaggactcgaaacggatgaagaccaagtttgaggagctgtgtgatgaggacaagatcttggtgttcttcaagaagctactcattgagtggaaccaggagcttgatgagatgccggagctggagaagaggacagcaaagggcaagtcgatggtcgcaaccttcaagcaatgtgcgcggtatctcagccccctgtttgagttttgcaggaagcaggtgagaatccttttgtactgcatcaataagttacataaacaatgcattgttaaatgttaatttggttgtgtctataacttcagtaattgttagaaaaaactttaactaataaaacaatggtgtggattaggatttgaaatgaagcttgtagctgaatggcttacgtcgaagttatgatcctgggacctgggtaactggttaccatgatgaatgcattttatgaccatatcagaaagaagagatggcaaagctcggcgtctatgttttttgtagaaactgtctaactgtttgtgcttcactgttcggagctttgatatttcgtggtaattgtggtgacctctatgcatggcacctgggttcttaaagaacagcttactagcatatcaagaagctttagtgtc

SEQ ID NO: 40739 - DNA, 1129 bp, Oryza sativa
  unsure (1)..(1129): unsure at all n locations
ctttgttcctattgggatttgcctttgttctctactagcattatattctgatcctgaattcactgttatatagatacttagctgtccagatttagtactggcattgaaattaaatttctacaaaattatgccttctgtcatggattcagcctcaatgtaattttggatttccttgcagtggatccagtttcttactataccttgttgagctaaatcatattgctcatatgggggatatttttatgcattttaaggctacctatgacttccttgactacatattgtttggcaactctgataccaattattgttttgatttatgtttaggttcttcctgatgacatccgtcaagcattgctcgttattgttgaatgctgcatgaagcgtgattatttagcagcaatggaccaatacatcaagctggccattggcaatgcaccatggcctattggtgtcactatggttggtatccacgagcgttcggcccgagaaaagatctacacaaacagtgtggcgcacattatgaacgatgagaccactcgcaagtaccttcagtcaatcaagaggcttatgaccctttgccagcgacgttatcctgctctgccctcaaaatcggtggagttcaacagcctggcaaatgggagtgacctgcaggcccttttgtcagaggagaaagatccaggaaaccctcctagcgaggataggcttcgactcatgccagcgtcaaaagagtgatgcttcaacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
